United States Patent 6,812,339 (POLYMORPHISMS IN KNOWN GENES ASSOCIATED WITH HUMAN DISEASE, METHODS OF DETECTION AND USES THEREOF) - sequence listing, part 85

SEQ ID NO: 28417 - DNA, 601 bp, Human
ttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaawatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaagagaaagatggtctcctgagttttttaaaatagctcacttggtgtgatatggctgact

SEQ ID NO: 28418 - DNA, 601 bp, Human
taaaagatgcagggtttttttggggggctaaatatctccctatgataaaaggaagacaaaaactcataagaataattgatttttcttctcctaacaaagaagttaatcactatgatctattctgtcatagttaggtctagttcccaacaggttctaactataaatttgttttatttcattttgtatacatataattttacatacaaaactgatgtaaattagaaatcaaggcatcttttgtggggctttttcatgttattctaagtgtttttttagttccagtaagacagtcttaatgcartataaccagttttataaaaagatttctagatatgcattaaacatcaaaggtttcaagctgtctcttcagattagtgaggatcatttctgtaagtaggagttccagaaatgatgagtagagtttatcaatttagcatggaaaaactaattcaaattctgcttttagggattacaacatggattttttgactttgagacatttgatgtggatgaatatgaacattatgaggtttgtacatttaattttttttacaaaacataatttcatgttgattaattttttccccctgtcacactcatg

SEQ ID NO: 28419 - DNA, 601 bp, Human
ttgcagtttttacttttaataatgactgagtgaactagtcatttgactctgctgttcttcagttttcgaactttaaaatgagggcctgggaagagatgaataaaaacatctcttttgactctgataccgtgttcatgtgtttggtcagcttaactccaggactttgttgtggttcagtgatgccagcgcaccatcttgtggccagatggagtaagggtcggatgaaggctccataagttctgggtcggcacattatacacattgctaaaaccaatctctcgcaaaaagcactcacgtacagccgtaaaagccacaaacagttgttcacaggtcataggacatttccattgttcgttataatttattctaaacagttttaaggatttttataaaacctactcaccaattctaaccgctcatgttcatatcatgttctcttatttggagtcttaacagatagaatcaagttgaatcttacttgaaattagccccagcatgggtgttggaatctgactgccaggattgaaatactggctctacctcttactagctgtatgtgtacgggccagcttttccaggcaccagaaattgagtaattgta

SEQ ID NO: 28420 - DNA, 601 bp, Human
ttgctaaaaccaatctctcgcaaaaagcactcacgtacatccgtaaaagccacaaacagttgttcacaggtcataggacatttccattgttcgttataatttattctaaacagttttaaggatttttataaaacctactcaccaattctaaccgctcatgttcatatcatgttctcttatttggagtcttaacagatagaatcaagttgaatcttacttgaaattagccccagcatgggtgttggaatctgactgccaggattgaaatactggctctacctcttactagctgtatgtgtaygggccagcttttccaggcaccagaaattgagtaattgtaggttttaatgagataatccacataaagcacttagcatagtggctagcatatagtaagtgcttgataaacgttaggtgcaattattgttgttattattatttcagtgccctgttgccatatttggacaatttctgtccagtgttttcttctcaaaagatgtatacatcgtttctcttaatagtctatttaggcatgttagctatgctgccatttactcatgatggaaattcatatatgaaaagagagattcttgcagccttt

SEQ ID NO: 28421 - DNA, 601 bp, Human
ttatttggagtcttaacagatagaatcaagttgaatcttacttgaaattagccccagcatgggtgttggaatctgactgccaggattgaaatactggctctacctcttactagctgtatgtgtacgggccagcttttccaggcaccagaaattgagtaattgtaggttttaatgagataatccacataaagcacttagcatagtggctagcatatagtaagtgcttgataaacgttaggtgcaattattgttgttattattatttcagtgccctgttgccatatttggacaatttctgtcsagtgttttcttctcaaaagatgtatacatcgtttctcttaatagtctatttaggcatgttagctatgctgccatttactcatgatggaaattcatatatgaaaagagagattcttgcagcctttgttgcagggaggaaggggataggcactgaaccaattgctaacacaacgtgtgacaggtgctgtcatggaggtcccaggcatgctagcaacccagaggcagaagctctcaccagcccgccacaccagggcaggctgcccaggtgtttatgagcccttctcctccccattcctcacat

SEQ ID NO: 28422 - DNA, 601 bp, Human
gtacgggccagcttttccaggcaccagaaattgagtaattgtaggttttaatgagataatccacataaagcacttagcatagtggctagcatatagtaagtgcttgataaacgttaggtgcaattattgttgttattattatttcagtgccctgttgccatatttggacaatttctgtccagtgttttcttctcaaaagatgtatacatcgtttctcttaatagtctatttaggcatgttagctatgctgccatttactcatgatggaaattcatatatgaaaagagagattcttgcagcytttgttgcagggaggaaggggataggcactgaaccaattgctaacacaacgtgtgacaggtgctgtcatggaggtcccaggcatgctagcaacccagaggcagaagctctcaccagcccgccacaccagggcaggctgcccaggtgtttatgagcccttctcctccccattcctcacatgatagaaaaaccgttacttcttaatgccaactacagttctttttttgctttaggctataaatctgttgcagggaaataatttgagcaagtaaaccaactaggaaaacagacttgatttttg

SEQ ID NO: 28423 - DNA, 601 bp, Human
caattattgttgttattattatttcagtgccctgttgccatatttggacaatttctgtccagtgttttcttctcaaaagatgtatacatcgtttctcttaatagtctatttaggcatgttagctatgctgccatttactcatgatggaaattcatatatgaaaagagagattcttgcagcctttgttgcagggaggaaggggataggcactgaaccaattgctaacacaacgtgtgacaggtgctgtcatggaggtcccaggcatgctagcaacccagaggcagaagctctcaccagcccrccacaccagggcaggctgcccaggtgtttatgagcccttctcctccccattcctcacatgatagaaaaaccgttacttcttaatgccaactacagttctttttttgctttaggctataaatctgttgcagggaaataatttgagcaagtaaaccaactaggaaaacagacttgatttttgcagttagaaaagcatgttttctccatgtttgtgtaggttattgtttctacacagaagattttaaataagctctgttttacctgtttgctcaaaagcaacatagcctgtgaaaatcacata

SEQ ID NO: 28424 - DNA, 601 bp, Human
cctcccaaagtgcggggattacaggtgtgagccaccgtacccagtctgtattgtagatgtttttattttaaatcagaacctttaacattgaagtcagttcttgtataggatagtcacatttacatgtggtaatatctttttgagattgttatttcattttcttccacttgcacacacacgtaggattcttttataaggattacacctttggtttaattacagctgtattgcttttcacagcatacttatctactataggcttattaattattttgacatctgccctaattaagtcagcttmgttttctgggaattcaagcagcactcagtcttttaattgaactaaaagaaggaaggagaaagaatcttatcctatgtcaaatgaactttggtggctactgaaaagggaatgaatatgtcatgcctcaacgtaaagtattttatacagagataaactagaaaccaatttgctggggattacatttcaatatctgcatttcactttgtggttgataaaagagatggctatgaattcttgaaattctctaccacaaataataatctaaaatacagcaacgttgtgatagtccagtatgtgatt

SEQ ID NO: 28425 - DNA, 601 bp, Human
ctaagctagttcctcagctttaccttctatttttgaaaattgaataagcaattcttacctgtgcctgtaaagttataagccatcttgactttgaagtctcaaactactcaccagaatcaatgatgggacttgacttctgatcacatttgaaacctgctgatagctcagattgggtttaaaaaaaggggaatcaaaaggtgcaaacgtttgtaaatatcatcattttttaaaattacaatatactgggtggcaaggccccagtccacaaattaatataatggtaagcagcaacatttttttracttataaataagagatacacatagcagaaggatgttttgccggtatggtaaacaccaaacagattcacagggaatttagttttcatgtgtaatctgggagaaactataacactgtagtcagattgggtctttactgagttcctgatctaaggaataaaggttcatattgctcaaagatgaggttatcattttctgcagtattatgagaaaaggggatagcaagcctggttctgggtagtctaatatccatttgcaaggtttctcccttttgctaatttaatatttttactggtttgata

SEQ ID NO: 28426 - DNA, 601 bp, Human
aagaggatggatttgacatataagaagtggaatctaaggttgtgctgaggaatgaataccagtggcaaagaagggcagtggcccaggaagacaggatcatggctaagagcaggactttgactcctgggtttgaatcccaggtctgctgttcactaactgagtgactggatgaggaacttttcctctgtgtttttgtttcctcacttgtaaagtaaggacagcaatattagctacttcgtagggttgttgtaaggacaagctgagctgacatctttaaggttcttagaacagtgcctggcaattagtgctgtgtcagtggtggctgccgctgctgtcatcactattaggacctgtcatgatatctttaagattgattaatttatcttgtcctagttagttgctgaatgtttaagataagactactttattgtgacactttgccatttttctccgcaaagattaagttcatccctgcaaggatctgcagttactttgaagacatcaaaaatggcactgtccccttcagcaacggccaagaggatcaacagaacttctttgtcttcgggtgccactgtaagaaggtaatttttctctccctctt

SEQ ID NO: 28427 - DNA, 601 bp, Human
tatttacatgtacagtgttacattatatatgtattgtgaactttaaaagactattttgataaatttataaatatataaaattatgtaaaaactacactatattttgatttagattttcctgctgtttgctaccaaaaatttgtattttaaatctgtttagttttagtatggttttgtctctaatgaataaataattccttcttattaagaagaagtaagggagaaagtttttagaaagtgatttttatgctcgcactataaatatggcaggtcagttcattcttttgggaagtcagtttarttacactgagtttatccaagtttatctctaccaagagtataatggcatgggatggcttatttaggacaattccctttcccattgtttttgttgctgagccaatttgagttagttttgcatcctggggggctttaaaatacagcatgcagtgaaagatcagaattcactgaatatttcttctgagagcatggtttcatggtttttctctatgaaatgactcaatattccaaatgtttttttttccttcctcctttcaaaagagttcttaacccaattaggatatcctgctttgggtatgag

SEQ ID NO: 28428 - DNA, 601 bp, Human
tctccagtagctgggattatggcactcaccacctcgcctggctaatttttgtatttttagtggagacaaggtttcgccatgttggccaggctggtcttaaagtcctgatctcaagtgatctgcccacctcagcctcccaaagtgctgggattacaggcgtgagctaccacacctggcctaaattgtgcacttttaaatgattaattttatgtaaattttacctcaaatttttttaaaaaagaaagctcctggagagctccaagaagatgaaattaatagaatacctaatgtgttttaaacrcattaaaaagagatcttaataattgggccaaggtttgagaatgacttagtattagtacacagaaaactaaacaaatgaaaactagaaactctaagaacaataactttaggccaggtgcagtggttcactcctgtaatcccagcactttgggtggtcaaggcaggcagatcacttgaggccaggagttcagaccagcctggccaacatggcaaaaccccacctctactaagaatacaaaaattagccaggtgtggtggcacactcctgtaatcccagctagttgagtggctgagacatgag

SEQ ID NO: 28429 - DNA, 601 bp, Human
tcagtcattctaaaatgaaagtcaggaataacaaactgcaaaagtagtgttcagctatcactggctctgggcactgttactcataaactgtaagacagtccagaatatctctgaacttttgaactattgggcaaccaaactttgtaataagtgatatccacaaaaacaacaaaatgttccagcaatcccctgtgtactatacaaaagtcaaaatcagagcatttctgttgtggggatccatgactaaatgcaaaaaacctgttagcaaacataacaatggtgctgctattggatgccaccrtcacactctttgcaactctgtaaataatagtcatatctaagtatatacatattatttaaagattacataattttcattcacatttacttatcaaagactacaaattaatgttgctttaacttttcatgacattaaaagtagtttttatagaagtctcatcatttttatttaattatattttcctatggacttgtgataactcactccattttcccatgacctcagctccaaccacttcacccttcaaatgaagtgggaattttcaatccatctacatcattacatggatttgaaattggt

SEQ ID NO: 28430 - DNA, 601 bp, Human
gcctttaaaatatacagtaatttatctctcctgcttgaaggcttacctgtcatcaaagagtacttcatgaattaagagtttagattcattttcagtttttcaattttaaatgttgcaatcaaagtctctctctctgtcattctataaatgaattagagaccattttttcaaacaaatttttcaaataaactcagtgagaaactctaccaactggtaagtgcaatattcagtcattctaaaatgaaagtcaggaataacaaactgcaaaagtagtgttcagctatcactggctctgggcacygttactcataaactgtaagacagtccagaatatctctgaacttttgaactattgggcaaccaaactttgtaataagtgatatccacaaaaacaacaaaatgttccagcaatcccctgtgtactatacaaaagtcaaaatcagagcatttctgttgtggggatccatgactaaatgcaaaaaacctgttagcaaacataacaatggtgctgctattggatgccaccgtcacactctttgcaactctgtaaataatagtcatatctaagtatatacatattatttaaagattacataatttt

SEQ ID NO: 28431 - DNA, 601 bp, Human
ttctctgtcagattgctttcttctcccatttcactctctcatgcatctcaaccccttattcctatctcacctcactcccgccttctcttccctcccctttccttccctttctttcttctctcccttgttctctcctttcccctccctccatcttcttctccctctgtctgtcttcctgtgtttctttcctctcctttgttacatctgcttgtctttcttggaatttatattctgaatataaactattcaaatacatggaaaaaactcatgttagaatgaactaaaaggacaccactgcttyacattttagaactactctataataaatatcatgaagaattattgaaatacttaccctgaagcattatataagtctgcaagctgatatagaatatcaatttctagtggtgtgacttgtccatagcgtatggcactctgggcaaattcctctggaacagagaaaaaaaaagttaaaatcttgaatgattcttaatatataacaaagttctaccttcaccaactataatataacctgaaagctataggcattttagtatcatttttaaaatctaaaattgaatttaaatatttaagttcaact

SEQ ID NO: 28432 - DNA, 601 bp, Human
gaatataaattccaagagaaaaagacaagcagatgtaacagaggagaagaaagaaacacagggtctggacacagggagccttcacttcagtctccgactggtcacaggccaggctggtctcaaacttttgacctcagatgatctacccaccttggcctcccaaagtgctgggattacaggcgtgagccactgggcccagcctctttcccactttatgaaccctatcacaacccttctcttctctgtcagattgctttcttctcccatttcactctctcatgcatctcaaccccttattccyatctcacctcactcccgccttctcttccctcccctttccttccctttctttcttctctcccttgttctctcctttcccctccctccatcttcttctccctctgtctgtcttcctgtgtttctttcctctcctttgttacatctgcttgtctttcttggaatttatattctgaatataaactattcaaatacatggaaaaaactcatgttagaatgaactaaaaggacaccactgcttcacattttagaactactctataataaatatcatgaagaattattgaaatacttaccctgaagc

SEQ ID NO: 28433 - DNA, 601 bp, Human
aggtggttgctggtggacactaagtgcaactacctccactggaaaaatgctgctggggcaactcaggatacttcccaaggtcctttccagcctttaaccagggccaccttagcagggaccttaatcacttgggaaaatgaaaacaacaaactaacccatatgttcaccatagacaacaatttttgtcttaaaaaacaaagatcctttctcctgtgtggaactagttgtacttatgtttatcagccaactggattggaagctgtacacttgtatatttacccccttaaaatcaacatagctyccaataaccagtctctcattatacctctaactgcaactaccaagcacaaatgagccatccaactcataccccttttggtagggctaggaataactgcaggaatagcaataggagttagcaggcttccaacttccctatcctattaccaatgctcatccaaggatcttccagacagcttggaagacactgcccaaagtattgtcaccttacaaaatcaaacagactccttggcagcagtcactgtacaaaatagaaggagactggatctcctaactgctcaaaaagatggcttatgtcttt

SEQ ID NO: 28434 - DNA, 601 bp, Human
caagagctaaaaccaagggccctgctaagtcccctcacattcagaggggaacactctattcaactacctctatagccctgctatcccttagggaagcagcaggagccgaggggctggtctgagtgtaggtccccttctccataaataacatacaacaatgtaaagaaaaagctaggaagctattcagagaaccccagaaaatttgcagataggttccaagctttgaccttagcctttcatctctcatagagagacgttcaattcattccagcaacttgttgcaccccgttggaaaaggaakgaatctttgaggccacttgccgagaagcagacaatttatttgcccaaaaccctcagggtaattgcccaggcccagacacagtctccgctactgatcctaactgggactataacacccccatgggaatgaacaactgggccaaatttcttaaggctctccttggaggaatgaaaaagggaataactaaggcagtaaattatgataaagtaagggaggttgcacagggcaaggaggaaaatctagccgtgttttatggcaggctggaggaagcctttagaaaatataccaatctggaccctt

SEQ ID NO: 28435 - DNA, 601 bp, Human
acttaaaccccggaagatttgcaactagggctcttgagctgcttgctcaagcctgctcctgatctgtggagtatacttttgcttcaatacatctatgcttttgtcttctattgctttgtttgtgcgttttgtccaattctttgttcaatatgccaagaaactggacaacttgtagtcaagaccctccactggtaacatatcttggcaagtcagccaggaggtaagcccaaatttggggatttatttttctttgctttgcttttgctctttttcttttcctctctattgagccttcatttgmgggcacaggctagagctatctccatgcagagctccctacactccacagaggggaaccctttctgctctctttcccttttccaacacgggaccctccacagacagcatctaagcatgaaggcaactgcaggtctctggccaggtccactctcccgggagactgaaaggtatccatgtggaagcacctgaccaccattgcctggtttgggtgagggacctgagtccttttctttttttcagtctttcagaggctgtttcctagtagatccttggtaattgagggcaactagccagagccact

SEQ ID NO: 28436 - DNA, 601 bp, Human
ttttttttttttccaacgatatgttctttccaaccctttgagttttgacccatttttaggcaggagaatagggtctggagacaggcagccttcacttcagcctctgattggtcatgggccaagtcttcatttgcgtaggatgtaacttcagcctctgattggttgtaggctgagccttcacttcagcctccaattgatcacgggctgagccttcacttcagcctccgattggttgtgggccaagtcttcatttatatagggtgtaaccgataggaaacctctaatgggtacttaaaccccrgaagatttgcaactagggctcttgagctgcttgctcaagcctgctcctgatctgtggagtatacttttgcttcaatacatctatgcttttgtcttctattgctttgtttgtgcgttttgtccaattctttgttcaatatgccaagaaactggacaacttgtagtcaagaccctccactggtaacatatcttggcaagtcagccaggaggtaagcccaaatttggggatttatttttctttgctttgcttttgctctttttcttttcctctctattgagccttcatttgagggcacaggct

SEQ ID NO: 28437 - DNA, 601 bp, Human
caaggatacctatctaaaggacaggcgcaaagtatctgggaaggatacacataaatctgataaatactggttgcctcgaaggaaaggaacaagggtatgagggagactttttttttttttccaacgatatgttctttccaaccctttgagttttgacccatttttaggcaggagaatagggtctggagacaggcagccttcacttcagcctctgattggtcatgggccaagtcttcatttgcgtaggatgtaacttcagcctctgattggttgtaggctgagccttcacttcagcctccarttgatcacgggctgagccttcacttcagcctccgattggttgtgggccaagtcttcatttatatagggtgtaaccgataggaaacctctaatgggtacttaaaccccggaagatttgcaactagggctcttgagctgcttgctcaagcctgctcctgatctgtggagtatacttttgcttcaatacatctatgcttttgtcttctattgctttgtttgtgcgttttgtccaattctttgttcaatatgccaagaaactggacaacttgtagtcaagaccctccactggtaacatatcttg

SEQ ID NO: 28438 - DNA, 601 bp, Human
ctacccactaaatgtgtccccaaggatacctatctaaaggacaggcgcaaagtatctgggaaggatacacataaatctgataaatactggttgcctcgaaggaaaggaacaagggtatgagggagactttttttttttttccaacgatatgttctttccaaccctttgagttttgacccatttttaggcaggagaatagggtctggagacaggcagccttcacttcagcctctgattggtcatgggccaagtcttcatttgcgtaggatgtaacttcagcctctgattggttgtaggctgrgccttcacttcagcctccaattgatcacgggctgagccttcacttcagcctccgattggttgtgggccaagtcttcatttatatagggtgtaaccgataggaaacctctaatgggtacttaaaccccggaagatttgcaactagggctcttgagctgcttgctcaagcctgctcctgatctgtggagtatacttttgcttcaatacatctatgcttttgtcttctattgctttgtttgtgcgttttgtccaattctttgttcaatatgccaagaaactggacaacttgtagtcaagaccc

SEQ ID NO: 28439 - DNA, 601 bp, Human
cattttagtgaaataaaaaccttttaactctgttttcatcaacaaaaagcaaaagactccagagaaataatgtggagtgcatgaatttggtaagactccagtgatagatattaaaatcaaataattattgccagaagcaaaagtatagagattgactgtccctacccactaaatgtgtccccaaggatacctatctaaaggacaggcgcaaagtatctgggaaggatacacataaatctgataaatactggttgcctcgaaggaaaggaacaagggtatgagggagactttttttttttttccaacgatatgttctttccaaccctttgagttttgacccatttttaggcaggagaatagggtctggagacaggcagccttcacttcagcctctgattggtcatgggccaagtcttcatttgcgtaggatgtaacttcagcctctgattggttgtaggctgagccttcacttcagcctccaattgatcacgggctgagccttcacttcagcctccgattggttgtgggccaagtcttcatttatatagggtgtaaccgataggaaacctctaatgggtacttaaaccccggaagatttgca

SEQ ID NO: 28440 - DNA, 601 bp, Human
ataaagctttgttcgggcccagtctttcttaggaagatttctaagccaaatagttcaacagagctcagaataggctagggattaatgagcttgtatgtgcaaacaaacaagtacagtaaattacataaatggcatggacttgagcatgtagagagtattttcatagaatcccaagtggcgcccaaagagattaaaaaattaatctccctcccaaaggaaaccctatattctaatgtgaaaacacatacatgaaagtcattctctctccaaagagacaagttcctacaaagacaacggggggtggggaaaattctgcatggggcgcagtgctgcctctgatgccaactgcactgtgctcagtctagagtggctgctaacattccctgcgaaagaaaatctctctgttttgactgtacacctctgagctaagtgggggaaagaagcaagaattagacttggaaccaaagggttttccttttttttttttttttttaaaccttcagatggctcattggaaaaaatttataaatggtccctgaaagagacaaaaacatttgatatttatttcagttgaaataaatatatggagggtaaactcatc

SEQ ID NO: 28441 - DNA, 601 bp, Human
cattctggatattgtacgcctttccacagggtacatgctgtacaggtggaattcaaagagactacaattctgaatatttgaggaaaactcatcacattcattctcaagagcagggtacttgagcctagtttgatttcgggataactctctcctattattctatatataatgctaaaaatgaacatccttgtgaccctctacttcaattatgagtttatcggagttatattttttgcttgaatacctgtatataatgctaaccagcggtgtttttttcctcctgtccatgagcataaagctytgttcgggcccagtctttcttaggaagatttctaagccaaatagttcaacagagctcagaataggctagggattaatgagcttgtatgtgcaaacaaacaagtacagtaaattacataaatggcatggacttgagcatgtagagagtattttcatagaatcccaagtggcgcccaaagagattaaaaaattaatctccctcccaaaggaaaccctatattctaatgtgaaaacacatacatgaaagtcattctctctccaaagagacaagttcctacaaagacaacggggggtggggaaa

SEQ ID NO: 28442 - DNA, 601 bp, Human
caaagaaatattggagatatcaaggaaaaaaacaaccttaatgccactcaaccttgattccccattaaataaaatctggatatgcagggtttaatcagttaaaacaagcattcacatggaaaggtctgcattctggatattgtacgcctttccacagggtacatgctgtacaggtggaattcaaagagactacaattctgaatatttgaggaaaactcatcacattcattctcaagagcagggtacttgagcctagtttgatttcgggataactctctcctattattctatatataatgckaaaaatgaacatccttgtgaccctctacttcaattatgagtttatcggagttatattttttgcttgaatacctgtatataatgctaaccagcggtgtttttttcctcctgtccatgagcataaagctttgttcgggcccagtctttcttaggaagatttctaagccaaatagttcaacagagctcagaataggctagggattaatgagcttgtatgtgcaaacaaacaagtacagtaaattacataaatggcatggacttgagcatgtagagagtattttcatagaatcccaagtggcgc

SEQ ID NO: 28443 - DNA, 601 bp, Human
agtataccaaagaggagaaaggtcattattcaacaaagaaatattggagatatcaaggaaaaaaacaaccttaatgccactcaaccttgattccccattaaataaaatctggatatgcagggtttaatcagttaaaacaagcattcacatggaaaggtctgcattctggatattgtacgcctttccacagggtacatgctgtacaggtggaattcaaagagactacaattctgaatatttgaggaaaactcatcacattcattctcaagagcagggtacttgagcctagtttgatttcggrataactctctcctattattctatatataatgctaaaaatgaacatccttgtgaccctctacttcaattatgagtttatcggagttatattttttgcttgaatacctgtatataatgctaaccagcggtgtttttttcctcctgtccatgagcataaagctttgttcgggcccagtctttcttaggaagatttctaagccaaatagttcaacagagctcagaataggctagggattaatgagcttgtatgtgcaaacaaacaagtacagtaaattacataaatggcatggacttgagcatg

SEQ ID NO: 28444 - DNA, 601 bp, Human
cattgagaaggctaaactatgcagtaaatatctaggttccttttaataggggacattttctttgcaatttaaaagtataccaaagaggagaaaggtcattattcaacaaagaaatattggagatatcaaggaaaaaaacaaccttaatgccactcaaccttgattccccattaaataaaatctggatatgcagggtttaatcagttaaaacaagcattcacatggaaaggtctgcattctggatattgtacgcctttccacagggtacatgctgtacaggtggaattcaaagagactacarttctgaatatttgaggaaaactcatcacattcattctcaagagcagggtacttgagcctagtttgatttcgggataactctctcctattattctatatataatgctaaaaatgaacatccttgtgaccctctacttcaattatgagtttatcggagttatattttttgcttgaatacctgtatataatgctaaccagcggtgtttttttcctcctgtccatgagcataaagctttgttcgggcccagtctttcttaggaagatttctaagccaaatagttcaacagagctcagaataggc

SEQ ID NO: 28445 - DNA, 601 bp, Human
ctgtcaacaattttgtcaatcatctgacagaataatggaccagttgcaagcaatatatgacaatctcaataatcatagtgctcacatacaggactcctacaatcttctccctaatacaaaagtctctcatttaaagaactgcttttatgagcttacatcctgaataaaaccaacaatcccctcccctacttgctatattgcatccatttaataaacatgacatctctctcaaatgaaatcttctgtaagcatctatccattgagaaggctaaactatgcagtaaatatctaggttcctttyaataggggacattttctttgcaatttaaaagtataccaaagaggagaaaggtcattattcaacaaagaaatattggagatatcaaggaaaaaaacaaccttaatgccactcaaccttgattccccattaaataaaatctggatatgcagggtttaatcagttaaaacaagcattcacatggaaaggtctgcattctggatattgtacgcctttccacagggtacatgctgtacaggtggaattcaaagagactacaattctgaatatttgaggaaaactcatcacattcattctcaagag

SEQ ID NO: 28446 - DNA, 601 bp, Human
atacttttttgcatacattttttaaagatgctaacaataaacattttatatcctttaaatcatccagccaaaggggagttatatatgtgtttgcctgcttgctgactgctgatcttaagcctgctttgaggatactgctgagttccataagttgagagccacaagtaatcatacatataggctactgtcagtcaggctgaattatcaatgatacacacaaagcctcacacacctttcatgcgtagcagactgatttaaaagaacaaatcagcagatggcagtattaactttctaaccctcrtgattatcaggctctattacttttaatctaactcccatacaaccatgtcagcatgcatatttgttttacaactcgcctcaataaggctcatggaatttaataaagtactgatttgtgtcattttatcattgttgcctgcgaagaaatttagctaatctgtcaacaattttgtcaatcatctgacagaataatggaccagttgcaagcaatatatgacaatctcaataatcatagtgctcacatacaggactcctacaatcttctccctaatacaaaagtctctcatttaaagaactgctt

SEQ ID NO: 28447 - DNA, 601 bp, Human
aatctgcatatctcaaagcttgtgaaagcatggtgaatcctgcagtcctagagttaataactgggtaatgatagtattctgaaaactaagaactttctggcatttcttatatagattcagagtttttaaaattaattaatctcttactatggtaaaaacacacaagatctaccctcttaagtttttacatcagctgagagtccccgcagtgccaggtaaaaagctataggcagtggtgaaggaaaagtaactactctagagcagggggaaaagaaacccaaatcttctctcctcattcccmatgtcctaaatagcagacaaaatattttagcggcaggtttccacaggagtagaaaatcattacccaggggcagcttgtcccaatgactgaggtctcaaagaacacctccctcagctttgtcagaagcccacaccattccactacctagctaggcaaacactccaccttggcgcttgtttttttaatgactctgttttattctttttaatttttttttttttctgagacagggtctcactatgttgcccaggctggagcatagtggcaggatcacagcttgctgtagccttgaccgtctga

SEQ ID NO: 28448 - DNA, 601 bp, Human
atgcttcttaagctcactgttttaaatgcattggtcttaaaggttctgtcttatcagttttctaagagttgcaacaatgcttttgtagacagaacaaacatttgttttggacttagtgatttctttgtaaaggagttgagcagctgacttacaggcctccaaaatcaatgtaaaaccaccgctggagaagttcataagtgaccaaggtaacaccaaactggggagaggatcgaaacactcgagctgaaaaagagaagcaggggcaggggagacttgaaaccaggacaaatgtggtaaagayagccactgagtcacaggggaggacgctagagccagccagccattctgtatggctccagcccctgcctacctgcagtccctttccaaaatgctgagggcccttcttcccggagaatcttcctgaaacagtcgatgacaccactgtatgtcgtctggccagcgcgggcagccacctgcagtcttgtcttgatgacatcagcaggggtcaccagagatgcagctgggacacctttcaggagaaaaccacatttaatttatctagagtaccttataaaagataggaatactgctaacatctact

SEQ ID NO: 28449 - DNA, 601 bp, Human
attaaattatttaaagagagataggccgggcatggtggctcacgcctgtaatcccagaactttgggaggccgaggcaggcggatcatgaggtcaggagatcaaggctatcctggctaacacggtgaaaccccgtctctactaaaaatattaaaaaaaaaaaaaattagccaggcgcggtggtgggcgcccttagtcccagcttctcaggaggctgaggcaggagaatcacttgaacctgggaggtggaggttgcagtgagccgagatcgtaccactgcactccagcctgggcgacagagcragactccgtctaaaaaaaaaaaaaaaaaaaaaagagagagagagaaatagctttagttcttttacagaagatgaaagaagcatggaaaagcctgaagcctcacatttctacaatgcaactgtaagactgctgttctcactttttttgcataggtccctccacttggttcagcagctgattccctatatggcctttgggcacagaggagttcacaggtttctgatgtgaggactcaggaatggtacttggtcttctgctgaaaagctaataattgcttgctttgggtacaacttccccacc

SEQ ID NO: 28450 - DNA, 601 bp, Human
attttgccacactcaacagttgtctcatcactgagtggctgccactgctgcctttggctgaaccacagcaacactaggagacttaaatttcgggagataaaggccaaatttgttttcgatgcctgcaaacgtggctgtggcgagtctgtatccaccgatgtgatcagggttggcaggaggaaggtctgcaatgcgtgacttaggtgttggttctgaaccagcgggtttgctgttgacagaaaaaaagccaatggttagcatgctcaaggtggatgagcgcagcttacagctggacattttyggtctgacccatgtgccacaaagaagaatgtttctctcaaccatttccatggcatctgtgctgcatgactagaaaccacagtcatgatttatagctgctttgacagcaacttatctacatatttgatttacaagagaaatggccttatttccaatgcttgcatacatatataaacaaatccataggaaaaaagtcagaagaaaagacactcaaatatgaagactctctgggtagtaagattatggatgatttttttcttttttcttcttgtaaagatggggtcttgctatgttgccaaag

SEQ ID NO: 28451 - DNA, 601 bp, Human
tttgtgtgattcttaataaaacactttcaaaacattctgtacatttcaagccactcagaaccgcattacatttctacaaatgtgatttgttgggatgaggtgccaagatgtctctgtacaaagatgtacaatatgtacaatcactgtaagtgcaagctgtgcaaagcagagtctagaacactaattcatgccaaggcttacaaaaacatttcaacacataagactaaagcttgaaacagcgttgtggttttttccctgggcaaatgattattttataaacaagtatatgtatatgtcatayagaaagaagagtttgactcctcagctcagtcagtaccatgcagctgactggatacattacagggctgctctcctaggcctctttcttcaaggcgccattttgccacactcaacagttgtctcatcactgagtggctgccactgctgcctttggctgaaccacagcaacactaggagacttaaatttcgggagataaaggccaaatttgttttcgatgcctgcaaacgtggctgtggcgagtctgtatccaccgatgtgatcagggttggcaggaggaaggtctgcaatgcgtgacttagg

SEQ ID NO: 28452 - DNA, 601 bp, Human
tgcaagtcattatcttacaatcgatcagtttaataattgcttgaaataggtagagtatgcttttgcttagaaaagttaagggacctgcctcaggtctcatagcaagtcaatactagagctggaatttaaagcccatttcttttcacacacaaccccaagctcctacttgcccacatcaagcggcccttttgaagaataagcaagctcaaattgggaactctggtgagtttcaagtatctggccagtcccctcacgaatcccaagaagccacacggtgtcctctgcctgaaaggcccttatyttccctgcaaagccaaatcctctcccagctctgaagggaaaatgtcaagtctcaacccttccagctgtaccagcccacagtgctgcctccttaaattccagctgcatttaatattagtcaatacctcaaagctgagcactcatactgagtcctcctgtgctgtcatgatttcctttctttctgccctggagagactgtaagccccttgaagataaaaatcatgtctctaattcttgttttcctttttttcatctcccacacagccacaatagcgatgcgtaaagctagcatttggaagaa

SEQ ID NO: 28453 - DNA, 601 bp, Human
ttcctcttgtaagataccaatataagatacacaatcagtaatcatttcaaaattataatgcaagtcattatcttacaatcgatcagtttaataattgcttgaaataggtagagtatgcttttgcttagaaaagttaagggacctgcctcaggtctcatagcaagtcaatactagagctggaatttaaagcccatttcttttcacacacaaccccaagctcctacttgcccacatcaagcggcccttttgaagaataagcaagctcaaattgggaactctggtgagtttcaagtatctggccagtcccctcacgaatcccaagaagccacacggtgtcctctgcctgaaaggcccttatcttccctgcaaagccaaatcctctcccagctctgaagggaaaatgtcaagtctcaacccttccagctgtaccagcccacagtgctgcctccttaaattccagctgcatttaatattagtcaatacctcaaagctgagcactcatactgagtcctcctgtgctgtcatgatttcctttctttctgccctggagagactgtaagccccttgaagataaaaatcatgtctctaattcttgttttcc

SEQ ID NO: 28454 - DNA, 601 bp, Human
acattggaagggagtggacaaacttataaggtaataccacagtgctgagcacttctcatatttcctgggaggaaagcaatacaatatcaccaaaaaaaatgaaagacatatgcttctagcaatatggcacactgggtccactgaaaacctctcctcttacaaaacacctagaattgaataaataataacattcagagcagtaaactatttgccttgaaagttcagagactgtagatacaggaaagctcagcaaggtatagcacttaagatagaaacccctgaataaaaccgggactgggcrcggtggctcaagcctgcaatcccagcactttgggaggccgaggcaggtggattgcttgagcccaggagttcaagaccagcctgggcaaaatggcgataccccatctctacgaaaactacaaaaattagccaaagcgtggtggtgtgcacctgtagtcccagctactcaggaggctgaggtgggaggaccacctgaacccaagaggtagagactgcagtgagccgagatcactgcactccagcctgggtaacagaccactgcactccagcctgggcgacagactgaaactgtctcaaaaaa

SEQ ID NO: 28455 - DNA, 601 bp, Human
cagtgaccacatccaattcaatggcactctccctccctttaactaatacagaagagatgaacatacttccattaaaatatgataaatacttggttaaaaaaaaaaagcttcatgtgtgtctcgtttcctccatttaaagacttccagagggaaagtatatgatatggctactattcctacacctactacagagtgctgcatagacctcatcgaatctccccaactagcctatgaccttgatcatctaatttgtattttatagattaagaaacaaactcaaaagttaccaacacacccaagrtaaaaccgcaagcagcagcaccaggatgcaaaccccaatctccaaagccatttttttttgtactcaccccatgtgagtgacaagtggcacaaaaaagaggttgttgccaaaagaaggttgaagaaatctctatttttcaatctcatctgaatatctccttcttctaaaacccaaacccattattaacagtgtgaggtcctcaagagtggaaatgcatatgaaccatgcatttgcatctctaaaataagcagtatttctgcctgtcacccaggtaagttgcctaaactttgggaccctgca

SEQ ID NO: 28456 - DNA, 601 bp, Human
ccttgtatctctgccagccccaattccctaccctcagttttgaacttcaaagacagtgaccacatccaattcaatggcactctccctccctttaactaatacagaagagatgaacatacttccattaaaatatgataaatacttggttaaaaaaaaaaagcttcatgtgtgtctcgtttcctccatttaaagacttccagagggaaagtatatgatatggctactattcctacacctactacagagtgctgcatagacctcatcgaatctccccaactagcctatgaccttgatcatctartttgtattttatagattaagaaacaaactcaaaagttaccaacacacccaaggtaaaaccgcaagcagcagcaccaggatgcaaaccccaatctccaaagccatttttttttgtactcaccccatgtgagtgacaagtggcacaaaaaagaggttgttgccaaaagaaggttgaagaaatctctatttttcaatctcatctgaatatctccttcttctaaaacccaaacccattattaacagtgtgaggtcctcaagagtggaaatgcatatgaaccatgcatttgcatctctaaaataa

SEQ ID NO: 28457 - DNA, 601 bp, Human
tgtacggtcaaatgtcaagtatggcaagcaaatgctttaaagttggtacagaactgggcaatgccatggcctctaaatgccattttcatctttcctcaactctgaaacaggagcacgagtaaggccagctccccaggtatatgggctaagactgaaaacaagcttgttactgaagaacaaagtgaaactgagacggtgtcttaaaattaacagtcaaggttcctctcagattttcttttctatgcccttttggtgatagttttgaggtagtaaaatctggtagagaatcagtgtatagcasagtataaaatgcactagccaggaacagaaagattagtgctggttctgccactaattttcagtgtgaccttgggcactcagcaaatctcaggtgcccgatttcctcatctgtcaaatgaaagtactaaagtgccatgctagatcacaagtggcaaactcgttgctcacagcctggttctgtttggcctgcagtctcatggtgaccttcagcaaggccgagcacctggggctcaaggcagacacgccacagtgcacccagccacttccctcatccccgttgcctgcctcattaggcatctgc

SEQ ID NO: 28458 - DNA, 601 bp, Human
gaatctttcccaagccttttgactcacatcccagtgtttgtgcccttgggtctgcctgcttatatctccaggaaaggaaataagcagatttgcggaactgttgcttttctccagattctggtgaccctcagtgattaatattctaggacagctgcctttgtaaggattctatagttaaacacaagtttctcgaggtcttcatggagatctatgttatacaatgtagctatggtggaaaaaaaacttgggctttgcccaaacaaaattaaaaagtgaaaacccaggacttggtgaaagaagycagatacaaaaaaagacatacactgtatgttccatttatatgaaatgtccaaaagaaggcaaccgaaagtagattagtagttgccgagggctatagttggaatggggaatgactgtaaatgagtaggaggattctttttggggcgatgaaaatgttctgaaattaagattgtggtgattgtacaactgtgaaaataaattaaaattcctggaattgtatacttaaaatgggtgagttttatttaaaatgctatctgaataaagcttttaaaaaactaccaccacagcagcaaacccaggg

SEQ ID NO: 28459 - DNA, 601 bp, Human
accatgtaaggtacctttccgtaagggatctgaggtagctagcaggtgcatggagaaagcctgttttgcgtttgcatgaatactgggacctgcaggagtgtgaatgcataagtaccacacaacagactggctgggggactaagcacaccagggagaaaataggggggccagcatacctgcatccctatgtaacgagcatgagagggacacaggggacacgtactctcctctttcccttgattccaaaggctgtaaactggcagcagcgcttttataaggatggtcctggctgccgtgagaygggtgggcccagcccccactgtccacaggaccacaggccctatcacccctcttgaaatcatcatccctacttcactccttcatttgcctcacctcaggtggggtggaactttccacaactgaagtacctgccagcacctgcttaccaatctcaaagctggcatcttgcagggcctttgattttggataaggttctcagttctaagtttcctcatctatacaacagcacccaggtgcaatcacagatgtatacagtaattcaaagaaaaacataaatgagaatctttcccaagccttttga

SEQ ID NO: 28460 - DNA, 601 bp, Human
taaaggccaaatccagtagattaactggaggcagaggagctgctcagactcttttgtaggtggatgatttattgtatgatatgaagtattatgcccatccattaaacagtgaggaacactgtacaggaccctgaaaatcagatagaaaagaatgccaacgaatgcagcgttccttcccacatgcatatatcttgggaagaaaataccaaagagataaaaggaagattaaatacactgcacatttcaatttgaaagtgactaaagttgttttggtttctcaccctgtcctccccctctgaamaggttttagtattttttctaacagactatctgttttaatcgcgagaaggttaaagaatgaagataaagggaaggcaaactttattatacataaagggccactagttgaccttccatcagcctcataacagacaccagcccctccccacacaccccacaccctctgaagaaagcaactcccttgtcacttaggtcttctcatggcaaacaaatcagggacaatgctgtgtcccaaggaaggcattaccttcacggccccactgttggcttcaatgtaaatcacatctccagcttctactcg

SEQ ID NO: 28461 - DNA, 601 bp, Human
aaaggcagcaaatgtttcctgtctggtcctcaaaactgccttgccaagtaggagggaactcaaaaccgaaccccaaaccacagaaaacccagagacccaaagtgacaaattaaccaagctggtcagtgatggagcaacacagttcctgacttctgactcccagcccagcactcttctcaggtcaagggctcccaggaggtcagtttggggatggccatttcaccaaccaaggggacctgttggtccaagatgagtcttcagtaatctcttgaccaaagctccaaggaacaaaacacccacrgatcaaatttcaagtcagaaaacaaactattccctaatagtgactattcactatttcctagaaatgtcatatagtgataacatcctttcctgcactttactagccaaggcataagtatccatctgtatgagaagcagacaacagtaccagctcaaagctaaaacactgtggcttttgctaagcagggggaaacaaagagctttgttaggctttctgaaatcctgtaaagggctcatagaacactcctgccctcctgccattaacacccagaaaatcccaggcgtgagcccactgctggag

SEQ ID NO: 28462 - DNA, 601 bp, Human
cgcaagagcatctcagaatgtggggccctccgccctgccccttgctcacagggcacactggttctcctacctgtgatttctgtcttctttggcttcattagctggcccatcatggacaggatatcttgtcccccctgcataagagaagacttagagtcagtgctgctttctaaggtgactacagaagcctcatccccctgcatcccactcatcaactcaacatgggatcctgaggtatggagacccctcctcaaagcctgaggagcttctaaacacagaggaatttttagaggttcccctracctgtaagaatcaaacaaaatcctttcatggcaagtataagctccgtggggcctgcccagcctccttttccagccctatctttttccaaccccttgttccttgattagccacacaagactaccagccctgccctggacacccccaagcttttttatgactcaatgcttttgagtctattccatctgccaggaatgccattctccttcctagaagttcccagtcattaaagttcacgtcaaatgccctctagggcgcatctgaccctaaccggactcaggacttcctccaaatgttcctg

SEQ ID NO: 28463 - DNA, 601 bp, Human
atgtttaactaacatcttaaggtgacgaaactgtaggtggaattagaaaaaaaacagcaacaggaaagctgggaagagcagcaggttaaataaaggttcacaggggagcagcagcagtgtcccctgtggagctctgggaagtgcccacaaactgggcagggcagtatgtggagctggtctgtggagctgccctgtgctctactagggagggggctgacagccccaaggctccagagcctgtgctccagcagagctgggcgacacaaatccctatttctggggcctcataggggccagaaaytgtgactgcagtggggcagatagcacacagtgtgctatatggctgcctaaatgccgccagaaacttaggctagagtcaagctctaagctatgaggaagaaagaactgttctgaggcatttcctcagggcgactgtgctcacagagccgcaagagcatctcagaatgtggggccctccgccctgccccttgctcacagggcacactggttctcctacctgtgatttctgtcttctttggcttcattagctggcccatcatggacaggatatcttgtcccccctgcataagagaagacttag

SEQ ID NO: 28464 - DNA, 601 bp, Human
gcttaaactttaaagacaatatttgctttaatgtttaactaacatcttaaggtgacgaaactgtaggtggaattagaaaaaaaacagcaacaggaaagctgggaagagcagcaggttaaataaaggttcacaggggagcagcagcagtgtcccctgtggagctctgggaagtgcccacaaactgggcagggcagtatgtggagctggtctgtggagctgccctgtgctctactagggagggggctgacagccccaaggctccagagcctgtgctccagcagagctgggcgacacaaatccmtatttctggggcctcataggggccagaaattgtgactgcagtggggcagatagcacacagtgtgctatatggctgcctaaatgccgccagaaacttaggctagagtcaagctctaagctatgaggaagaaagaactgttctgaggcatttcctcagggcgactgtgctcacagagccgcaagagcatctcagaatgtggggccctccgccctgccccttgctcacagggcacactggttctcctacctgtgatttctgtcttctttggcttcattagctggcccatcatggacaggatat

SEQ ID NO: 28465 - DNA, 601 bp, Human
ggagccctgggtgaaatgagttttcacatgcaaatttacctgttctatactcagtaaatgaccctttcttttggtcccatacaacaatgcttaggttaattaactttcaatcaagtgcctggactaaggaagtgggtgcttttagaatcctgagcagaaacctttgaggaatgaaaggctctgaagaaaggcccaatctcagagctcctagagggatgagtctctcaaaagttacataacccagctaaggtctcagtgctcattttccaaaccagctcctgtgttatcatcaggagggagyagctcacaaatagaaaactggaagatctgaggcagcgtcttccaccaaaggcaagaggcggggattgtccaaagaggatgcacaccgaaaaccgtgtgaaaagaaagaaactgcttctgacaactcgaacagaaaggtctcagattgctgccctggcttaaactttaaagacaatatttgctttaatgtttaactaacatcttaaggtgacgaaactgtaggtggaattagaaaaaaaacagcaacaggaaagctgggaagagcagcaggttaaataaaggttcacaggggagcagcagc

SEQ ID NO: 28466 - DNA, 601 bp, Human
gggaccagctcagcaatgccctggtcgatgtacttgttcaccaccttattaatctcccctcgaagtttgtctaggagatgcaaggatgggcaggcaaggtcagcacagggctgggggagactatcgccttttctcctccacctgaattcaatccaaacccatgctaggagcctagttttcctactagctatgtgatcccagacagggtgtgtccccactccaggtttcagtgtcgtcatctgaacacagtgataatcacacctaaaaggtcacaaaattggcagcctcccccaaaagatgrgtttggttaaatgtaaaaaggttgcacaggtgttctgcatgggaatcccttcacagcacacgctcactgctgtcacactccctaccatgccttatcacttcccacatacccaatctagctctgtctgatctgggagacattggagtttgggagccctgggtgaaatgagttttcacatgcaaatttacctgttctatactcagtaaatgaccctttcttttggtcccatacaacaatgcttaggttaattaactttcaatcaagtgcctggactaaggaagtgggtgcttttagaatcct

SEQ ID NO: 28467 - DNA, 601 bp, Human
gccatcctacctgatgacacagttgcctcggttggatgcaaagatgacgatgggagcgatagaagactccagggcgcggtgcaggtaggtgaagcactcaatgtccagcatgtggacctcatcaacaaacagcacacccgggaccagctcagcaatgccctggtcgatgtacttgttcaccaccttattaatctcccctcgaagtttgtctaggagatgcaaggatgggcaggcaaggtcagcacagggctgggggagactatcgccttttctcctccacctgaattcaatccaaacccaygctaggagcctagttttcctactagctatgtgatcccagacagggtgtgtccccactccaggtttcagtgtcgtcatctgaacacagtgataatcacacctaaaaggtcacaaaattggcagcctcccccaaaagatgggtttggttaaatgtaaaaaggttgcacaggtgttctgcatgggaatcccttcacagcacacgctcactgctgtcacactccctaccatgccttatcacttcccacatacccaatctagctctgtctgatctgggagacattggagtttgggagccctgggt

SEQ ID NO: 28468 - DNA, 601 bp, Human
gccactgcactccagcctgggcgacacagtgagactctgtcccaaaaaaaaaaaagaaagaaaatgctggttttgttatcagaaggagctgggttcttatcctgtctttacgatgagggacaagttatgattccagtttccttatttgaaaaatgacgccaataatgcctacctctcagagcgcagatgaagactgaagacgttcatgtgtataatgtcatcaaaggctagccctgtctgatctcacctttgtacactccaattgaacgaccaaattgtagtatcacacccaaaagatcasgtgggagaccctcctcatgagtgacaggacagctgctgcctttggtgactagggaaatgaggccagaggcaagccacttggcacattttccctcaaaaacaacatgacctcccctcatccctgtcccacctcatggggtttggagagatcctgaggaacaaatgagcccagatggaagttaaaaaagccttgtggctggcaggcagccatcctacctgatgacacagttgcctcggttggatgcaaagatgacgatgggagcgatagaagactccagggcgcggtgcaggtaggtgaagc

SEQ ID NO: 28469 - DNA, 601 bp, Human
atagaaagaaaatgctggggccgggcgtggtggttcatgcctgtaatcccagcactttgggaggctgaggcgggcagatcacgaggtcaggagatcaagaccatcctggctaacacggtgaaaccctgtctctactaaaaatacaaaaaaattagccaggcgtggtggtgggcaactgtagtcccagctactcgggaggctgaggcaggagaatggtgtgaacccgggaggtggagcttgcagtgagccgagatcgcgccactgcactccagcctgggcgacacagtgagactctgtcccmaaaaaaaaaaagaaagaaaatgctggttttgttatcagaaggagctgggttcttatcctgtctttacgatgagggacaagttatgattccagtttccttatttgaaaaatgacgccaataatgcctacctctcagagcgcagatgaagactgaagacgttcatgtgtataatgtcatcaaaggctagccctgtctgatctcacctttgtacactccaattgaacgaccaaattgtagtatcacacccaaaagatcacgtgggagaccctcctcatgagtgacaggacagctgctgccttt

SEQ ID NO: 28470 - DNA, 601 bp, Human
cagcagggggcaccatctgtccaaggctgagccctttcaccaactgcactgtcaggcttcagcctggcctagccaaggctaagcaagtccagacagccacaggcatgccaggcataccagccataaggcccacatgcatctgtctccagaagctgcccaagtagccatgctggatctggcacacactttctctccaagacttaggaagcacttatgacagtggtcttgtctagagagcatcacggacggggattcagagtagctacaagatgctgccacatggacttgaatcacgcattcrattcctaattgcaagtgaaagaaaccgcctgagggggaagggctgttgctatactgcagtgctcacagcactacagaacccccattgtggggcttacccagagccagcaacaccagagtttgcatgttttgtttttttttaattatttttagagatgaggtctcactgttgtccaggtgggagtgcgatagctattcacaggtgcaatcattgcacactacaaccttaaactcctagcctcaagcaatcttcccgcctcagcctcccagagagtacactacaggtgcataccactgtgcc

SEQ ID NO: 28471 - DNA, 601 bp, Human
catagtgccaaaattctcttccaaagcaaacaaccgaatctgcgttacctgagccgacctgcctaaaaatccatgttctgagtgtcttccttccacttgagtaactacagtctagcaaggagtctccacaacctctagcagcccttgatcaaatcagcccagatggggctggggccaaatctcccgggtctcaggctgaccagagctttgtctccactgagcaggttctgagatcaaggccacctttctgtgcaccttagtcctgagtgggatgggactgagagaccttacttctgagacragagatgccaggctctgcaggtatgggctgggctgggttccctactgtggagggagggaagcctattagcagagctccccagcagggggcaccatctgtccaaggctgagccctttcaccaactgcactgtcaggcttcagcctggcctagccaaggctaagcaagtccagacagccacaggcatgccaggcataccagccataaggcccacatgcatctgtctccagaagctgcccaagtagccatgctggatctggcacacactttctctccaagacttaggaagcacttatgacagt

SEQ ID NO: 28472 - DNA, 601 bp, Human
tgggaggacatgagatggcccatgtagagtgctctgtatagtttctgacacacaggaagccctcagttagtcacctcccttccccctctctttccttcggagctctagagatcagatgtggttctggggggtaaggaagccctgtagttcccctctaggggtggagtctgtgggaagcatatcagatggctattattgttggctattacttttttcattaccatgttgacattattatcaccactacaacaaatttcctactagaacatagtgccaaaattctcttccaaagcaaacaacygaatctgcgttacctgagccgacctgcctaaaaatccatgttctgagtgtcttccttccacttgagtaactacagtctagcaaggagtctccacaacctctagcagcccttgatcaaatcagcccagatggggctggggccaaatctcccgggtctcaggctgaccagagctttgtctccactgagcaggttctgagatcaaggccacctttctgtgcaccttagtcctgagtgggatgggactgagagaccttacttctgagacgagagatgccaggctctgcaggtatgggctgggct

SEQ ID NO: 28473 - DNA, 601 bp, Human
catcatgctaagtgaaagaagccagtcacaaaagaccagattatatggtgctatttatacaaaatttccagaaaaagcaaatctatagagacaaaattgattaatggttgccagtggatgggggtaagggtgcagaaggggacgatgactattgatgggtatagtttctttttggggtgatgaaaatgttctaaaattgaccgtggtgatggttgcacaactctgtgaatacactagaaatcacaaaaaaaaactgtattttatatgaattatgtctccataaagttggtttttttttttkttggaacactatctgccacagggttacactgagcagagtccatactgtttcttaagtcttgatgttttggtgcaacaaagtgactttcagtgagaaactcctacaagaactcctaatcccagggagctatacctcaatatgaagagaaaatctcccagttttcaagctgggatcagtgctgggctctcatctaacagttcaggatcctgagcctggaaggaaagggacttcttatggtggcaagttagggaggagccaggcaagaaggcaacagagctttgcctccctgtcatccatgga

SEQ ID NO: 28474 - DNA, 601 bp, Human
aggccaggtgtggtagctcacagtaatcctagcagtttgggaggctgaggcaggaggatccttggagcccaggagttcaagaccagcctggtcaacaaagtgagaccccatctctactttaaaaaagaaaaagaaaaagaaagaaagaaaaaaaaagttgtacacaaatgttcagagcaccattattcataataacccaacaacccaatgtccatcaactaatgaatggttaaataagatacactattaaatattccatataatagaatactattcagctggaaaaagaaataagtactaygcatgctacagcatcatgctaagtgaaagaagccagtcacaaaagaccagattatatggtgctatttatacaaaatttccagaaaaagcaaatctatagagacaaaattgattaatggttgccagtggatgggggtaagggtgcagaaggggacgatgactattgatgggtatagtttctttttggggtgatgaaaatgttctaaaattgaccgtggtgatggttgcacaactctgtgaatacactagaaatcacaaaaaaaaactgtattttatatgaattatgtctccataaagttgg

SEQ ID NO: 28475 - DNA, 601 bp, Human
gacaaatatacttctggaaaagtatcctatagatataccaccacatgtgcaacatggctgactcatttgtgactactttcctcttacaataactgtgacactgtggatgttttggaccaaattaactctttttgaagggctgtcctatgcactccaggatgttcagcagcatccttggcctctacccactagatgccagcagcacttctgagtcatgttaagtaaaaatgtctccagacattgctacatgtccccagcggaacaaatttgcccctggttaagaatcactacataaatgctkctttatgtaatcctgtaactacagggacacggataacacaaagcttttctgctgacagaaagcacagtaaaaacacctctctgggtaatgtgatgggtaactcacctaatatccacttaaccttggctcagtggacacacagtaagagtgctaaaaagacagccatttgattttctgatgaggctgccaaaacaattcaataaaaaaagaacagtcttttcaacaaatggttctgggacaactggatattcacatgcaaaataatgaagttggaccaaccccttacttatgccctacatg

SEQ ID NO: 28476 - DNA, 601 bp, Human
cggggggtggggaggatcacagtttaacaaggcagccataatggtaatgttataaaactgctaataagaagctggataataattacattttggtcaatctgcagatttattcttgcatcttagaagttcatttctggctttggcctcagtctactattaattttaacattttaccattcagcaattgtccaaactcggccattagtgagcttcctccagatagacagtttggagctatgaagccacagacccaaatctccttggaatccaatacagcgtatctataaaagcaagacaaatrtacttctggaaaagtatcctatagatataccaccacatgtgcaacatggctgactcatttgtgactactttcctcttacaataactgtgacactgtggatgttttggaccaaattaactctttttgaagggctgtcctatgcactccaggatgttcagcagcatccttggcctctacccactagatgccagcagcacttctgagtcatgttaagtaaaaatgtctccagacattgctacatgtccccagcggaacaaatttgcccctggttaagaatcactacataaatgctgctttatg

SEQ ID NO: 28477 - DNA, 601 bp, Human
cgtgtcactgcactccagcctgggtgacagagtgagactccgtctcaaaacaaaaaaaaattaaaatcttcaaagtaaatatggaaacaaactaataggaaatacaagtattaagttaactttagagaaaacttatctttttccagcaacgaatgtctttttaaaattaagaagaattataaagatgaaattctatcatgattcaaatctcagtatttggtgtgcctggaaccttcacattaagcaaaataaccttttaaaactacatttaatttttagttttttaattctatttaggccrtaagtgttttttaagtcttatttgagaattcttttggtaattttgaggaaatcctaagatctcaattttgccacattaaaatatcccaaggacaaaaatatccaaaattctacaccacccatgataaatcacaacaaacataaaaagtttaaagaagaaaaggttagagaaaaataaagtactcccaaatcaaacttcacaagaacagaatttatagaaatgcattaataacatttcttatagtttttaaagtctattaaaaggctaccaagtggtaaaaaggaatttgaggagaaaaac

SEQ ID NO: 28478 - DNA, 601 bp, Human
tcctgggctcaagggctcctcccacctcagcctcccgagtagcttggagtacaggcgtgagctactgcacctggcttgcaacagtcttaataattatgtttaatatttacttaacaatccattaaatattttacttaacccaaattgttgagcatttaggtagtttccaattgttgctattatttttattgatattttgataatttgatgcatacagccataagcatttccttagcaactgttgtagtgcttgacagaaccctgaatagctacttgaatgaataactatcctaatttatasagctacacatgagttatctaatctcacaggatcatagcactaccgagtattctcattctgaaatattttgctatttcaacagtttagaaaaagagggaaaggtaacaccttaagtttgcatttctttgattactaatgaggcatttgaatgtattcccttatatatattattttacttctttttgagaagggtccaatcccatcttttgcctatttttctcttgaacccttagccaagccataggaataacaccccagggaggaaccttgccaacccaccagaccctgaggtgccctgcg

SEQ ID NO: 28479 - DNA, 601 bp, Human
atggtggtgcacacctgtaatcccagctactcaggaggctgaggcatgagaatcacctgaactcgtgaggcagatgttgcagtgagctgagagtgtaccactgcactccaccctgggtgacagagtgagactctgttccaaaaagaaaaaaaaaaaaaaaccaacttatttatcttggtaatcatcaatatcatagcaaaactgggaaggaggaaaaaaataactaaaatcatactcaaaaataatcatctagatatttgccaaacattcatatataaacaaattatatagtataatatayagtatatactatattatagtatatactaattatactctatagtataatatatagtatatactaattatgccctatagtataatatatagtgtatactaattatactctatagtataattttacaaattatactaagtatgcaagttttttttgttttttttcatgttgcttcagtctccttgttttgttttgtttttgagactgggtcttgttctgtggcccaggctggagtgcagtggcatgattctagctcactgcagccctggactcctgggctcaagggctcctcccacctcagcc

SEQ ID NO: 28480 - DNA, 601 bp, Human
ggcactgcctggctttgcatcctgcacttacagctccatgactcaaatgtaaaaaataaaatagatggtgatcacatggaatacctggaaataccatgaaggtgactagaaattcctagtccaatggtattcctatgcttggcacatagttgtgctctagctccaaaccaagcaagaggcaattcctacagggacaactgggactgtggccctttggataaagcccacgctcatacatccctgtcgtctcccaactcagcctaacccagattcagctcacgcagacttcagggcatgcacrgtgtgccagccactgagctagatgcttccaagggtcctccaatgaagcctcttattatatgatcagtttcacaaactccctccttcaggtgctcttctaagctgtatgatgctgtctcgccatcacctctgtggacttggcagaagccctcaaggactctattgcaaagccacagacctgcccaggggcggcctccaaagctgccgagaaacttgtcatgctgtttacagcagacaggctctgctaggacacaagcactggcctcttccaggtcagggtggctacattctgtaccctgct

SEQ ID NO: 28481 - DNA, 601 bp, Human
agtctctgatgatcgcggttgggcttgggggacagcacattggctgcccacagatgggaaaggccttggaaagccccagcaggacagagcggctgcgatgagccaggtgagggtgaaatgcttggccagcaaacaccctggggaggcagcccctccacccgcggccaccactgctgcaaggtgttgtctgcagtcttcccttttctcaagacaggctcagaactcagatccttgtacgaaacgtcctgattttggcaggacacaatggctcacgcctgtaatcccagcactttgggaggcsgaggcaggtggatcacctgaggtctggagtttaagaccagcctgaccaacatggcgaaaccccatctctactaaaaagacaaaaattaggtgggtgtggtggcacatgcctgtaatcccagctactcaggaggctgaggcaggagaattgcttgaacccgggaggcggaggttgcagtgagctgagattgggccgttgcactccagcctgggcaacaagagagaaactccatctcaaaaaaagaaagaaagaaagaaatgtcctgatgtctagatgtcagcaacttgttcaaacatttca

SEQ ID NO: 28482 - DNA, 601 bp, Human
agtgctttaaagacaatgttgctcagatttctcactgtgcagcataagagaaactgagacctgggttggtgggcagggagccaacgcctgcccagcactgccggcccggcaccctccaggaggcatgtgcggccctgcagtatgcatgaatagcatcacggccagtgtgctgtattcaactgactcaagtgtggctggtgcccaaggaggtatgcagcttcccaagtggctcactcttgcctccatgtcctcccgtcccctgtccccaggcagagaactggggcctcttctaacctaccckgggctcctgcaagggctctaaccttcctctccagcatgggcactactgcctacaagcactcaggcaagaagggacattttttatttgcttgataaatatgatggttaaataaatcaaaaaagttacttttaaagatttaccaggcctcataacatcaccgggagatatctaatctatcaagaagaggctgacgcttgttgcagtttgaagatcttggtagagttggaggggaggcaggctggcggcggggatgctgtaacacggtggaccaggatcctgcaggcgtaccagcactgagtg

SEQ ID NO: 28483 - DNA, 601 bp, Human
attgtatgttcacaatgactctgtacatctaaaactgttctgaaaagtttatttttaaaaaacttagagagagagagagagagaatcaaaataacctatgaagatttatagaaaacacaccaggtaaggaagggttctttcaaagcaaccacaggaacagttacgataacttaaaaagaaatgctttccacactgaactgacagcgctgcagcccacgcctgagtggggacggcagccccaagcccaggggcaagcgcccacaggctggacccaggccaggcacacctggggagtctcttrctgctgaaaacctcagccatctcacttcatgtacttatcctgctggtcagccaggattttggcggaggacttggcatcatagaaaagttcactgatctcttcgacatgctctttctcaatgctgtccttcccgttgattttagcaagcaagttggccggggtcagcagctgcactgagtacctagagtggacaggggccagggctggagtgaaactggggccaccgaagaaagcaccttccccccacatcagtaggcagcactggcaccaggagcagagcccagtgctgggcttgtgcca

SEQ ID NO: 28484 - DNA, 601 bp, Human
tattggtcattcacggtgacaaatgtgctatctgatgtaacacgttaacaagaagggaaactgggtacaagatacatgggaactccctattgtatgttcacaatgactctgtacatctaaaactgttctgaaaagtttatttttaaaaaacttagagagagagagagagagaatcaaaataacctatgaagatttatagaaaacacaccaggtaaggaagggttctttcaaagcaaccacaggaacagttacgataacttaaaaagaaatgctttccacactgaactgacagcgctgcagmccacgcctgagtggggacggcagccccaagcccaggggcaagcgcccacaggctggacccaggccaggcacacctggggagtctcttgctgctgaaaacctcagccatctcacttcatgtacttatcctgctggtcagccaggattttggcggaggacttggcatcatagaaaagttcactgatctcttcgacatgctctttctcaatgctgtccttcccgttgattttagcaagcaagttggccggggtcagcagctgcactgagtacctagagtggacaggggccagggctggagtga

SEQ ID NO: 28485 - DNA, 601 bp, Human
tatttatctctgcaattctttggtcaatttctgtattccaagttgagcaatatgatagccagagttgagttaatcctgtgcactgcaataacccagccccaagcataggacacagatgaaatgaataaatgtgggtgtgtgcacgtggccatgagtaaaggtgagacactgggaagtctcctggggtgggcaagtgtgtgagtcgggtgagcttcccctccccttacccagggctctgtaggcaggcacaatggtgaccgtgatgggctccgcagtccccctggtctggatggtgaagacragagcatcggggactctctgctccatcctcaggtcctcgagcccgaggtccagcaggtcctggctttgccacatggttttccatatcagcctcagaacatctttgtgatgcttggctgcctcctggaagctgtggaaacagctcagaaacgccaccagctccacctctctggtgctcctgagaaccgtgccattcccgaaggagcccacctgcagaacacagagccccgtcaccctgaggcccactgccatgagccaggcaacccctgcggcacttcacatgcactgtctcactgaatgc

SEQ ID NO: 28486 - DNA, 601 bp, Human
actgcactccagcctgggcgacagagcgagactccgtctcaaaaaatatatatatatataaactcatagggagaaccaggaaccagttccatggtacacatcactgagacatcccagcactctcttccttgctaaaatcagatcctgtctcttataccttctccaaagagcaactccacgcagccagccactacagctgataggagttagcacatgagatgaaacctctaggatctgggcttgcagcatgtaggttttacttcaaacacctaggactctgcccgaggacaaacaacagggrccagtgagttagtgctcccaaagcagcccccaaccagtgacggctgggaagctggtgagtaagcacgccagcgtcccacttgggatcccgaagaggttcgctccataatgggactgtgagttctcccaggacatgaagctcagggtggtgacttgcccatggacgcacgttgtattgaattcttgcctttcccatctcagttccatacttccctaccggtgtttcctgggaggaatacccaaataaactgcgtatcctcacatccatgtcttaggatctgcttctataaaatgcagtgac

SEQ ID NO: 28487 - DNA, 601 bp, Human
gtggtggcttaagcctgtaatcccagcactttgggaggccgaggtgggcggatcacctgaggttaggagtttgaaatcagcctggccaacatggtgaaatcctatctctactaaaaatagaaaaattagccaggcatggcatggtggcgggctgtaatcccagctactcgggaggctgaggctggagaatcacttgaaccctggaggtggaggttgcagtgagccgagatcacggcactgcactccagcctgggcgacagagcgagactccgtctcaaaaaatatatatatatataaactyatagggagaaccaggaaccagttccatggtacacatcactgagacatcccagcactctcttccttgctaaaatcagatcctgtctcttataccttctccaaagagcaactccacgcagccagccactacagctgataggagttagcacatgagatgaaacctctaggatctgggcttgcagcatgtaggttttacttcaaacacctaggactctgcccgaggacaaacaacaggggccagtgagttagtgctcccaaagcagcccccaaccagtgacggctgggaagctggtgagtaagc

SEQ ID NO: 28488 - DNA, 601 bp, Human
accaccgcaggccttgatcaggctcacatagacctcagggggtggctgggagttgggaagagaaggccctgaggagtgaaggagcaaaggaagagattggggattgaggaagccagagggtggtaagtagtattttggggagagcctgcctttacattggaagtatccctccagggacacttgagacctcatatcttcagaaaccaaaggtttgccttgtctaattgtcctttttgtgaaattcttactctggagaaccaacattgggctttccatgcatcagacccctccctggatgtcytcaatgtccctcattttctttaatatctgttttgtatctctttcaatactcatagggaggccgggtgtggtggcttaagcctgtaatcccagcactttgggaggccgaggtgggcggatcacctgaggttaggagtttgaaatcagcctggccaacatggtgaaatcctatctctactaaaaatagaaaaattagccaggcatggcatggtggcgggctgtaatcccagctactcgggaggctgaggctggagaatcacttgaaccctggaggtggaggttgcagtgagccgagatcacg

SEQ ID NO: 28489 - DNA, 601 bp, Human
agtccttaacctgctgtgacgaatggccacagtacccggcgaagctgacatctgccaggcctagactgtaattgaagggtaacaagaacatgtggggtgggtgtggtggctcgtgcctgtaatcccagcactttgggaggccaaggtgggaggatcgcttgagaccacttcgaaaccaggctggtcaacatagtgagaccctgtctctacaaaagaaaaataaaaaaaattagctgggcatggttgtgcatgcctgtagtcccagttacttaggaggctaaggtgggaggatcacttgagmcagggaggtcttgatccagggaggtggaggctacagtgagtggtgattgcaccaccgcactacagcctgggcaacaaagcaagatcctgtctcaaaaaaaaataataaaataaaataaaaataactagtttactgaaatactgtagagcacctatttttctccttccttctctgtttctttctcctcttcctcctcctctcctccttttccaccttcttcactgacggtttcactttacatttcaaaagactagcattctctccctctctacctgcttccatttcccctggctgcagctt

SEQ ID NO: 28490 - DNA, 601 bp, Human
ctatataataaatgatttttgtctctgagttctgttttgcagttggagtttccgttatctcggaggaagattttgtttccaaaactgactgagctgctgcctgagaaatgtccctgagggctgtttacactcacacatgccctcttttcgactcctggggtggaattaaagaaatccttccccttgttagtccttaacctgctgtgacgaatggccacagtacccggcgaagctgacatctgccaggcctagactgtaattgaagggtaacaagaacatgtggggtgggtgtggtggctcrtgcctgtaatcccagcactttgggaggccaaggtgggaggatcgcttgagaccacttcgaaaccaggctggtcaacatagtgagaccctgtctctacaaaagaaaaataaaaaaaattagctgggcatggttgtgcatgcctgtagtcccagttacttaggaggctaaggtgggaggatcacttgagccagggaggtcttgatccagggaggtggaggctacagtgagtggtgattgcaccaccgcactacagcctgggcaacaaagcaagatcctgtctcaaaaaaaaataataaaata

SEQ ID NO: 28491 - DNA, 601 bp, Human
tgcatggtggcgggcacctgtagtcccagctactcgggaggttgaggcaggagaatggcatgaacccgggaggcggagcttgcagtgagctgagattgcgccactgcattccagcctgggcgacagagcaagactctgtctcaaaaaaaaaaaaattataagttaattaatttgttttgtaactttttgcaaattcatccttaacactcaattttgtaaaccataactaataacattataattttgttagaaatttaaactcatggtaatataacttattttcttcaatattagtgaaatrttacattcttaaaacttagatgatatataaaatgtaggatgcctgtaatctgtaagatgtaagccttagtgaatagataaaaaaaatacccagctcaacttacttcacctccggggctcaagtgatccttcctcctcagcctcctgagcagctgagactacaggaacccatcaccacccccagctaatttttgtatttttgtattttttgtagagacggggtttcactatgttgctcaggctggtcttgaacccttgggctcaagtgatcctcctacctcagcctcctaaagtgctgaaa

SEQ ID NO: 28492 - DNA, 601 bp, Human
tagggggagaatgaggccccaagaggcatgctggagtaataacagatgccctttcaggcagggggggccctgtaccttcggagcaggttttgcaagtttaagtttaaggttagagctgctgaattactttggatagtagaaacaccactgccaccaactactgacatttattgaagcacaaggccaaatcctatgcagattaacctattttaatcttacagcaattctataaggtagggactgttatttttattgtttattgttgtggttgtcccctttttacagacctccctaagttcctttttttttttttttttttttttttgagacagagtctcgctctgtcgcccaggctgaagggcagtggtgcaatctcggctcactgcaacttccacctcccgggttcagccaattctctgcctcggcctcctgagtagctgggattacaggtacccgccaccacgcccagctaatttttgtatttttagtagagatggggtttcaccatcttggccaggctggtcttgaactcctgacctcgtgatccacctgccttggcctcccaaagtgctgggattacaggcatgagccaccggtgccc

SEQ ID NO: 28493 - DNA, 601 bp, Human
cagtcctgtttcaggcactgggaggccctctgagcaacgatgtcccatctgtacccttctgccacgttgagggtggggtcggccggatccaggatgatgggcctgtaacacaggaaaagggtgcccaggctcataatggtttgaaggccttcaagccagaaaaaaaccttctcggcaattatttcgtccagccactgagaattgtgatatccacatcccggggatgttcaagagggccccaaaacaccgcaggagagtaacaggatggagacaatgctatttccaagaattcctatctggsccaggcacagtggctcacgcctgtaatcccagcactttgggaggctgaggcgggaggatcacttgaggtcaggagttcaagaccagcctggccaacgtggtgaaaccctgtctctactaaaaatacaaaaaattagccaggtgtggtggtacgcacctgtcatcccagttactcagaaggctgaggcaggagcattgcttgaacccaggaggtggaggttgcagtgagccaagatcatgccaccaccctccagcctgggtgaccgagtgagactgtctcaaaaaaaaaaaaattcttctt

SEQ ID NO: 28494 - DNA, 601 bp, Human
ttcttactttacagaattgcttatgaggatcaactgagacagaccttggacaagagctttgcacactagaaagtgtgatgttaataaaatagatttttgtgatctctgcctatactataggtttggcatcatataataatatgacttagtattttttgtttgtttgtttgttttcagagtatcttgtcttctctggtaattctagcagttttgtgtaagtttgtttcatggatttgcttcctgacaacatagggtgagttctctgagagtgagggtggtgtcttttttttttctttttttyttttttttttgaggcagagtttccctcttgctgtccaggctggagtgcaatggcacgatctcagctcactgcagcccccagctcccgggttcaagcgattcacctgcctctgcctccggagtagcagggattataggcacctgccaccacgcccgcctaattttgtatttttttagtagagatgggttttttccatgttggccgggctggtcttgaactcctgacctcaagtgatccacctgtcttggcctcccaaagtgctgggattacaggcgtgaaccaccgcacctggccgagcgt

SEQ ID NO: 28495 - DNA, 601 bp, Human
tgaattatttttttattttgtagagacggggtctccctgtgatacccaggctggtcttgaactcctcggctcaagcgctcctcccacctcggcctcccaaagttctgggattacaggtgtgagctaccacgtctggcctgggataactcattgtaaaactggtgaagacctgggaccttcccagtagacaatgggacagagtgattgacaggatgagttctggagtacatggcagaaatgtacagagaagtctcccagagaaaactaactggctggaaacagagcctctcctttcttcttygagaggatgagagtgtcactgtcttggatgccatagatccccagacccaaccagtcctgcaggacttggccttggaattccagctgctgctgctttttaggaagcccctgctggtcttcaatctgctgcttcagacccaggatgaagctgttggggttgatggcataggcgtagctcccaccatcaggattcttcacgaagacctggatctcggaggggatggtctccagcagatagatgtgagtgtgggagaagatcccatatttggctaaggagcacctgctgctgagaagctgcctc

SEQ ID NO: 28496 - DNA, 601 bp, Human
tgaccacactatttatttgtatatttagtcctcacacccctcctcatcctccccctggcagggctgggataatcctttttttaaacggatttacttatttttatgttttagtttttagacacagggtcttgctctgtggcctgggcaggagtgtagcggtgtgatcacagctcactgcagcttcagcctcctgggctcaagtgattcttctgcctcagcttcttgagtgcctgagactacaaatgtgcacaaccacacccagtgaattatttttttattttgtagagacggggtctccctrtgatacccaggctggtcttgaactcctcggctcaagcgctcctcccacctcggcctcccaaagttctgggattacaggtgtgagctaccacgtctggcctgggataactcattgtaaaactggtgaagacctgggaccttcccagtagacaatgggacagagtgattgacaggatgagttctggagtacatggcagaaatgtacagagaagtctcccagagaaaactaactggctggaaacagagcctctcctttcttcttcgagaggatgagagtgtcactgtcttggatgccatagat

SEQ ID NO: 28497 - DNA, 472 bp, Human
gccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcycgagttatcgggaccctgttgggtgagtggtcagagaaagttaacattcttttcttcctcccacttctcatttatctcactcccctaactcattaattctttaattcctggtgtcctaccgtcctttcctcccatccccaatgacctcttaatactatatactgcatccta

SEQ ID NO: 28498 - DNA, 601 bp, Human
aagagtattgcaagtgtattactgactgtgagcagtggctcaatgcctgtaatcccagctgggaggctgaggcaggaggatcacttgagcccagtagttcaagatcagcctgaacaaaatagtgagaccctgtctctacaaaaacattttttaaaaacttagccaggcatgatgacacacacctatagtcctagctattcaggaggctgaggctagaggatcacttgaggccaggaatttgaagttgcagtgagctatgatcatgccttgccactgcattccagcctgagtgacagagtgmgaccctgtctctaaaaaacaaaaggaaagtgtgttacctgtaggaactgtgaattcagtgggttttgctggtggttctgatcctgtggggccaggatatttcgaattaccttgtaagtgacttggaatttttcatcagcactaagtcagcctttgattttatttgacatagttttcggtgtgtgtattgctcttggcagttggtgtcactaggtgtcctaccgtagaagtgtccggtaccctgaagacacccatgccactgttgtgtttgatattgacgccacatatagacaggagtcca

SEQ ID NO: 28499 - DNA, 601 bp, Human
tgtgagcagtggctcaatgcctgtaatcccagctgggaggctgaggcaggaggatcacttgagcccagtagttcaagatcagcctgaacaaaatagtgagaccctgtctctacaaaaacattttttaaaaacttagccaggcatgatgacacacacctatagtcctagctattcaggaggctgaggctagaggatcacttgaggccaggaatttgaagttgcagtgagctatgatcatgccttgccactgcattccagcctgagtgacagagtgcgaccctgtctctaaaaaacaaaaggraagtgtgttacctgtaggaactgtgaattcagtgggttttgctggtggttctgatcctgtggggccaggatatttcgaattaccttgtaagtgacttggaatttttcatcagcactaagtcagcctttgattttatttgacatagttttcggtgtgtgtattgctcttggcagttggtgtcactaggtgtcctaccgtagaagtgtccggtaccctgaagacacccatgccactgttgtgtttgatattgacgccacatatagacaggagtccaccactgtgttccatttcacaggtacg

SEQ ID NO: 28500 - DNA, 601 bp, Human
cacgagtactacagccgagaggcccccaaccccatccacctcactgtggacacaagtctccagaacggccgcatgagcatcaaagcctacgtcaggtgaccacagtcttgggctacaagggcataaaaccatgcccagatgccatccctcccccaccccaagcaaggttaattccttccatgtgtaacttgctgtgtccttaggaagcctgttcctctctctcaacagttattctaaaggtttcactctgaaacaaaatctgttcctgtaatttctaccgctgatcctagttgtactccaktttctactcattgcccttttaagtatttgagcaagctgtcaagtcatcttttgtaggacctaactattccatagttcctacagccaatcatcacatggtattcttgtcatgatccttcaccacattcattacttttctgaattacccattagtttgtcattatctctagaactcagcacagcgctcagggtaatacagattataaggatgactgtccttattttgaacacatttattaacccaggattgagtgcagttttaatgacaatgacattacagtgaacacgttgagcttgcagg

SEQ ID NO: 28501 - DNA, 601 bp, Human
ccatagttcctacagccaatcatcacatggtattcttgtcatgatccttcaccacattcattacttttctgaattacccattagtttgtcattatctctagaactcagcacagcgctcagggtaatacagattataaggatgactgtccttattttgaacacatttattaacccaggattgagtgcagttttaatgacaatgacattacagtgaacacgttgagcttgcaggtggttaaaatgccagttatgggggatgttgggaaaggccctggtggcatgctgaggaagcagctgtggkagttggaaagaccatggtcaaagggaaggcagctgttagtgcatctgtcaggctgttgattttgtgctggttctgtgtctgacactgacatagccagttaactcttacacagtacacagtaagacaaagatggtggatgccaagtctttatgagccagttggcataccactaagcactagccattgcctgacttcttaaccttcccaggtatttcagactcctcaagatccagtatatatatatataggatccagtatatacaatatatatatataagatccaactatatatatgtatat

SEQ ID NO: 28502 - DNA, 601 bp, Human
gccaatcatcacatggtattcttgtcatgatccttcaccacattcattacttttctgaattacccattagtttgtcattatctctagaactcagcacagcgctcagggtaatacagattataaggatgactgtccttattttgaacacatttattaacccaggattgagtgcagttttaatgacaatgacattacagtgaacacgttgagcttgcaggtggttaaaatgccagttatgggggatgttgggaaaggccctggtggcatgctgaggaagcagctgtggtagttggaaagaccrtggtcaaagggaaggcagctgttagtgcatctgtcaggctgttgattttgtgctggttctgtgtctgacactgacatagccagttaactcttacacagtacacagtaagacaaagatggtggatgccaagtctttatgagccagttggcataccactaagcactagccattgcctgacttcttaaccttcccaggtatttcagactcctcaagatccagtatatatatatataggatccagtatatacaatatatatatataagatccaactatatatatgtatatatatgtagatagag

SEQ ID NO: 28503 - DNA, 601 bp, Human
caggtatttcagactcctcaagatccagtatatatatatataggatccagtatatacaatatatatatataagatccaactatatatatgtatatatatgtagatagagaaagatatatatagttgacatagtaaagtatagatccaggtatataattgacatagtaaaaagaatacctttagtgagatgacttatagcacccaatgtaatttggtgggcaggagttggtttcctttttcaatgctgatgaagggcgtagtccccgaaaagatttgtctctgtctcctttccatggtaggyagctgtctagacagccagctctacggggtaattgagtcctgtcctctcgtcactgacactgcaccgtgtgtgaagtaatcctctaaagggaccaggccaaatgcaaaggccccccttacagatcaagggtttggtatgtgggaaaagctaaggggagaaagtaacttttgctcccatgagacctctggggttcatttggtcccaccctttctatcagaaccttgagagccatattcctgctgtatctgctttctcagcccagaatagacatggaaaccctctcccaaggccatctgttta

SEQ ID NO: 28504 - DNA, 601 bp, Human
agtaggacgttaagaccatctctttcctggtgggatgactgaattctctctcttactgcccaccactgccgctgccaccctgccaaccaacttccatagttgacctgatcatgaagacctgctttagccccaacagagtgattggactctcaagtgacttgcagcaagtaggaggggcatcagctcgcatccaggatgccctgagtacagtgttgcaatatgcagaggatgtactggtgagaggggaaagaaaaaacaaagggggaggacatagttctctatcctgggatcactgaggcaygtgctgatgaaatggtagggctcagtggttataattaactgcctcatcgagtctttgttttggtactcagtctggaaaggtgtcagctgacaatactgtgggccgcttcctgatgagcctggttaaccaagtaccgaaaatagttcccgatgactttgagaccatgctcaacagcaacatcaatgtgagtgcccttcctgagccccttcttgcctggtttcttcccccacctcagcacatacactcaaatgtgaaaagagttgggtgaggtgacctggagtaggatagagacagggcttc

SEQ ID NO: 28505 - DNA, 601 bp, Human
cttcctgagccccttcttgcctggtttcttcccccacctcagcacatacactcaaatgtgaaaagagttgggtgaggtgacctggagtaggatagagacagggcttcacctatagccccactgaagtccaggttgggaggaaggaagaggtgtgttatgcgtggttggagacttccttccttctcccatgattccattgtctcatttactgctgatactactgtgacttactgtctaaattcgtgatggaaagaaacactaaaattcagaggttaatgaaaatgcaattacttatttcccycatctgagttcacagaccccctatattccatccatgggtttcagctaaggcacccctagtctataagtgtatcagtagagataagaaagccttctcaagcatttcctttctgtcttctacctttttgacttttattcagtctctcctagctgtcatttatccacagctgtcctcatacccagtgtctaccatagagctggccaaagccagcctttttgctccctttccacccaaccccccactcattgtgtattctttgtcttccaggaccttttgatggtgacctacctggccaacctc

SEQ ID NO: 28506 - DNA, 601 bp, Human
gtatcagtagagataagaaagccttctcaagcatttcctttctgtcttctacctttttgacttttattcagtctctcctagctgtcatttatccacagctgtcctcatacccagtgtctaccatagagctggccaaagccagcctttttgctccctttccacccaaccccccactcattgtgtattctttgtcttccaggaccttttgatggtgacctacctggccaacctcacacagtcacagattgcactcaatgaaaaacttgtaaacctgtgaatggaccccaagcagtacacttgytggtctaggtattaaccccaggactcagaagtgaaggagaaatgggttttttgtggtcttgagtcacactgagatagtcagttgtgtgtgactctaataaacggagcctaccttttgtaaattaatttcatcttatgtgagtttattgccgggtggaagggaggaaaatgttttagatcacacagaaactaggaagtgaatattgtaggtagagaagttggttatgtgtttggcatgttactgttttaccaaactgttcttttggttttcaatatggaaaggtgtccattggcaaaacaa

SEQ ID NO: 28507 - DNA, 601 bp, Human
ggcactgtgtgccaaaccacaggcagccagttggccacgaggacaccaaggtgacacctgagaagctgacaccatttgagctcccagccagcgacactggtggaggaggaggaggaggagccccgaccccaccccagagagggcgggaggacaacaggggcggcagcctcacatgcacagcaacggcagacatgggacacacaacaggaacagcgcccaggtccccctcgcgtggcaggcgacaagtgcacgtctgcactctcacactcgccaccagcaaatcccaccaaagaattcggayggtacagccacaggcatgcaacggagacactatacacacagtgcgcacacacgatgtggggtggtcagcaccctggggccgacagacagcagctcatcaggacagtcacagggccaccagcaaagtcacagctgccaagtcgcacatatatgggagacgcccgtctcccaaccataggaggtacagccaattaggaaggcacagacgccccgaggagagtctggcaccatcaaacccgctgcactgtcgtgcgggagatgacagcacgaaggcagcagtggggacagaacccgtgcactg

SEQ ID NO: 28508 - DNA, 601 bp, Human
tcgggcttcagtgttgagccagcgcaggcactgtgtgccaaaccacaggcagccagttggccacgaggacaccaaggtgacacctgagaagctgacaccatttgagctcccagccagcgacactggtggaggaggaggaggaggagccccgaccccaccccagagagggcgggaggacaacaggggcggcagcctcacatgcacagcaacggcagacatgggacacacaacaggaacagcgcccaggtccccctcgcgtggcaggcgacaagtgcacgtctgcactctcacactcgccacmagcaaatcccaccaaagaattcggacggtacagccacaggcatgcaacggagacactatacacacagtgcgcacacacgatgtggggtggtcagcaccctggggccgacagacagcagctcatcaggacagtcacagggccaccagcaaagtcacagctgccaagtcgcacatatatgggagacgcccgtctcccaaccataggaggtacagccaattaggaaggcacagacgccccgaggagagtctggcaccatcaaacccgctgcactgtcgtgcgggagatgacagcacgaaggca

SEQ ID NO: 28509 - DNA, 601 bp, Human
cttccctgtcttgttctgcgtggcctgcaccggctctagctctggggaccaaaagacagtcaagttcaacctcactgtggcgcaggcgtggggacagagccgccccaggaagctcgggcttcagtgttgagccagcgcaggcactgtgtgccaaaccacaggcagccagttggccacgaggacaccaaggtgacacctgagaagctgacaccatttgagctcccagccagcgacactggtggaggaggaggaggaggagccccgaccccaccccagagagggcgggaggacaacaggggcrgcagcctcacatgcacagcaacggcagacatgggacacacaacaggaacagcgcccaggtccccctcgcgtggcaggcgacaagtgcacgtctgcactctcacactcgccaccagcaaatcccaccaaagaattcggacggtacagccacaggcatgcaacggagacactatacacacagtgcgcacacacgatgtggggtggtcagcaccctggggccgacagacagcagctcatcaggacagtcacagggccaccagcaaagtcacagctgccaagtcgcacatatatgggagacgcc

SEQ ID NO: 28510 - DNA, 601 bp, Human
gtccacggactggcagggaccccaggcacaagagctgccacccctctgcccggttttggaaaaaaacaataaaggactgtcccctcaaaaccagccaggggactgttaaattggctcagggctattggttggcccaacactccgtgaaggtgctgggacaaggcagggagcaggggctggggcagggatggagtcttacttggcccactcgacgttgaggatgaggtggtcgtagccaaagccggacaccccggcaatggcacgcgcagcatcctcgcggcggtggaagctgatgaaggcraagccctgtggaggggcgggatggggtcgggcacgagctaggacaggcgaccctaggacaagtgaccctcacacagccccaccgtgcctgcctgcctgcccaccttggattggccagtggtcttgtccttagccaggtagatgcgggagatggagccgaaaggccggaagagctcctgcaggtcggtctcacgcgtgtcctctgacaagttggtgacacggatggtggcgttgtcgtcggctgtgtgggagaggggaggtggctgtgagggggaggacactgcccagccctcgtgtgctg

SEQ ID NO: 28511 - DNA, 601 bp, Human
gccaagggtcccggaccgagtacacagtggcagctggcttagttggtggacggcctggggtaggggagggtggcaggtataagacttctgggggcaccccaagaccccagacacccaagtggcatcttgggggtgggtgggcagaggacggggtaatgtgaggacgaagcgggcacggagccagatggccagtctccaggcctggtccacggactggcagggaccccaggcacaagagctgccacccctctgcccggttttggaaaaaaacaataaaggactgtcccctcaaaaccagccrggggactgttaaattggctcagggctattggttggcccaacactccgtgaaggtgctgggacaaggcagggagcaggggctggggcagggatggagtcttacttggcccactcgacgttgaggatgaggtggtcgtagccaaagccggacaccccggcaatggcacgcgcagcatcctcgcggcggtggaagctgatgaaggcaaagccctgtggaggggcgggatggggtcgggcacgagctaggacaggcgaccctaggacaagtgaccctcacacagccccaccgtgcctgcctgcc

SEQ ID NO: 28512 - DNA, 601 bp, Human
ccgagccccgacacatcccttcccccaaaaagcaacacctgtgcttgcagccaggtcaggcccagctgcagcccaggcaggagcagtcgcctttcccacccacagcgctggccacagggctccctgcagggtcagggaccagaccacgcccagaggaggggaggcactggcccccgccacaggactggagacgcaagaacaaaaacaaccaagtagagagagtggagctgctttattgcccttggagcccgcgctctcggaggctgtcttctgtcgccaagggtcccggaccgagtacacrgtggcagctggcttagttggtggacggcctggggtaggggagggtggcaggtataagacttctgggggcaccccaagaccccagacacccaagtggcatcttgggggtgggtgggcagaggacggggtaatgtgaggacgaagcgggcacggagccagatggccagtctccaggcctggtccacggactggcagggaccccaggcacaagagctgccacccctctgcccggttttggaaaaaaacaataaaggactgtcccctcaaaaccagccaggggactgttaaattggctcagggc

SEQ ID NO: 28513 - DNA, 601 bp, Human
tacaaggaccacttcttcagaagcagagctctcctctcagtctcctcaaaggtgagctccacctgaggccgctctctgcaaagaagctaagggttaccaatctcactggcatgtaagtctgtgactgcaactgacacaagtattcccattgccagacacagacaggacttaggagataaaacaagtttgggacaaattaagaaatggaatgttgaatgtggctgcagctgcaactgatgcttggaaccaaggtcatttgctctctgtcaaaagaacagatgatctgaggagactggtagcrcttcctctgcccaagcaaatactcccttgggtgagagaagacttttaacacctgcccctttatagatggtgcacactgcttacaaaacggcagcaggagctgttaaccctgcacacagtagaatcccaacaaataccaaccaaagatatctgcatgataaaacaggaggccaagggttttctactgttaggatgaggcgagggcttcagactccaggcccaagggatcagaaacagccaagactcctcatgcatgacagcaacaacatgaactccagagcagtgcttaagcatctggatt

SEQ ID NO: 28514 - DNA, 601 bp, Human
gcagacttgaaccctggtcattcctactctcaggggcagcatgttaaggatagcagcctgcaagtctatctcttaaactccacttgtgtgtacaccttggtgatgtcattgtacctgccttcagggggttggtagttagggatcggtggtgtgtaatgtggcccttccttctcaaaggggaacaggttaggatcccgcttgatggcctcagcatggagcttcggggattccagttgcagttcctccagagcttcctgctgggcttctagcatagccctgatggtgtccctctccatcttaygctcttgctgcttgtacaaggaccacttcttcagaagcagagctctcctctcagtctcctcaaaggtgagctccacctgaggccgctctctgcaaagaagctaagggttaccaatctcactggcatgtaagtctgtgactgcaactgacacaagtattcccattgccagacacagacaggacttaggagataaaacaagtttgggacaaattaagaaatggaatgttgaatgtggctgcagctgcaactgatgcttggaaccaaggtcatttgctctctgtcaaaagaacagatgatctg

SEQ ID NO: 28515 - DNA, 601 bp, Human
aagtctaaaattaactaaaactaaaaataaagagtcagagactaggtataacctgagtcaacaaatgatagtaaattaacttaattctcaaggagaatcattgtttttgtattcctagtgcctcaaaccaacctgacacatagcaggtactcaatttagtaacaaatgacggactaggatatactagttgaaatacacaaggacacatcataattccaggctactgctaaaaggaatgaaacattaaaaaagaaggtgggaaataaagattaataatatgagtacaaaattccacctgagraggattttaaaaattaaaaaggctcaccccgatactagctcccttcagttcactaatatcaacacttttctaagggtagggtcctcacctttaacaaatggcacttttggtcacacccactgccttccgctcctctgcctctaaaagtgatacttctccttggcttggggaggaagtgttgcgtggcctgcctcttccttcatgaagccacaaagtgccactgcgtgagttccgtggcacattggaacacagtgtacccgcctctgggcaagagccgtggaaatccacacatgaagccag

SEQ ID NO: 28516 - DNA, 601 bp, Human
acaaggttcaccagtggatgctaaactaacaggcaaaaatttgaggataaacagtatagtctcaaagtatctcccccaagataattcttaactacaaagggaaagacagtaactttgtagtggagaaatccaatcgctcaccacaagttcattccacgatatacctaactggtactcttcgaagaatcaaaatcatgaaagacgaggaaaaactgaggaactatttcagattggaggagactaaggagaaagaaaaactaaataaaatgcaggatccttgataaaatacaatgggaacagaaaaaaaaaaacagacattagtaggaaaattgatgaattttcaataaagtttgtagtttagttaatagtattgatcaatgtagtatggttatgtaaggggttaatattaggggaagctaggtgaactgtgtatcatttttacaacttttctgtaagtctaaaattaactaaaactaaaaataaagagtcagagactaggtataacctgagtcaacaaatgatagtaaattaacttaattctcaaggagaatcattgtttttgtattcctagtgcctcaaaccaacctgacacatagcaggt

SEQ ID NO: 28517 - DNA, 601 bp, Human
aaagtgagcgatggaaaaaaaatcactctcagcaaacaccacttaataactgttgcagacaaggttcaccagtggatgctaaactaacaggcaaaaatttgaggataaacagtatagtctcaaagtatctcccccaagataattcttaactacaaagggaaagacagtaactttgtagtggagaaatccaatcgctcaccacaagttcattccacgatatacctaactggtactcttcgaagaatcaaaatcatgaaagacgaggaaaaactgaggaactatttcagattggaggagactraggagaaagaaaaactaaataaaatgcaggatccttgataaaatacaatgggaacagaaaaaaaaaaacagacattagtaggaaaattgatgaattttcaataaagtttgtagtttagttaatagtattgatcaatgtagtatggttatgtaaggggttaatattaggggaagctaggtgaactgtgtatcatttttacaacttttctgtaagtctaaaattaactaaaactaaaaataaagagtcagagactaggtataacctgagtcaacaaatgatagtaaattaacttaattctca

SEQ ID NO: 28518 - DNA, 601 bp, Human
taacagcccaacctagaagcatttgagtaatttaaaaaaaaaatgatggcactgtattttaacccataggataaagtgactatccactagtctacactgataaaaatgatcaaacaaataaatgaatagaagagaaggggcggctcttttcttaaattccaactagtaagaaagtgagcgatggaaaaaaaatcactctcagcaaacaccacttaataactgttgcagacaaggttcaccagtggatgctaaactaacaggcaaaaatttgaggataaacagtatagtctcaaagtatctyccccaagataattcttaactacaaagggaaagacagtaactttgtagtggagaaatccaatcgctcaccacaagttcattccacgatatacctaactggtactcttcgaagaatcaaaatcatgaaagacgaggaaaaactgaggaactatttcagattggaggagactaaggagaaagaaaaactaaataaaatgcaggatccttgataaaatacaatgggaacagaaaaaaaaaaacagacattagtaggaaaattgatgaattttcaataaagtttgtagtttagttaatagtattg

SEQ ID NO: 28519 - DNA, 601 bp, Human
aggacaccatgtatcactctaaaaatatttactaagcatttgcaccaaggagaaagggtgtgttcattcggcagctatgagcaccaaaatcagcattccaacatctctgaacctatcaggtaattttgcagacacagggcatgtgagtgggcttgatgttgtcccaggcacatgatcctgatgccttggggctccctggggcaacaccagaagaaagactgattattttgctactctttttactcctgcagagttcctaggagtttaccttttacacacacattgccccactttccttaggccttggtattcattatcccaattacaactcctttaggagacttctaaatgatcactggccagatcctaaagggacagtggttccctgggcagggtaggaatgggataaaaatgatgacagccatttacatgtacaagtcatttaaacccagagattaagctcctaacagcccaacctagaagcatttgagtaatttaaaaaaaaaatgatggcactgtattttaacccataggataaagtgactatccactagtctacactgataaaaatgatcaaacaaataaatgaatagaagagaag

SEQ ID NO: 28520 - DNA, 601 bp, Human
tttggttttcctccactcaattcaaccagtctttttctgactacctgctattttcaagcaaagggaaaaccatataaagagaattaaagcctagtctttgtactcagggtttatttctatctttttctagatctcaatgtctgcaatttcctgtcaaatatgagaacaacatcccaaagtgggagaacagatgaaacaagacggataaaatactgagaagtcttgaatataagtgataggtacctgagagtcctttctttctctctacttttgtgaatgcttgagattttccataatagtktttaaaatctggcaaggaagataagctataacaaaaggaaaggaaacataagtgctaagtatcattcttggagaatctctaaccacacacatttttactccactaaagtgggtggggaggacaccatgtatcactctaaaaatatttactaagcatttgcaccaaggagaaagggtgtgttcattcggcagctatgagcaccaaaatcagcattccaacatctctgaacctatcaggtaattttgcagacacagggcatgtgagtgggcttgatgttgtcccaggcacatgatcctgatg

SEQ ID NO: 28521 - DNA, 601 bp, Human
atttccattttttcttttaatgagtatgtaatatttttataattagaaaaacataatgactttttaaagaaagttatttttagggcaagtgactcctggttggtgtttgggaaagtgccatcatattggatttatttacactaacatttaagtaattgagagacccttaattctcacaggagtctcagagttattttctttttcagtcaaggctgtcttgaagtgccaagggactacatcatcagtattgagaacaaattcaggcaacatgaaagaagttatttagggcaagatttaccaytcttttcctttctagaagtctgccccgtagttagttaaaaatggtcatgttttcatatttggttttcctccactcaattcaaccagtctttttctgactacctgctattttcaagcaaagggaaaaccatataaagagaattaaagcctagtctttgtactcagggtttatttctatctttttctagatctcaatgtctgcaatttcctgtcaaatatgagaacaacatcccaaagtgggagaacagatgaaacaagacggataaaatactgagaagtcttgaatataagtgataggtac

SEQ ID NO: 28522 - DNA, 601 bp, Human
gaacacatgtatttattggctctaattaccaatgtgattcatgttcaaatgttatcagaatattgcccaagataatgttatctctgggattaatgagatgatttttactttctaactctgtaatttccattttttcttttaatgagtatgtaatatttttataattagaaaaacataatgactttttaaagaaagttatttttagggcaagtgactcctggttggtgtttgggaaagtgccatcatattggatttatttacactaacatttaagtaattgagagacccttaattctcacargagtctcagagttattttctttttcagtcaaggctgtcttgaagtgccaagggactacatcatcagtattgagaacaaattcaggcaacatgaaagaagttatttagggcaagatttaccactcttttcctttctagaagtctgccccgtagttagttaaaaatggtcatgttttcatatttggttttcctccactcaattcaaccagtctttttctgactacctgctattttcaagcaaagggaaaaccatataaagagaattaaagcctagtctttgtactcagggtttatttctatc

SEQ ID NO: 28523 - DNA, 601 bp, Human
tctttatttattttttatttttattttttgagacagggtctcactctattgcccaggctagagtgccgtggcacaatctcagctcactgcaacctctacctcccggttcaagcaattctagtgcctcagcctcccaagcagctgggattacaggcgtgcaccactacgcccagttaatttttgtatttttagtagagccaaggtttcaccatgttgtccaggctggtcttgaactcctggcctcaagcgatccatccaccttggcctcccaaagtgctaggattacaggtgtgagccaccrcacccagccctgggaacatggcttttctaagagctatttttagagggagagtcccctggaagagagaatcaccaagtggaaggaggttatgaccataaaattactgcagtgttgaaatcagaaaagatcttaaagaccacacatccacctccctcattctacagagtgggaagagatttaaaaacctacccaaggcacggggtacatgggaaatctctgtatcttctgctcagtttggttaagaatctaaaactgtcctaaaaaatacagctgaaccttgaacaacatgggtttgaactg

SEQ ID NO: 28524 - DNA, 601 bp, Human
taatcacatggaaacacttatgattaaatcttaaatgacaaaaagaaaaacagaaagtaagccctatatctgtgctatgattacaactaacaatatatacaattaaggaaagtctagaaagctaataataattatattaggagaatgggattcgctggggtggtttattttttctcttttctttttagaatttttaataatatattttatatttttaataatttttatttttataaaatttattttataaattttattttatttaataatttttaatagtatattttataaaatataaaaaaatatattttatattttaatatattttatatttttagaatttttaatatattttatataaatgtatatatttttgtatatcacatattgtcatatttacatatattttacatatatcattttataatatggcagtcttacaatgaaaacaaagtgaatttttttaatggtgaatagagaggcagtaagtaactgtaaaaaacaacaaccacctcagaaactctcaagatagtttcacacttactaaaggatacaactccagaaatttagtttcaggttagtttgaaggaaacctagaaaa

SEQ ID NO: 28525 - DNA, 601 bp, Human
ctgtgtggacaaatcacgtctctcctcaaattctaaacatgttctcagaagaacacagaaaatgctaaagctagggcacagataatctccatagacaaacatattctcaaacaaataaaatggagaccaaaatattttctatgctaaataatcacatggaaacacttatgattaaatcttaaatgacaaaaagaaaaacagaaagtaagccctatatctgtgctatgattacaactaacaatatatacaattaaggaaagtctagaaagctaataataattatattaggagaatgggattmgctggggtggtttattttttctcttttctttttagaatttttaataatatattttatatttttaataatttttatttttataaaatttattttataaattttattttatttaataatttttaatagtatattttataaaatataaaataatatattttatattttaatatattttatatttttagaatttttaatatattttatataaatgtatatatttttgtatatcacatattgtcatatttacatatattttacatatatcattttataatatggcagtcttacaatgaaaacaaa

SEQ ID NO: 28526 - DNA, 601 bp, Human
tcctctctgtgtggacaaatcacgtctctcctcaaattctaaacatgttctcagaagaacacagaaaatgctaaagctagggcacagataatctccatagacaaacatattctcaaacaaataaaatggagaccaaaatattttctatgctaaataatcacatggaaacacttatgattaaatcttaaatgacaaaaagaaaaacagaaagtaagccctatatctgtgctatgattacaactaacaatatatacaattaaggaaagtctagaaagctaataataattatattaggagaatrggattcgctggggtggtttattttttctcttttctttttagaatttttaataatatattttatatttttaataatttttatttttataaaatttattttataaattttattttatttaataatttttaatagtatattttataaaatataaaataatatattttatattttaatatattttatatttttagaatttttaatatattttatataaatgtatatatttttgtatatcacatattgtcatatttacatatattttacatatatcattttataatatggcagtcttacaatgaa

SEQ ID NO: 28527 - DNA, 601 bp, Human
taaattgccactctgatttcatacttcagtagcatgagatgggataatatgaattcacttctaagagggggctatgctcttaattattgacaaaaatcatgtttttaagaccacctagctgagggcccaccctggaccacagaaaatacactaaagtggtaaaggccacctgacaaggatacctggtttgccgccagcaacatccaccatatcctctctgtgtggacaaatcacgtctctcctcaaattctaaacatgttctcagaagaacacagaaaatgctaaagctagggcacagatratctccatagacaaacatattctcaaacaaataaaatggagaccaaaatattttctatgctaaataatcacatggaaacacttatgattaaatcttaaatgacaaaaagaaaaacagaaagtaagccctatatctgtgctatgattacaactaacaatatatacaattaaggaaagtctagaaagctaataataattatattaggagaatgggattcgctggggtggtttattttttctcttttctttttagaatttttaataatatattttatatttttaataatttttatttttataa

SEQ ID NO: 28528 - DNA, 601 bp, Human
gaagtagttactggtggcccacccaaccactgtcaggcacaaagtcaacagcaacagtaatcggaatttgtaggaaaggtggaaagtcaggttgaagcccatgttttttattacgtgaataatatctatctctctgcttcactgcaggcaagaaagcttcaagttgagcttttccaatctgattgcgaacttgatgacaactgaagatacaatgcctggtttttctcagtagttctgctccaacagtctaaaacgcaatcacaaaagacacgttgtttcaaatggaaattctatcctgaartgattcactccagcacaaactgaaaacccatccccgatggaccttgactaaccgtaatggtaggtcttccacttagcatttagagattcgaaaaccagaggttttagaggttccaagcatcaatacatcacagaagcactctctagtttatcagccaggctgtctgccacccaagaagggaagcaatttccaaatgttggacagaacaaataggcaaaggagacaaggagactgcaaagacctgagctggacacagcctaagacatagccctaatggttctctgcctcagttgccccttc

SEQ ID NO: 28529 - DNA, 601 bp, Human
gaatttcctctactcctttcaaggataaatgaggtaagagaactcgtttttgatgatagtctgatgttccttttacccaacatagacaaacagtcacatggccaagtctggcagagaagaggagggtcgagggcaggccctggtctgcccccacgctcacctggtggatgacgtagatgccataatccagctgctgcctctgcaggaagggatgcagatgttccagcaggtacatcaggtgtttctctctgttccggtggggaacgaggatggcgaccctctgtaaagctttacattcctsagggcgataccggcctctggacactttgggattttctgcctgtacctcttccaaagtgagatctggtttgaaaatgagcttgctctggcctcctacaatgaacataggacacagacaataacagtagctacttcaaaaagtgttgaggtttacacgagctaatatgcatagaaagaacactgcccagctcacagtgagtactacaaatgtcagcttttattatgattactttaaaggctcatttagtcatgataatggccagagcatcatgtcactaaggttactggctgcaaaagcaag

SEQ ID NO: 28530 - DNA, 601 bp, Human
tcatcatatagtgcatggcacgcacagaaagaaacagaaggggccaggaagcctccggggaaatctgagggcagtcattggctaacatggaagggctcacaaaacaggcttcctccagaggttcctttaagggcagtaaaatttcccagaacttgaacccataactccacactctgagacaagaatttcctctactcctttcaaggataaatgaggtaagagaactcgtttttgatgatagtctgatgttccttttacccaacatagacaaacagtcacatggccaagtctggcagagaaraggagggtcgagggcaggccctggtctgcccccacgctcacctggtggatgacgtagatgccataatccagctgctgcctctgcaggaagggatgcagatgttccagcaggtacatcaggtgtttctctctgttccggtggggaacgaggatggcgaccctctgtaaagctttacattcctgagggcgataccggcctctggacactttgggattttctgcctgtacctcttccaaagtgagatctggtttgaaaatgagcttgctctggcctcctacaatgaacataggacacagacaa

SEQ ID NO: 28531 - DNA, 601 bp, Human
ttgctatggttgataatgacagacaattccagaatctcatcatatagtgcatggcacgcacagaaagaaacagaaggggccaggaagcctccggggaaatctgagggcagtcattggctaacatggaagggctcacaaaacaggcttcctccagaggttcctttaagggcagtaaaatttcccagaacttgaacccataactccacactctgagacaagaatttcctctactcctttcaaggataaatgaggtaagagaactcgtttttgatgatagtctgatgttccttttacccaacayagacaaacagtcacatggccaagtctggcagagaagaggagggtcgagggcaggccctggtctgcccccacgctcacctggtggatgacgtagatgccataatccagctgctgcctctgcaggaagggatgcagatgttccagcaggtacatcaggtgtttctctctgttccggtggggaacgaggatggcgaccctctgtaaagctttacattcctgagggcgataccggcctctggacactttgggattttctgcctgtacctcttccaaagtgagatctggtttgaaaatgagcttg

SEQ ID NO: 28532 - DNA, 601 bp, Human
gtagtgatgattttgctgacattcttagaatttataagaatttgagggggaattatccctcttcttggcctccttggatggccaaggataactgtgaaaagtttagacactgatgtttaaactgatgtcttagttttctttcaataaactttaatgccaaatagaggtatctttaatcatccactccactgacctcagaggtaagctcttcaaaagcagccgatagttatgctgtgctcctaccaaatcatgcttctggaagtcaaatagatgaatccagaaagtgaaaatcaaacataayatgtttcacataataaatagtggcaaagttcagggcagaaatgtggtggcagccatagagcaccacagctactaatacagaatgttctttcaaatcctctgtctagatccccattgagttgctatggttgataatgacagacaattccagaatctcatcatatagtgcatggcacgcacagaaagaaacagaaggggccaggaagcctccggggaaatctgagggcagtcattggctaacatggaagggctcacaaaacaggcttcctccagaggttcctttaagggcagtaaaatttcc

SEQ ID NO: 28533 - DNA, 601 bp, Human
aaaacaaaaatagctataaaacaatataatagtaacattttgttccaagtactaaaatacagacataggtgtgctatataagcacactgattttcaagagcctcagtttatcaccaagtctatactgcagagctggtcctctgagttgtccaaagttttatctaaaagaaatattacctgttctaacagtagtgatgattttgctgacattcttagaatttataagaatttgagggggaattatccctcttcttggcctccttggatggccaaggataactgtgaaaagtttagacactgatgtttaaactgatgtcttagttttctttcaataaactttaatgccaaatagaggtatctttaatcatccactccactgacctcagaggtaagctcttcaaaagcagccgatagttatgctgtgctcctaccaaatcatgcttctggaagtcaaatagatgaatccagaaagtgaaaatcaaacataacatgtttcacataataaatagtggcaaagttcagggcagaaatgtggtggcagccatagagcaccacagctactaatacagaatgttctttcaaatcctctgtctagatcccc

SEQ ID NO: 28534 - DNA, 601 bp, Human
ttcaaattccttcagaatgaattccagttaagtggtttatcataaaagtgcaagtatttctcagaagttaccacaatgttttcctgataagaataacacgaagcagacatatttttctctttctctttttctttttttttaatttgagatggaatctcgctctgttgcccaggctggagtgcagtggtgtgatcttacctcactgcagcctccacctcctgggttcaagtgattctcctgcctcagcctcctgggtagctgggactacaggcatgtgccaccacacccaactaattttttktttttttttagtattttaacagagtattttgtatttttagtagagacagggtttcactatgctggccaggctagtctcaaactcctaacctcaagtgatccacccaccttggcctcccaaagtgctgagccaccgggcctggcccaaagcaaacatgtttttctattcataaaaatagtactataccttgtaggttactgtcctgagcaagaactcagaatcaaataaatcataactatgaccaacaaccttaaaaacaaaaatagctataaaacaatataatagtaacattttgttcca

SEQ ID NO: 28535 - DNA, 601 bp, Human
aataatcaataataatgtacacttaaaatgtattgagtatagctctcatgttaaatattcttaccacagttaacaaaaaaaaattttctcttaaaattttacaaatacctttacgtattctgtataaaactacaaaacctttcttatatactagtcatgtcaattagtattactgcttcacagttcaaccctaggtaatcccaatcttaccctctgttatgaatttacactaagcttctaagagacttagttaatagcttgccagaaaggatcaagaaatctcaacctatagaaagagaargttattgctaatatttctaagctactttaaagtttctcagaaatccctgtaagagaatcctgttataatgctactggtggaggctaatcctcacagtggccttatggaggtagattcgtcactgggcaataaaagaacacagtttgacctgtaatatgattgaagctgtaataaaaaaattaaataattttttcatggctgcttcattcaaattccttcagaatgaattccagttaagtggtttatcataaaagtgcaagtatttctcagaagttaccacaatgttttcctgataagaat

SEQ ID NO: 28536 - DNA, 601 bp, Human
aaaacttgaaaagctcctgagataaagtttcatattgtttgcctcttagttaggattcaggagatggtattattctaattattctacgcacgagactacacttgtgacataaagatctgacagagaagatgcaatgacaataaaagaccatttgatttttttcttcgtgcttcacacatacttatattccagaacttagaaacagtccttgaaatccaaagagttgttgtttaatgatagagagttccagttttgcaagattaagttctggagattgatttcataaatacactgcatatakttatgcaaccaatatattgcataattatgcatagatacattgcatgtaaatattcttaacattactaaactgcacactcaataatagttaagatagcaaaaattttaaaaagttaaaaaaagttaagatggtaaattttacgtcgtgtgtttcacaattaaaaattttttaaaagcagctttaaaatacaaataactcaaataatcaataataatgtacacttaaaatgtattgagtatagctctcatgttaaatattcttaccacagttaacaaaaaaaaattttctcttaaaatttta

SEQ ID NO: 28537 - DNA, 601 bp, Human
aaaattaaaacttgaaaagctcctgagataaagtttcatattgtttgcctcttagttaggattcaggagatggtattattctaattattctacgcacgagactacacttgtgacataaagatctgacagagaagatgcaatgacaataaaagaccatttgatttttttcttcgtgcttcacacatacttatattccagaacttagaaacagtccttgaaatccaaagagttgttgtttaatgatagagagttccagttttgcaagattaagttctggagattgatttcataaatacactgyatatatttatgcaaccaatatattgcataattatgcatagatacattgcatgtaaatattcttaacattactaaactgcacactcaataatagttaagatagcaaaaattttaaaaagttaaaaaaagttaagatggtaaattttacgtcgtgtgtttcacaattaaaaattttttaaaagcagctttaaaatacaaataactcaaataatcaataataatgtacacttaaaatgtattgagtatagctctcatgttaaatattcttaccacagttaacaaaaaaaaattttctcttaaa

SEQ ID NO: 28538 - DNA, 601 bp, Human
agtttcacagttctttctctcctgccttcttcttcctctcttcatttgtccctctctcccctccttaccaagtgcttatagttgtatttgcagaaatgcaaaattaacgcaactccactgtagctacctgtctccccacactgacactcaacggggagccctgtgagggcaggtgctctgccttattcaaactggtcttatggcctccagcacagtcagcaccacagatatgagcacccatgaacagcagggcctggggaaagctgacaggtaagtgtgcacacaaatgagggaatatagygtttcatttgcagagaaacattctgtgtcactattcccgcttggttgtgcttgaataggagctggtgaatcaaataaggctgaaaagcagctacacccttcttaagggtggaggggatggggaatgaagacacagatgatggcatctggcacttctcacagtggctttgagagaaatgaacttgtcctgggtgtcctggctcccgagaagactactcagaggacatgccctcccccacctctccccatattctagaaagaggccacagtctggaaagtgatgtctcaacagaggtctcac

SEQ ID NO: 28539 - DNA, 601 bp, Human
cacctacatcaatgttacttaagaattctcttaaattgcccaaagtgagagagcaacacagaagcccagaacaaatgaggtatcaagagactcactttccacttcacactcacgtagagtacatactggtggaatctccagcattatttgatagtttcacagttctttctctcctgccttcttcttcctctcttcatttgtccctctctcccctccttaccaagtgcttatagttgtatttgcagaaatgcaaaattaacgcaactccactgtagctacctgtctccccacactgacactyaacggggagccctgtgagggcaggtgctctgccttattcaaactggtcttatggcctccagcacagtcagcaccacagatatgagcacccatgaacagcagggcctggggaaagctgacaggtaagtgtgcacacaaatgagggaatatagtgtttcatttgcagagaaacattctgtgtcactattcccgcttggttgtgcttgaataggagctggtgaatcaaataaggctgaaaagcagctacacccttcttaagggtggaggggatggggaatgaagacacagatgatggcatctg

SEQ ID NO: 28540 - DNA, 601 bp, Human
actgctttcctcaatgcagaagtgactcaaagaaaccagaaaacaaaacccctagataataagattagatccaaagatcaagtttccccaaagaaaaaaatcatgggattctctccttgccctctggatccacagcccccgccctaactcagacatgtggcgtctctcccctcagctttcccctcttcccttgcttcatctgatacattcaaaatcagctgaaccaagctttctcccatccttccccagctgtaacgtgtcaacagctccccaacccctgccacagcaacttcgaactccrtatcagactaaagaaggcctgcgtaatctggctcctgcttagcctcagttcttgcctctcctcgcagacattccttctagaataccagtgaactattgcattttccccaaaactgcgctgtgctctctggcatgtcttggaactctgctgagaagctcttgttgttccacaagattaaggtaccaccttacctggggaacagctttaaacccttcccttcaaggtgtttcttaaagacactgtgctctcacccaccatagtttgttctaggtgtttatgtcctgcagcttacacacagcc

SEQ ID NO: 28541 - DNA, 601 bp, Human
ttaagcaatcctctgtgattgcttagaaatgaatggtgcaaccaggtgtttaaaaaaatctgggcaatgggaagtttaagattatcatctatggtaagtgtctaaggtacaggtgttctgtgttgtaaatagtgacatcttactacagagtaagtgaacagatggtgacatgcttttgaaaaaaccaagttgcccagccatgatacactgctttcctcaatgcagaagtgactcaaagaaaccagaaaacaaaacccctagataataagattagatccaaagatcaagtttccccaaagaraaaaatcatgggattctctccttgccctctggatccacagcccccgccctaactcagacatgtggcgtctctcccctcagctttcccctcttcccttgcttcatctgatacattcaaaatcagctgaaccaagctttctcccatccttccccagctgtaacgtgtcaacagctccccaacccctgccacagcaacttcgaactccatatcagactaaagaaggcctgcgtaatctggctcctgcttagcctcagttcttgcctctcctcgcagacattccttctagaataccagtgaact

SEQ ID NO: 28542 - DNA, 601 bp, Human
atctgatgaaatccatgactgtgacaccaaagcatgagtgaaaatcagttcctggcaggaatgtccaagagctcagccttcttatggttcagcttaatagaaagataaaatctagaatcccagcaaaaaacctgtccttaagcaatcctctgtgattgcttagaaatgaatggtgcaaccaggtgtttaaaaaaatctgggcaatgggaagtttaagattatcatctatggtaagtgtctaaggtacaggtgttctgtgttgtaaatagtgacatcttactacagagtaagtgaacagatrgtgacatgcttttgaaaaaaccaagttgcccagccatgatacactgctttcctcaatgcagaagtgactcaaagaaaccagaaaacaaaacccctagataataagattagatccaaagatcaagtttccccaaagaaaaaaatcatgggattctctccttgccctctggatccacagcccccgccctaactcagacatgtggcgtctctcccctcagctttcccctcttcccttgcttcatctgatacattcaaaatcagctgaaccaagctttctcccatccttccccagctgtaacgt

SEQ ID NO: 28543 - DNA, 601 bp, Human
ctggccagttagaatggcaagttagaaacagcaagagtcatacatatgctgtttctcagagtgagcggcatctgatgaaatccatgactgtgacaccaaagcatgagtgaaaatcagttcctggcaggaatgtccaagagctcagccttcttatggttcagcttaatagaaagataaaatctagaatcccagcaaaaaacctgtccttaagcaatcctctgtgattgcttagaaatgaatggtgcaaccaggtgtttaaaaaaatctgggcaatgggaagtttaagattatcatctatggkaagtgtctaaggtacaggtgttctgtgttgtaaatagtgacatcttactacagagtaagtgaacagatggtgacatgcttttgaaaaaaccaagttgcccagccatgatacactgctttcctcaatgcagaagtgactcaaagaaaccagaaaacaaaacccctagataataagattagatccaaagatcaagtttccccaaagaaaaaaatcatgggattctctccttgccctctggatccacagcccccgccctaactcagacatgtggcgtctctcccctcagctttcccctcttcc

SEQ ID NO: 28544 - DNA, 601 bp, Human
tctgctcactgagcaaagtgccacccagctgttaatggtgatgtttgtgtgtagaggcctatagagatacctgtcaatgtgaaccacaccatcagatattgataagatttcatctcatgtgccaatccaaggaatggtaacagttgccaagggcactgggttaagaaggattctgaggctgcatccgggttcagcacgaatgcgtgtcatgatgaatatacctttcttttttttcactttcacttttgcaggggagggttgaaggcaggagacagctcccgcacacactctgtatgcaaayctccacttctcaacatgcatctccagctcagagtctgtttcctggataacccaacacatgtcaacaccctctgaagtttctggcctgccaaccagacagagtctaggtagtgcttttcatgaaaataggctgtacagaacaagaattaggttttgaaaggaaggacagtgaatcatgctttagataagctgaattttagatacacctggggctttgccagtaggcaaaaggatacagggtccaagctcacaagagaggaacgactacagatatggctttggaaataagctgttatcatgt

SEQ ID NO: 28545 - DNA, 601 bp, Human
gtttatcactagcctttgctactcttgtcctgaaatgtagcacgtaccctctgtccagttcctaagccatgaccacataggctgctgatgggctgggctgtgaagagctgttgcccatcactacggccatttctgtagagcccctggtcaggggaatccactccctcctgctagaaacattccagaggctctcagcctagacatgggaacaagagcagcatggagcccctgggttctttatgatgaggcaacaaaaaaatttctgacagtcacgtaactaataattcagagccccaggttrgaaatttcctttccagccaggcacagtggctcacacctgtaatcccaacactttgggaggccaaggcagacagatcacctgaggtcaggagttcgagatcagcctggccaatatggtgaaacctggcctttactaaaaatacaaaaaaattagccagacacggcggcacacgcctgtagtcccagctactcgggaggctgaggctggagaatcactcaaacccgggaggcagaggttgcggtgagtcgagatcacgtcactgcactccagcctgggtgacagagcgagactttgtctcaa

SEQ ID NO: 28546 - DNA, 601 bp, Human
ttctactaatcaccccagtgaagtacatttggggaagataatggggattgtttatcactagcctttgctactcttgtcctgaaatgtagcacgtaccctctgtccagttcctaagccatgaccacataggctgctgatgggctgggctgtgaagagctgttgcccatcactacggccatttctgtagagcccctggtcaggggaatccactccctcctgctagaaacattccagaggctctcagcctagacatgggaacaagagcagcatggagcccctgggttctttatgatgaggcaamaaaaaaatttctgacagtcacgtaactaataattcagagccccaggttagaaatttcctttccagccaggcacagtggctcacacctgtaatcccaacactttgggaggccaaggcagacagatcacctgaggtcaggagttcgagatcagcctggccaatatggtgaaacctggcctttactaaaaatacaaaaaaattagccagacacggcggcacacgcctgtagtcccagctactcgggaggctgaggctggagaatcactcaaacccgggaggcagaggttgcggtgagtcgaga

SEQ ID NO: 28547 - DNA, 601 bp, Human
tgtgatcagggcaaaattctactaatcaccccagtgaagtacatttggggaagataatggggattgtttatcactagcctttgctactcttgtcctgaaatgtagcacgtaccctctgtccagttcctaagccatgaccacataggctgctgatgggctgggctgtgaagagctgttgcccatcactacggccatttctgtagagcccctggtcaggggaatccactccctcctgctagaaacattccagaggctctcagcctagacatgggaacaagagcagcatggagcccctgggttmtttatgatgaggcaacaaaaaaatttctgacagtcacgtaactaataattcagagccccaggttagaaatttcctttccagccaggcacagtggctcacacctgtaatcccaacactttgggaggccaaggcagacagatcacctgaggtcaggagttcgagatcagcctggccaatatggtgaaacctggcctttactaaaaatacaaaaaaattagccagacacggcggcacacgcctgtagtcccagctactcgggaggctgaggctggagaatcactcaaacccgggaggcagagg

SEQ ID NO: 28548 - DNA, 601 bp, Human
agcaggaaagaagacactgaagatatgtgatcagggcaaaattctactaatcaccccagtgaagtacatttggggaagataatggggattgtttatcactagcctttgctactcttgtcctgaaatgtagcacgtaccctctgtccagttcctaagccatgaccacataggctgctgatgggctgggctgtgaagagctgttgcccatcactacggccatttctgtagagcccctggtcaggggaatccactccctcctgctagaaacattccagaggctctcagcctagacatgggaacwagagcagcatggagcccctgggttctttatgatgaggcaacaaaaaaatttctgacagtcacgtaactaataattcagagccccaggttagaaatttcctttccagccaggcacagtggctcacacctgtaatcccaacactttgggaggccaaggcagacagatcacctgaggtcaggagttcgagatcagcctggccaatatggtgaaacctggcctttactaaaaatacaaaaaaattagccagacacggcggcacacgcctgtagtcccagctactcgggaggctgaggctggaga

SEQ ID NO: 28549 - DNA, 601 bp, Human
tctcagttccctcatctgtaaaatggcaatggtgatagggagttgatttcaaatattcaaatgatataatctgcatggaacatgcttgtactctgcaatgtattatatgtattatataagtacaaagaagggtagtgcctgttgcacaggcgaataaataagcagtaaatctcaaccaactttcatattcaaatcatcttagtttatctaccacattagtcaaaaaccattctgaaggccatgatggtcttttcaaatgaaagcaaaattggaggctcccctctactttgaagctgaagcrtagcaggaaagaagacactgaagatatgtgatcagggcaaaattctactaatcaccccagtgaagtacatttggggaagataatggggattgtttatcactagcctttgctactcttgtcctgaaatgtagcacgtaccctctgtccagttcctaagccatgaccacataggctgctgatgggctgggctgtgaagagctgttgcccatcactacggccatttctgtagagcccctggtcaggggaatccactccctcctgctagaaacattccagaggctctcagcctagacatgggaa

SEQ ID NO: 28550 - DNA, 601 bp, Human
tcacctcattgcctttgtctctagtgtggaagaccattgtatatttacccacttcaggcaggggccgggaaattttcattctttggagctcaaccctagaaaaataatagagatttttttaaagtccatcctatttatctaccactaggcaaataaaaagcatcatttgcgaaaatttatacacacacacacacatacacacacacacacacacagtgtcacaaacagcttgattattggagtattaaaaaaagaaaaacttctaaaatttccaatttcttataatggtggaacttcaggygataagcccaaaaaagaatgagattcagcatttattactggggtacaaaggagatgtgttagtttatacttagtcattttcaaaaagaaaaaaaaatgataaagtacttatttcaaaacatcctgaagaataggagaatcaagtctgttaggatccccaatttacttagagttgccttcttttaacaaagaaaggaatggccatttatggtcacaagttttaaagctacaattctaggttcaaatctggactctgttatttacaacctcagtaagtcagttcacagttccaggtctcagt

SEQ ID NO: 28551 - DNA, 601 bp, Human
tcttttaacacaatgaactggctcaaatctgatcgaattcaacatagtccttattgacagaacagactagggaggtagcctgctaggcaggtgaagccaggacttaccgttctgcgttcacctcattgcctttgtctctagtgtggaagaccattgtatatttacccacttcaggcaggggccgggaaattttcattctttggagctcaaccctagaaaaataatagagatttttttaaagtccatcctatttatctaccactaggcaaataaaaagcatcatttgcgaaaatttatacayacacacacacatacacacacacacacacacagtgtcacaaacagcttgattattggagtattaaaaaaagaaaaacttctaaaatttccaatttcttataatggtggaacttcaggcgataagcccaaaaaagaatgagattcagcatttattactggggtacaaaggagatgtgttagtttatacttagtcattttcaaaaagaaaaaaaaatgataaagtacttatttcaaaacatcctgaagaataggagaatcaagtctgttaggatccccaatttacttagagttgccttctttt

SEQ ID NO: 28552 - DNA, 601 bp, Human
cctcagaaaaaaataaatgaactttaacaggactgtttaatatcaggctaaaagcactttaatattgttttaaaatgtagactataacaaaagcactaaaaaccccttaagactgtttgaaaatttaaggggaaaaatcagaacaaagaaatacagattcttcaatcaaagcctcataagaactggcttatctgccaggattccttgtgaataggccaattcccaaggcaggaaaagtacaagaagagcctagaacatttcatcacagcagagcacagggagggaagctctcgaggactaytgggattcaggacccagcttgaagaagatcccattggccaaagatgagacaatatgagtaccaaaaagtacaagaactacatcctgaaggatgctaggaaacaccaagtcattagtctgaaaaatttttaatcagtgcttgactcttttctctttattctgcctttcctataaaaactataccccagagtacccaaatacatgaaaagggaaagtactttgtagaaaaatctaataaatgcagaaggaacaatagaattagaatattacaattttgcaactcctaattaaataataaatt

SEQ ID NO: 28553 - DNA, 601 bp, Human
gactagaaaaacatagaaaatagaaatagctattttgttggagtggttgactctaccaaaagggtgaaaagccatttaataatgctttaaaatataaactttaggccaggcatggtagctcatgctgtaatcctagaactttgggaggctgaggcaggaggactgcttgagcccaggagtttgagaccagcctttggcaacacaggaagaccctgtctttacaaaaaataaaaaaaaattagccaagcatggtgacacatgcctgtggtcccagctacttgggaggctgagcttggaggaytgcttgagcctgagagatcgaggctgtagtgagccatggtcacgccactgcactccagcttgggagcgagaccctgcctcagaaaaaaataaatgaactttaacaggactgtttaatatcaggctaaaagcactttaatattgttttaaaatgtagactataacaaaagcactaaaaaccccttaagactgtttgaaaatttaaggggaaaaatcagaacaaagaaatacagattcttcaatcaaagcctcataagaactggcttatctgccaggattccttgtgaataggccaattccc

SEQ ID NO: 28554 - DNA, 601 bp, Human
agctgtaacaggttcttaatgtgtgctactatttgaagtctctaggccaaaattattgcaaacaaagaatcagttcttccaaacatcaccaaaagatccagggtcatgcaccaaaccagaaatccactgtgatgttgatatataaaggattgtgttccacagatactaatttataagaacaactactcaacccatctgttctccagactcgtgacacttggtgtaagagcttcatcctaaagataaaaagaacaaatgtgaatgataagaatttaacatatgtctccactgcattttgccttgccctgaaatgtggcaaacatatttttgtaaattattgtacctgttgtgtttcctaccattacaaagtttgttttccccattgaaggtgacagacatgatagccatgtattcatgtgtcagactccacgtgagaacccggggacccatgatgaaaagtgtcactgcactcagtgagcccccagtctacaggacagaaggatgtgcaaggaatacagatactacaggatatgtaccaaccattgctaactgatccttggctgagcttcaggggatctctgaatcttcctatgttataagg

SEQ ID NO: 28555 - DNA, 601 bp, Human
tactgaaatgaacatatctgtaggcctcaaagaacaataaaaaacacgaaggaacactcaaagctttttcacattttactacagaggtatttgatagacatatttattattagttaatatgtaaacttgtaaactgctaattcatatcctacttgtacaaaatcattttacaaaaactctttaaaaactaatagagaatgtattctctggtgggcatcactggaaggcatacctgggcaggtcctcccctgaaggctatcagcagctgcaaccagctcagctactgctgcctttgcagccracactccaccctcctgctacctcttcattcccaagttcactgtgtcctgattcgtcgccttttctcccctcttttgtggacgccttctcacctgacaccaccacttcacagatgattgtacaggataaatgaataacagtattgtatcttcgtacctttctaccttggacgagaacaactctggttctctcagacattcagcagtcttatttcctgtggccttttatcccataatatattacttcaaatttaaataaatctccttcaaccagagtcctcaaatagcgttcattttatcct

SEQ ID NO: 28556 - DNA, 601 bp, Human
catttgttctgtttttaagctctttagaattatggatactgaaatgaacatatctgtaggcctcaaagaacaataaaaaacacgaaggaacactcaaagctttttcacattttactacagaggtatttgatagacatatttattattagttaatatgtaaacttgtaaactgctaattcatatcctacttgtacaaaatcattttacaaaaactctttaaaaactaatagagaatgtattctctggtgggcatcactggaaggcatacctgggcaggtcctcccctgaaggctatcagcasctgcaaccagctcagctactgctgcctttgcagccgacactccaccctcctgctacctcttcattcccaagttcactgtgtcctgattcgtcgccttttctcccctcttttgtggacgccttctcacctgacaccaccacttcacagatgattgtacaggataaatgaataacagtattgtatcttcgtacctttctaccttggacgagaacaactctggttctctcagacattcagcagtcttatttcctgtggccttttatcccataatatattacttcaaatttaaataaatctcct

SEQ ID NO: 28557 - DNA, 601 bp, Human
aacatcattaccatattccacaactgttgatgagaattccaccttcaaagtcaggtgggaacagccagggcatggggccttttcaaaagatttcttttccagtctgtcgcccagatgtttcttcccacagagcaaaaccacgagcagaagcagccagatgttgacaagcttcatggtcacaagcgaatatgatcataaaattgcatatattcaaatcacacttttttcttcttgattaaaagtgaatttttgtttcagctaaaagctgcaacattactaatcagccatcttacagtcttgyccaacataaataaaagttaaatcccatggccttttgtggttcagcctgaagagaggctttcatttctttctccgcttcttctccatcttggaaataaggcttctctcactcaggccgtgacgactgagtcctgtactccatttgtaccacagaaccaacgtccaatggggttgatcaatcaaccactgtgagccaatctatgaaacaaaaaacagtgcacacagacattagtagcaaactgacatagccaggtatgatttagttgtatttataatttaagcaagtgggtcagccaggcaa

SEQ ID NO: 28558 - DNA, 601 bp, Human
gggagttcctaatacttaagacaacatcattaccatattccacaactgttgatgagaattccaccttcaaagtcaggtgggaacagccagggcatggggccttttcaaaagatttcttttccagtctgtcgcccagatgtttcttcccacagagcaaaaccacgagcagaagcagccagatgttgacaagcttcatggtcacaagcgaatatgatcataaaattgcatatattcaaatcacacttttttcttcttgattaaaagtgaatttttgtttcagctaaaagctgcaacattactratcagccatcttacagtcttgcccaacataaataaaagttaaatcccatggccttttgtggttcagcctgaagagaggctttcatttctttctccgcttcttctccatcttggaaataaggcttctctcactcaggccgtgacgactgagtcctgtactccatttgtaccacagaaccaacgtccaatggggttgatcaatcaaccactgtgagccaatctatgaaacaaaaaacagtgcacacagacattagtagcaaactgacatagccaggtatgatttagttgtatttataattta

SEQ ID NO: 28559 - DNA, 601 bp, Human
tagctaattttatattaagtaagctttaaaaaaataggatgggagttcctaatacttaagacaacatcattaccatattccacaactgttgatgagaattccaccttcaaagtcaggtgggaacagccagggcatggggccttttcaaaagatttcttttccagtctgtcgcccagatgtttcttcccacagagcaaaaccacgagcagaagcagccagatgttgacaagcttcatggtcacaagcgaatatgatcataaaattgcatatattcaaatcacacttttttcttcttgattawaagtgaatttttgtttcagctaaaagctgcaacattactaatcagccatcttacagtcttgcccaacataaataaaagttaaatcccatggccttttgtggttcagcctgaagagaggctttcatttctttctccgcttcttctccatcttggaaataaggcttctctcactcaggccgtgacgactgagtcctgtactccatttgtaccacagaaccaacgtccaatggggttgatcaatcaaccactgtgagccaatctatgaaacaaaaaacagtgcacacagacattagtagcaaa

SEQ ID NO: 28560 - DNA, 601 bp, Human
agaaaaagaaaagaaggtgtaggtaaataattcatgtcaatttccttttatcatataagcttactctactgggaaaacaaacttaagcaaagttaacattcatgtgctgtgcactcaacccattggaaatttactacagaaggccaggcacggtggctcatgcctgtaatcccagcactttgggaggccaaggagggtgatcacttgaggtcaggagttcaagaccagcctggctaacatgctgaaaccccgtctctactaaaaatacaaaaaaaaaaaaaaaaaaaggcctggcacgatrgttcatgcctgtagtcccaacactctgggaggccaaggcaggcggatcacgaggtcaggagctcgagaccagcctggccaatgtggtgaaaccccatctctactaaaaatagaaaaaattaactgggagttgtggcgggtgcctgtagtcccagctgctcaggaggctgaggcaggagaactgcttgaacctgggaggtggaagttgcagtgaaccgagatcgtgccattgcactccagcctcagcaacagagtgagactccatctcaaaaacaaaacaaaacaaaacagaacaaatcaa

SEQ ID NO: 28561 - DNA, 601 bp, Human
actctgtctccaaaagaaaaagaaaagaaggtgtaggtaaataattcatgtcaatttccttttatcatataagcttactctactgggaaaacaaacttaagcaaagttaacattcatgtgctgtgcactcaacccattggaaatttactacagaaggccaggcacggtggctcatgcctgtaatcccagcactttgggaggccaaggagggtgatcacttgaggtcaggagttcaagaccagcctggctaacatgctgaaaccccgtctctactaaaaatacaaaaaaaaaaaaaaaaaaaggcctggcacgatagttcatgcctgtagtcccaacactctgggaggccaaggcaggcggatcacgaggtcaggagctcgagaccagcctggccaatgtggtgaaaccccatctctactaaaaatagaaaaaattaactgggagttgtggcgggtgcctgtagtcccagctgctcaggaggctgaggcaggagaactgcttgaacctgggaggtggaagttgcagtgaaccgagatcgtgccattgcactccagcctcagcaacagagtgagactccatctcaaaaacaaaacaaaacaaa

SEQ ID NO: 28562 - DNA, 601 bp, Human
aaaagaaaaaacaaaaataaaaaaattagctgggcacggtggcaggtgcctgtagtcccagctactcaggaggctgaagtgggagaccacttgtgcctgggaggccaaggctgcaatgagctgagatggcaccactgcactccagcctgggcgacaagagcaaaactctgtctccaaaagaaaaagaaaagaaggtgtaggtaaataattcatgtcaatttccttttatcatataagcttactctactgggaaaacaaacttaagcaaagttaacattcatgtgctgtgcactcaacccaytggaaatttactacagaaggccaggcacggtggctcatgcctgtaatcccagcactttgggaggccaaggagggtgatcacttgaggtcaggagttcaagaccagcctggctaacatgctgaaaccccgtctctactaaaaatacaaaaaaaaaaaaaaaaaaaggcctggcacgatagttcatgcctgtagtcccaacactctgggaggccaaggcaggcggatcacgaggtcaggagctcgagaccagcctggccaatgtggtgaaaccccatctctactaaaaatagaaaaaattaa

SEQ ID NO: 28563 - DNA, 601 bp, Human
ctgggaggctaaggcaggagaatcacttgaacctgggaggcggagattgcagtaagcagagattgcaccactgcactcctgcctggtgacagagcaagcctccgtctcaaaaaaaaaaaaaaaaagatctctatgaatcacctaaccacaaagaatacatcattcgaaaccagatacccgtgatatttttttaaaaagcaaatacctacagaagtttgaatacacaacaaagaaatgtatataatttttatcaagtaggaaaaagaaattcagagaactgaatgctcagttagtgtttctyaaaacgaaaacagtaacaaaattccagagtggattatgtgagactatttgctcagttcttcacatctggtcactcaaactttagaacataaacattctgcacctcccagctccccaccttcaccaattacaatggcacctgttccaaagaatcaaggtgtaggctgggcacagtggctcatgcctataatcccagcattctgggaggtcgaagtggatggattgcttgagctcaggagtttaagaccagcctgggcaacatggtgaaacaaaaaataaaaaaattagctgggcaggccgg

SEQ ID NO: 28564 - DNA, 601 bp, Human
gcaggcagatcacctgaggtcaggagttcaagaccagcctgaccaatatggagaaaccctgtctctactaaaaatacaaaattagccaggcatggtggcgcatgcctgtaatcccagctacttgggaggctaaggcaggagaatcacttgaacctgggtggaggttgaggtgagccaagatcgcgccactgcactccagcctgggcaacaagagcgaaactccgtctcaaaaaaataaataaataaaaaggaaaagaaaaaataaaacacacactgagagaagcgaaatgcaaggaagaarcagacacaaggacgcgtctttcagcacgagaaggcggccgcagccttgaagtctgaaggctttgagatgaagctggcgaaaatcgcttccaacagaaacaaagatcactaccatctactactgcaaaccctcagattttcttctaccagaacagtacgaagtctctttttaaaaaataattctgcccccccaacaccgaccctgcgcactaaacaaaactaaactaaaaaattcctaccaggaaaatgttcacaattagcaaactagatggaaggatgcggatactcactgtactatttt

SEQ ID NO: 28565 - DNA, 601 bp, Human
ctgatgcatgaccattcctggtcaggaggctttgacaaaaacaaaacgaaaccccaggaaaacatgttttgcaagagtgcctttaaaaatcgggctgggtgcagtgactcacgcctgtaatcccagcactttgggaggctgaggcaggcagatcacctgaggtcaggagttcaagaccagcctgaccaatatggagaaaccctgtctctactaaaaatacaaaattagccaggcatggtggcgcatgcctgtaatcccagctacttgggaggctaaggcaggagaatcacttgaacctggatggaggttgaggtgagccaagatcgcgccactgcactccagcctgggcaacaagagcgaaactccgtctcaaaaaaataaataaataaaaaggaaaagaaaaaataaaacacacactgagagaagcgaaatgcaaggaagaagcagacacaaggacgcgtctttcagcacgagaaggcggccgcagccttgaagtctgaaggctttgagatgaagctggcgaaaatcgcttccaacagaaacaaagatcactaccatctactactgcaaaccctcagattttcttctaccagaacagtac

SEQ ID NO: 28566 - DNA, 601 bp, Human
gtaatgaagtaggaaagactaagccctggagaagaaaaggaaaagccaagttgcttccatgctcacacctgcacagctgatgacttcaacgaacccagctgatgcatgaccattcctggtcaggaggctttgacaaaaacaaaacgaaaccccaggaaaacatgttttgcaagagtgcctttaaaaatcgggctgggtgcagtgactcacgcctgtaatcccagcactttgggaggctgaggcaggcagatcacctgaggtcaggagttcaagaccagcctgaccaatatggagaaacccygtctctactaaaaatacaaaattagccaggcatggtggcgcatgcctgtaatcccagctacttgggaggctaaggcaggagaatcacttgaacctgggtggaggttgaggtgagccaagatcgcgccactgcactccagcctgggcaacaagagcgaaactccgtctcaaaaaaataaataaataaaaaggaaaagaaaaaataaaacacacactgagagaagcgaaatgcaaggaagaagcagacacaaggacgcgtctttcagcacgagaaggcggccgcagccttgaagtctgaagg

SEQ ID NO: 28567 - DNA, 601 bp, Human
aaaacccttttcctttggtaacacatatctttggaaaatatcatttaataaatatgcaatttactatttgagactaaactctattttgacaagcccaattgtaatgaagtaggaaagactaagccctggagaagaaaaggaaaagccaagttgcttccatgctcacacctgcacagctgatgacttcaacgaacccagctgatgcatgaccattcctggtcaggaggctttgacaaaaacaaaacgaaaccccaggaaaacatgttttgcaagagtgcctttaaaaatcgggctgggtgcrgtgactcacgcctgtaatcccagcactttgggaggctgaggcaggcagatcacctgaggtcaggagttcaagaccagcctgaccaatatggagaaaccctgtctctactaaaaatacaaaattagccaggcatggtggcgcatgcctgtaatcccagctacttgggaggctaaggcaggagaatcacttgaacctgggtggaggttgaggtgagccaagatcgcgccactgcactccagcctgggcaacaagagcgaaactccgtctcaaaaaaataaataaataaaaaggaaaagaaaa

SEQ ID NO: 28568 - DNA, 601 bp, Human
aagaaatgatcgtaaataataacagaactagaaatttgttaacctgatttaagataaacagggaaaaaaaacccttttcctttggtaacacatatctttggaaaatatcatttaataaatatgcaatttactatttgagactaaactctattttgacaagcccaattgtaatgaagtaggaaagactaagccctggagaagaaaaggaaaagccaagttgcttccatgctcacacctgcacagctgatgacttcaacgaacccagctgatgcatgaccattcctggtcaggaggctttgasaaaaacaaaacgaaaccccaggaaaacatgttttgcaagagtgcctttaaaaatcgggctgggtgcagtgactcacgcctgtaatcccagcactttgggaggctgaggcaggcagatcacctgaggtcaggagttcaagaccagcctgaccaatatggagaaaccctgtctctactaaaaatacaaaattagccaggcatggtggcgcatgcctgtaatcccagctacttgggaggctaaggcaggagaatcacttgaacctgggtggaggttgaggtgagccaagatcgcgccactgca

SEQ ID NO: 28569 - DNA, 601 bp, Human
gatagacaaagaagagtaaaattttaatttcttcttccttctgatgaaagaaatgatcgtaaataataacagaactagaaatttgttaacctgatttaagataaacagggaaaaaaaacccttttcctttggtaacacatatctttggaaaatatcatttaataaatatgcaatttactatttgagactaaactctattttgacaagcccaattgtaatgaagtaggaaagactaagccctggagaagaaaaggaaaagccaagttgcttccatgctcacacctgcacagctgatgacttmaacgaacccagctgatgcatgaccattcctggtcaggaggctttgacaaaaacaaaacgaaaccccaggaaaacatgttttgcaagagtgcctttaaaaatcgggctgggtgcagtgactcacgcctgtaatcccagcactttgggaggctgaggcaggcagatcacctgaggtcaggagttcaagaccagcctgaccaatatggagaaaccctgtctctactaaaaatacaaaattagccaggcatggtggcgcatgcctgtaatcccagctacttgggaggctaaggcaggagaatca

SEQ ID NO: 28570 - DNA, 601 bp, Human
ttacacctggttttactatgaaaattaaacttctcttcgtgtgtgtgtgtgtgtgtgtgtgtgtgtgtgtgtttgtgtgtgtgtttaatgcagcaaaacctcagaggctcttaggcctaaaatatgatagacaaagaagagtaaaattttaatttcttcttccttctgatgaaagaaatgatcgtaaataataacagaactagaaatttgttaacctgatttaagataaacagggaaaaaaaacccttttcctttggtaacacatatctttggaaaatatcatttaataaatatgcaattyactatttgagactaaactctattttgacaagcccaattgtaatgaagtaggaaagactaagccctggagaagaaaaggaaaagccaagttgcttccatgctcacacctgcacagctgatgacttcaacgaacccagctgatgcatgaccattcctggtcaggaggctttgacaaaaacaaaacgaaaccccaggaaaacatgttttgcaagagtgcctttaaaaatcgggctgggtgcagtgactcacgcctgtaatcccagcactttgggaggctgaggcaggcagatcacctgaggtc

SEQ ID NO: 28571 - DNA, 601 bp, Human
tatctgtaagtctctttatttttaaaaagcggaggaaaaaggcagtaccacagaaatggcctaagggttttccctttacctttcaaagaccatgttataatgaacaagtcatatttcaaatcagttttaagaagagaaaatctgtaataccaatacagttctctttctaaagcaaatcactgtcatttttattctagccttaccaacctacacccatgttaagtacagggacctggaaacacatacagtcacgtcaattctggtaagtaaatatttgcacagtccaactgaaacggttctkaattgaaattcctctgctgagtctgatctttaagtcaacagcatgggacaatgctgcaggtgctgactgaagagcaacactgagaccaggaatgggcctgctctgcttgaccctgcacaggccagactccacctccagtattatactcagttcagggcttcacagctttcaaacaatttagaaaaattagtacattcaaaggaaaacacttaaaatgatgaggggacttgaaatcaagtcacctgagtaactatggcaagaactgaggattagcctggagagaaaaaattgccaaaaggg

SEQ ID NO: 28572 - DNA, 601 bp, Human
aattattccatatcttgattttgttggtggatatttgatggtatacttttgccaaaacttgccaaactatactctaaaaaggacgaattttactatctgtaagtctctttatttttaaaaagcggaggaaaaaggcagtaccacagaaatggcctaagggttttccctttacctttcaaagaccatgttataatgaacaagtcatatttcaaatcagttttaagaagagaaaatctgtaataccaatacagttctctttctaaagcaaatcactgtcatttttattctagccttaccaacstacacccatgttaagtacagggacctggaaacacatacagtcacgtcaattctggtaagtaaatatttgcacagtccaactgaaacggttcttaattgaaattcctctgctgagtctgatctttaagtcaacagcatgggacaatgctgcaggtgctgactgaagagcaacactgagaccaggaatgggcctgctctgcttgaccctgcacaggccagactccacctccagtattatactcagttcagggcttcacagctttcaaacaatttagaaaaattagtacattcaaaggaaaac

SEQ ID NO: 28573 - DNA, 601 bp, Human
aaatatcaacaggacttaaaacaactgtatattgctcaatattctcaatattcttatctgctagaatttcacctttcaaaaacaaaaggactacacaggagtgagagacagggaatttctgagggtgatggaattattccatatcttgattttgttggtggatatttgatggtatacttttgccaaaacttgccaaactatactctaaaaaggacgaattttactatctgtaagtctctttatttttaaaaagcggaggaaaaaggcagtaccacagaaatggcctaagggttttcccttwacctttcaaagaccatgttataatgaacaagtcatatttcaaatcagttttaagaagagaaaatctgtaataccaatacagttctctttctaaagcaaatcactgtcatttttattctagccttaccaacctacacccatgttaagtacagggacctggaaacacatacagtcacgtcaattctggtaagtaaatatttgcacagtccaactgaaacggttcttaattgaaattcctctgctgagtctgatctttaagtcaacagcatgggacaatgctgcaggtgctgactgaagagca

SEQ ID NO: 28574 - DNA, 601 bp, Human
aagggaaaaatccttattgttctgaattttatttcacaggacatgatcattaacactgcttcctgttctgaaacaaatcatcagcaggtgtgatagtcaattacttagtcactctgcattcaggacaccaaactcaagtgataaactaatttccgtggaattgcccagatcagggaccatctttccccaagaagtgacagacttctgcaggcctgtcggtcagcgccagtggccggcagcgctgtgctcgtttgtgtatgtgtcaataggagagaagtgctccacagccttcccttctaayctcagaaatggtaacaaaaataagacacaaatggtgacaattaggaaagccacagaaacagatgcctggcatcacaggagtcaaagatgaggagtacttggctacctccagctaaacaaatagtaagaaggttagatgtggaaggctgcagggctttagcactaggcagtcccgaacatggaattcctgcatgtctggactttccgcgccttccctgggtaatagcacacacctgtatatcccataagcaccttccctgggtaatagcacacacctgtatatcccatctgccagagcaca

SEQ ID NO: 28575 - DNA, 601 bp, Human
tttttaaaagaccaggtacttatattttctcatatacaccaaagaaattctacgaggaggtataagaaaggaacatcatcacacaggacacacgggccagtgaggaaagaacctgctggacggggacaggggtgggggtctcactgtgttaccttctgacatttctgagctatgcattacctattcaaaaattaaccttaaaaaataaataacgaaaaaagaaacaaatactaggaccctctcccttttctatagtttccaaatgaagagtgaaggaacaaggcttgtaaactcccattamccaacacaatgccaggtgtcgggacacagaggtaaataaaacagctcaaggtggtaggaacccaatcagggaggcaagcacacttattctatctgcaattgttctgttctatcatgcagacaaccgacccagggtacagaggcctggggaagcctggaggtagagaagaaacaagggaaatcaaagaatcgtcgtaagtagtagcctcggcagggtcttcagggttcaacttaggtcgacacagtggttggtgggagaagggcggagccacccaggaggcagaggaacagtaaactgagc

SEQ ID NO: 28576 - DNA, 601 bp, Human
ttagctgttaattcccacacctacaaaaggagcatttatttaatgaaagtatccctttcattaaacatataactgtcaaaaaaaaaaaaaaaaccatacacaacgtctaaaaacagttctaaaaaagcagcactggcccattataaaggcggatgtgctggcaacttgcatttttagaggataccacccgggacggagaagcacgcagtgcacagagcagatgctgactttctagtcactttgaggaaaacacgaattgcatgtttaggtaagaaaaaattggcagggcatggtggctcaygcctgtaatcccagcactttgaaaggctgaggtgggtggatcacctgaggtcaggagttggagaccagcctggccaattcggtgaaaccccgtctctactaaaaatagcaaaattagccgggcatggtggtgtgcacctgtaatcccggctacttgggaggctgaggcaggagaaccgcttgaacctgggaggcggaggttgcagtgagccaagactgtgccattgtactccagcctggccaacaagaacaaaactccatctcaaaaaaaaaaaaaaaaaaaaatcagcaaggcaccatg

SEQ ID NO: 28577 - DNA, 601 bp, Human
atagcagaaaccatgattacattgttagctgttaattcccacacctacaaaaggagcatttatttaatgaaagtatccctttcattaaacatataactgtcaaaaaaaaaaaaaaaaccatacacaacgtctaaaaacagttctaaaaaagcagcactggcccattataaaggcggatgtgctggcaacttgcatttttagaggataccacccgggacggagaagcacgcagtgcacagagcagatgctgactttctagtcactttgaggaaaacacgaattgcatgtttaggtaagaaaraattggcagggcatggtggctcacgcctgtaatcccagcactttgaaaggctgaggtgggtggatcacctgaggtcaggagttggagaccagcctggccaattcggtgaaaccccgtctctactaaaaatagcaaaattagccgggcatggtggtgtgcacctgtaatcccggctacttgggaggctgaggcaggagaaccgcttgaacctgggaggcggaggttgcagtgagccaagactgtgccattgtactccagcctggccaacaagaacaaaactccatctcaaaaaaaaaaaaa

SEQ ID NO: 28578 - DNA, 601 bp, Human
caaaatccagaaccctggacctctaacaaggttcacgatcatttactcaactattaggctagagtcctatgaatgccaatattcacgttttctgatatgcaaacatgaacttcacatagcttcaccttgtcttatgccctggatttgtgtaaagcatcctacagaaacttcgagcacaagaaatgacttataaacattatctagagaataaaatgaagctgctggtggaaagaaaactgagacctctaaccagacaggagcgtactggctgggattcagtggcaaatgtttcgcatctcaygctgcttaagtttagcacaaaggcccccctgtgacactgtcctccctgcctccctcctaaatgatccctctcatcaactcccaaagcaccggccatgttgccgttaggcccgccagcacttcccctgtgaatgagtgtcactgtgctcgcacctgctctttcagagagaggcagaaacctcttccgtttgcctctttacccggatgctttgcacacagatctcatcaacactgcagaatccctaatagattcacttttctgattgatttttggggaaaaaaagtagttagaataaaaact

SEQ ID NO: 28579 - DNA, 601 bp, Human
cgacagcaaaatccagaaccctggacctctaacaaggttcacgatcatttactcaactattaggctagagtcctatgaatgccaatattcacgttttctgatatgcaaacatgaacttcacatagcttcaccttgtcttatgccctggatttgtgtaaagcatcctacagaaacttcgagcacaagaaatgacttataaacattatctagagaataaaatgaagctgctggtggaaagaaaactgagacctctaaccagacaggagcgtactggctgggattcagtggcaaatgtttcgcmtctcacgctgcttaagtttagcacaaaggcccccctgtgacactgtcctccctgcctccctcctaaatgatccctctcatcaactcccaaagcaccggccatgttgccgttaggcccgccagcacttcccctgtgaatgagtgtcactgtgctcgcacctgctctttcagagagaggcagaaacctcttccgtttgcctctttacccggatgctttgcacacagatctcatcaacactgcagaatccctaatagattcacttttctgattgatttttggggaaaaaaagtagttagaata

SEQ ID NO: 28580 - DNA, 601 bp, Human
tggtaagaagctacggagtgcaaccacccacaaaagccacagggtttcagaacggcagccagcgtgtgacaaaacagtccgaacagcatgcgaaagagctgggaatccagacaggtatggccaggaggatgggcagagggatggggtgcggaagacctgagagaaacagaaggaggacactcattccaggaaggtgtacatggggaagtggaagatcaaggtgaactgagattgtggctggagttggccaactacggcccatgggccaaaccaggcccacacctgtttttgcaaatacagygttcctggaacacagtcatgttcatttacacatatatcacccgcagctgctttcacacaataacgcctaaaatatttattatctgaccctttacagaaaaagtttgcaattcagcctagaatactgaagaccttgaaaaacaaaagaaaaatgtggatttcatctattaggcaataataaactgctgcagattcttgattagaaaactgctacaatatatgtttgaacagtagaaatacgcacaaaaaagaaaaagagcagcttccattcaaagagcatcatcagcattcatggtgctct

SEQ ID NO: 28581 - DNA, 601 bp, Human
tattttgaatttgtccagctaaatacaattgtttctgtgttagcagagttgatattaagctgttctcaatggtttctccaacttcttaaggctcccctcccccaaaaaatatcatctcacctaccactgaggaggactgcttaccactactagatagggtaaacgggcaggaccccaattcacctaaaggtgagttcctcagaaatcaattaataagttaaactgggaaacaccgcttagaatcagccggtgctcatcacagcagctgtggacttgccagagtgaagtggcagatgctgayggggcccagatctctcgtcctcacggctgggcaggcactcacagccccggctattcccatgtgaatgtgagggtgtctgtgcacttacaaatacaccccaaggctcgtcaacaaccggtgccactagccacagtagtttgtccagctaaatacaattatttagcaaagaagagcgtacccaggtagtcattccccttgaagaaaagcgggcgatgttatcttcaaagtcaatgccgcctactccaatcacatccatttgatcagcagggttattcagagtgctatattgagaccaaaaaa

SEQ ID NO: 28582 - DNA, 601 bp, Human
aggtaaaggtgggtgaatgtgctgcataattaaaccccaaacagctgaattattaactgtagcagttattttgaatttgtccagctaaatacaattgtttctgtgttagcagagttgatattaagctgttctcaatggtttctccaacttcttaaggctcccctcccccaaaaaatatcatctcacctaccactgaggaggactgcttaccactactagatagggtaaacgggcaggaccccaattcacctaaaggtgagttcctcagaaatcaattaataagttaaactgggaaacaccrcttagaatcagccggtgctcatcacagcagctgtggacttgccagagtgaagtggcagatgctgacggggcccagatctctcgtcctcacggctgggcaggcactcacagccccggctattcccatgtgaatgtgagggtgtctgtgcacttacaaatacaccccaaggctcgtcaacaaccggtgccactagccacagtagtttgtccagctaaatacaattatttagcaaagaagagcgtacccaggtagtcattccccttgaagaaaagcgggcgatgttatcttcaaagtcaatgc

SEQ ID NO: 28583 - DNA, 601 bp, Human
cgagggcaaaggtgcccaactgctgttctgcacgagcgtctaatttttcatcaaactttgacaggtaaaggtgggtgaatgtgctgcataattaaaccccaaacagctgaattattaactgtagcagttattttgaatttgtccagctaaatacaattgtttctgtgttagcagagttgatattaagctgttctcaatggtttctccaacttcttaaggctcccctcccccaaaaaatatcatctcacctaccactgaggaggactgcttaccactactagatagggtaaacgggcaggamcccaattcacctaaaggtgagttcctcagaaatcaattaataagttaaactgggaaacaccgcttagaatcagccggtgctcatcacagcagctgtggacttgccagagtgaagtggcagatgctgacggggcccagatctctcgtcctcacggctgggcaggcactcacagccccggctattcccatgtgaatgtgagggtgtctgtgcacttacaaatacaccccaaggctcgtcaacaaccggtgccactagccacagtagtttgtccagctaaatacaattatttagcaaagaaga

SEQ ID NO: 28584 - DNA, 601 bp, Human
aggcagttgggaatctttccagggacttatctgaggcctccgagtgtggcatgtgacgttaaacaccaagagatgctctgaccctgaagaatgagaagggcagatgctcccctcggccacagcgagggcaaaggtgcccaactgctgttctgcacgagcgtctaatttttcatcaaactttgacaggtaaaggtgggtgaatgtgctgcataattaaaccccaaacagctgaattattaactgtagcagttattttgaatttgtccagctaaatacaattgtttctgtgttagcagagttkatattaagctgttctcaatggtttctccaacttcttaaggctcccctcccccaaaaaatatcatctcacctaccactgaggaggactgcttaccactactagatagggtaaacgggcaggaccccaattcacctaaaggtgagttcctcagaaatcaattaataagttaaactgggaaacaccgcttagaatcagccggtgctcatcacagcagctgtggacttgccagagtgaagtggcagatgctgacggggcccagatctctcgtcctcacggctgggcaggcactcacagccccgg

SEQ ID NO: 28585 - DNA, 601 bp, Human
tctgaccatcaaacccaaggaccatggatgcacatactgggataccgagtaaaggcatcctccactgcagctgtgatgatggaaggacatttctcaaatgccattaaaaagctggctggtgatgaaggccatggacgtgacatctcatcacggtttggtgaaagcgtttacacggggagctggggacaaagtggatgacatctcaccacagttcggtgagagcatttacacagggagctggggacaaagtggtggatgcagtttcccattatccggcagcacaaggaacatgctgagggarcgtggatgggaggacacgcagcctgccctgcacagactgtcacatgagagaatggtccccagccaacaggtcagctccaggaagaggcacgtgagtgtgggaggcggggacccctggtggggctgagtggcggggacgctgggggctgacgctgtcacaggacaaaggctcaggcagaaggctatcctgtaaagtggctacagtgtggacgaggcccacagtgttcccaggcagttgggaatctttccagggacttatctgaggcctccgagtgtggcatgtgacgttaaacaccaagag

SEQ ID NO: 28586 - DNA, 601 bp, Human
tgtttcaaacggttgtaaaagaggaaataagaaaccactgagaaggaacaagataaccacacgactaacttgggataacgttttaataagtacttgcttaagcttcttaagaattggggcaaaacgaaaattagaataggatctcatattctgtcagaaaacaggagcccaatttgaagggaagcccttttctgaccatcaaacccaaggaccatggatgcacatactgggataccgagtaaaggcatcctccactgcagctgtgatgatggaaggacatttctcaaatgccattaaaaasctggctggtgatgaaggccatggacgtgacatctcatcacggtttggtgaaagcgtttacacggggagctggggacaaagtggatgacatctcaccacagttcggtgagagcatttacacagggagctggggacaaagtggtggatgcagtttcccattatccggcagcacaaggaacatgctgagggagcgtggatgggaggacacgcagcctgccctgcacagactgtcacatgagagaatggtccccagccaacaggtcagctccaggaagaggcacgtgagtgtgggaggcgggga

SEQ ID NO: 28587 - DNA, 601 bp, Human
attacaggtgtgagccaccgcacccggcctccttgagaactttcttccagtttcattatctgcaagattaagggccagtcactaagctccattccaactgcatgagattcagtgagacaaagcagagtggtgactgtcagtccctggtggctctgacatcctttgctatagagaacattaaaaggtgagtccccttcacaaaaacaacaaatgggtaacactgtgagaagatggatgtgttcattcgtttcactagagtaacctcctttttactatctatatgtattccataacatcatgytgtatatcttacatatacgcagtaggatttgttttttgtttttcttttttaaagtgaatccccaaggaaatggaggatatatggcagggaaatatcttactatttgttccctgcctgatatttatgcttgcttggatataaaaatcacagttctagcacataaatgggatattagaaaacagaacacaaacataaagaaacaggttattttgcctatcagcactttgtttacttaggcttataaagtgtgttcacattcacttcatctaactataaaagaagtgactcctacctctttgc

SEQ ID NO: 28588 - DNA, 601 bp, Human
gaaagagatggatatctaccccttttttttttttggtagagatggggtctcactatgttgccccagctgctctcaaactactagcctcaaacaatcctcctgccttggcctcccaaagtgctgggattacaggtgtgagctaccacaaccagccaagtatctagctttattaaggattactaacaaaataatatctggcatcagaagctgaaatcaatattcaatttacttaaagagaacttaaaatataaagacatttaatactatttgcctatattaattaatttttaaattagcataraataacttccaaatacgcagagttttgtgtgttatcacaacactcaactaaaacttcatctagatagaagaagtacaatttatttttggggaaaatacagtaacaagataaatgccagccccaaagacatccttttacaactgagagtaaagaaacacgggccaccgatgaaagtgagaacatgtgaacatcaactctggtctactcgcttggagaactttattgattgattggctgattgagacagagtgttgctctgtcacccaggctggagtgcagtggcacgatctcagttcactg

SEQ ID NO: 28589 - DNA, 601 bp, Human
aagaatggaaattggaccactaaaacctaacctacaaacgtgcacacaagaggcctgcagtcttgtttagtatccaacaggtgcttgtctggcacagcctgcatgagagaatgagtgcacactcatctctgtacccaatccaggactgaccactccgcaaccttctacgggacccacttatgctaaatgcatcagtaacacatatttttgtgataattcaactaaacaaccacataggctgcagaaggcatgaatgtataggaggtactgactcctctggggagaggaagcctgctggtcrcaggaagaagatgccatgggacaccgcctggctgggagaaggaggagcacattcagatcctggggaggggccacgacacaggactagcaggaggcacaggtctgagtgaggaccgccgcctccaaagccaatccttgcctttttgtttccagattgggaggcttgtctgggatgagccaccctgatggatgatgcctttcagaacgacatagacctaaggccaccttcagtttcaccatgagaatgcatctgaacaagctttaacacacagtgtgacctggctaggaacttagcctggtg

SEQ ID NO: 28590 - DNA, 601 bp, Human
tctgccagcagcaccctgtagaagcagcagcaaaacctctccaagcaccccgagaattctgtgcttagtcatcattttctgttttgaggcttgtattttgtgcagagggaaaattcgcccagagcccagtgaaggagagaaagacccatcggcagggcggtgcactgaccttgcctgtggcttgtagctgttgaggatctgataggctctaagcagatcgagcttgccgtggccttgctcaaacatgttgaccccggggagcctccgggctgacgcgatcagggcctgcttcatactggcrggattcaccagctcacgcttctggactgtgctggaggaaaaatcaagaattgcctattttctctcagtaaaagaatggaaattggaccactaaaacctaacctacaaacgtgcacacaagaggcctgcagtcttgtttagtatccaacaggtgcttgtctggcacagcctgcatgagagaatgagtgcacactcatctctgtacccaatccaggactgaccactccgcaaccttctacgggacccacttatgctaaatgcatcagtaacacatatttttgtgataattcaactaaacaac

SEQ ID NO: 28591 - DNA, 601 bp, Human
aaacaacaaaagcaaaaaaaccactcagaaatcattacttttaaccatttatattaaagatcacatcagtaagcgaaagcagctaccagttctgccagcagcaccctgtagaagcagcagcaaaacctctccaagcaccccgagaattctgtgcttagtcatcattttctgttttgaggcttgtattttgtgcagagggaaaattcgcccagagcccagtgaaggagagaaagacccatcggcagggcggtgcactgaccttgcctgtggcttgtagctgttgaggatctgataggctctragcagatcgagcttgccgtggccttgctcaaacatgttgaccccggggagcctccgggctgacgcgatcagggcctgcttcatactggcgggattcaccagctcacgcttctggactgtgctggaggaaaaatcaagaattgcctattttctctcagtaaaagaatggaaattggaccactaaaacctaacctacaaacgtgcacacaagaggcctgcagtcttgtttagtatccaacaggtgcttgtctggcacagcctgcatgagagaatgagtgcacactcatctctgtacccaatc

SEQ ID NO: 28592 - DNA, 601 bp, Human
ccactcatctgaaatggtggcatcaggggaaactgggcaaccttgtaggacaactctctcctatttctgcaaaatttctgtaaacctaagattatttcaagagtctaagaaagtaaacaacaaaagcaaaaaaaccactcagaaatcattacttttaaccatttatattaaagatcacatcagtaagcgaaagcagctaccagttctgccagcagcaccctgtagaagcagcagcaaaacctctccaagcaccccgagaattctgtgcttagtcatcattttctgttttgaggcttgtatyttgtgcagagggaaaattcgcccagagcccagtgaaggagagaaagacccatcggcagggcggtgcactgaccttgcctgtggcttgtagctgttgaggatctgataggctctaagcagatcgagcttgccgtggccttgctcaaacatgttgaccccggggagcctccgggctgacgcgatcagggcctgcttcatactggcgggattcaccagctcacgcttctggactgtgctggaggaaaaatcaagaattgcctattttctctcagtaaaagaatggaaattggaccactaaaac

SEQ ID NO: 28593 - DNA, 601 bp, Human
tagaggaaaccaagaagacaggacaatgaaatccaatgtgggatcctggactggatcccagagaagggacctgtgggacaatgggcggaatctgcgtgaagcctgcaggtcagtcagcagtgctacatcaaggttcatttccagactctgacgctcatactgaggttatggaagatactaaggtgagggaaagctgggtgaaggactcaggggttctcatgaactatttgtgaaactttgctgtaaatctaaaatcatttcaaaataagggtgaaaacaaagcagggcccaggccggacgsgagtaccacaggagctggcgagatgtatgtggtctgcaggtgaattacagcacagtgtcagtgtttgtatgacagttttaacagctgtactccactcatctgaaatggtggcatcaggggaaactgggcaaccttgtaggacaactctctcctatttctgcaaaatttctgtaaacctaagattatttcaagagtctaagaaagtaaacaacaaaagcaaaaaaaccactcagaaatcattacttttaaccatttatattaaagatcacatcagtaagcgaaagcagctaccagttctgc

SEQ ID NO: 28594 - DNA, 601 bp, Human
gtgtgtctgtgcacgtgtccacacgttgcctagctctgtccgaagagcgcagtaaccactgtgagcacagcagcttggagcaccccgagtgcccaggtcttgatttctttagaagaggccatcagcaaagagctgcttggagacagaactgataccaaggctagagcacagaggtgcatgacaggacatcctgtgctgccaggaagacagaaagtgctcagaaaaggctggacacatgctgaaaacacacataagccaactagatggagctcccaacagccaactcggggacaatttgaaygacccactaaatgatattaattataatccacagagtaaaataaatatctatgtgtccacactgatgtaaagaactgaataaataaatgggacagaaaggacagctcttccttccaggagagttccaattaatcaatgtaaatggaatgaaggaaaaagaaaatcatcacgtgtcaaagttgtcaggagtaatcaccaaaggcaagaaccatcaaggcatgctaacatgagtgagtggaagtatgtgacgaaacaaggccatctcgaaacatgcccccacaagacactgagaagtcacaaa

SEQ ID NO: 28595 - DNA, 601 bp, Human
gctgctcagtacgtatacactacaactaagcaaataagccaacatattgtggataatgagagccaggcttctcactgttggagaatggagttagaaacagaggtaacatgaccatctctgtaaataagaaataaataaataaatagaaacaaggatagggaaaggctggaatgaacactgagatactggctggaacctggaggtggcatgaactcatgtttccagtacatacacagataggcagatacagaagcaggcgtgtgtgtctgtgcacgtgtccacacgttgcctagctctgtcsgaagagcgcagtaaccactgtgagcacagcagcttggagcaccccgagtgcccaggtcttgatttctttagaagaggccatcagcaaagagctgcttggagacagaactgataccaaggctagagcacagaggtgcatgacaggacatcctgtgctgccaggaagacagaaagtgctcagaaaaggctggacacatgctgaaaacacacataagccaactagatggagctcccaacagccaactcggggacaatttgaacgacccactaaatgatattaattataatccacagagtaaaa

SEQ ID NO: 28596 - DNA, 601 bp, Human
attcaaaaaactcacaaggacatgggctagcagttccaaagctgctcagtacgtatacactacaactaagcaaataagccaacatattgtggataatgagagccaggcttctcactgttggagaatggagttagaaacagaggtaacatgaccatctctgtaaataagaaataaataaataaatagaaacaaggatagggaaaggctggaatgaacactgagatactggctggaacctggaggtggcatgaactcatgtttccagtacatacacagataggcagatacagaagcaggcgtrtgtgtctgtgcacgtgtccacacgttgcctagctctgtccgaagagcgcagtaaccactgtgagcacagcagcttggagcaccccgagtgcccaggtcttgatttctttagaagaggccatcagcaaagagctgcttggagacagaactgataccaaggctagagcacagaggtgcatgacaggacatcctgtgctgccaggaagacagaaagtgctcagaaaaggctggacacatgctgaaaacacacataagccaactagatggagctcccaacagccaactcggggacaatttgaac

SEQ ID NO: 28597 - DNA, 601 bp, Human
atattcaaaaaactcacaaggacatgggctagcagttccaaagctgctcagtacgtatacactacaactaagcaaataagccaacatattgtggataatgagagccaggcttctcactgttggagaatggagttagaaacagaggtaacatgaccatctctgtaaataagaaataaataaataaatagaaacaaggatagggaaaggctggaatgaacactgagatactggctggaacctggaggtggcatgaactcatgtttccagtacatacacagataggcagatacagaagcaggcrtgtgtgtctgtgcacgtgtccacacgttgcctagctctgtccgaagagcgcagtaaccactgtgagcacagcagcttggagcaccccgagtgcccaggtcttgatttctttagaagaggccatcagcaaagagctgcttggagacagaactgataccaaggctagagcacagaggtgcatgacaggacatcctgtgctgccaggaagacagaaagtgctcagaaaaggctggacacatgctgaaaacacacataagccaactagatggagctcccaacagccaactcggggacaatttga

SEQ ID NO: 28598 - DNA, 601 bp, Human
taaatgagtccaactgtattaaaaagacaccaaggaaagaattaacctaagtaactgaaaaaaacactataactgtattctgtagggccaaagataatgacgcactgtcacaaatactatattcaaaaaactcacaaggacatgggctagcagttccaaagctgctcagtacgtatacactacaactaagcaaataagccaacatattgtggataatgagagccaggcttctcactgttggagaatggagttagaaacagaggtaacatgaccatctctgtaaataagaaataaataaatwaatagaaacaaggatagggaaaggctggaatgaacactgagatactggctggaacctggaggtggcatgaactcatgtttccagtacatacacagataggcagatacagaagcaggcgtgtgtgtctgtgcacgtgtccacacgttgcctagctctgtccgaagagcgcagtaaccactgtgagcacagcagcttggagcaccccgagtgcccaggtcttgatttctttagaagaggccatcagcaaagagctgcttggagacagaactgataccaaggctagagcacagaggtgcatga

SEQ ID NO: 28599 - DNA, 601 bp, Human
accacagtcatgtttcacacacccaataacaagttataatcaaccaggatgtgggggaaatctaaaaaggaatacaaacacgaataaatgagtccaactgtattaaaaagacaccaaggaaagaattaacctaagtaactgaaaaaaacactataactgtattctgtagggccaaagataatgacgcactgtcacaaatactatattcaaaaaactcacaaggacatgggctagcagttccaaagctgctcagtacgtatacactacaactaagcaaataagccaacatattgtggataaygagagccaggcttctcactgttggagaatggagttagaaacagaggtaacatgaccatctctgtaaataagaaataaataaataaatagaaacaaggatagggaaaggctggaatgaacactgagatactggctggaacctggaggtggcatgaactcatgtttccagtacatacacagataggcagatacagaagcaggcgtgtgtgtctgtgcacgtgtccacacgttgcctagctctgtccgaagagcgcagtaaccactgtgagcacagcagcttggagcaccccgagtgcccagg

SEQ ID NO: 28600 - DNA, 601 bp, Human
aatttaccctgaaggaacacctccaacaaaactaagacacacaggcctgaggttattcactgcaagtttataattacaaaatactggaaacaacttaaaagcccatatgtagacaagtagtggcttaaacgattgtacattcacaggatacggctgtgaaaaaggagaatctctacgcactgacgtggagagatttccaggacgttaagtgaaaaaagcagaatccaaaacaatatccacagcgatgctatccttctatgtatgtgctcatttgtggggtggtgggggcagggggaaggakaaacccaaacctgatgtcatggttacctaaggcgtgtgcggaagcctggtagaaagaatgggcgagtgggaactgacatggtttggatgctcgccccctcccaatctcacgctgacgtgtaatcccccatgttggaggtgggcctagtgggagggactgggtcctgggggagacccctcatgggtggtttagcaccatccctctggtggtaactgagttctcactcagctcaggcaagatctgggtgtttaacagtctgggacctccccgctctcttgctccctctcttgccatgtgatg

SEQ ID NO: 28601 - DNA, 601 bp, Human
tggcaaaaccctgtctctactaaaaatagaaaaattagcggggcacgggggtatgtacctgcagtccacctacttgggaggctgagacgggacagtcacctgagcccagatggcagaggttacagtgagctgagatcatgcaactacactccagcctgagccacagagcaagaccctgctgcattaaaaaagaaaaaaaaaaaaaaagagagagagagagagaaaagaaaagaaagaaagaaaagaatacccaagaaaacaccgaaaaaaaaaattacaaggggaactagcactaacagayattaaaacatgctataaagtctttataatcaaaacagtgtggtaccagtacatggacagacagaccagtggaacagaatggaaagctcagggatagacataatacatatgaaaacttagtacataataaagacagtatctcaaatcactggggcaaagatggactttttaatcacaagagctttaacaaatgggtggccatttggcaaaagaaaaaattacatccctacctccaaacaatacacaaaaattaactccaaatggatcaaggaatttcaagtaaataaaagaaagcaaacaa

SEQ ID NO: 28602 - DNA, 601 bp, Human
cggcttgagcccaggagttgaagaccagcctgggcaacatggcaaaaccctgtctctactaaaaatagaaaaattagcggggcacgggggtatgtacctgcagtccacctacttgggaggctgagacgggacagtcacctgagcccagatggcagaggttacagtgagctgagatcatgcaactacactccagcctgagccacagagcaagaccctgctgcattaaaaaagaaaaaaaaaaaaaaagagagagagagagagaaaagaaaagaaagaaagaaaagaatacccaagaaaacamcgaaaaaaaaaattacaaggggaactagcactaacagacattaaaacatgctataaagtctttataatcaaaacagtgtggtaccagtacatggacagacagaccagtggaacagaatggaaagctcagggatagacataatacatatgaaaacttagtacataataaagacagtatctcaaatcactggggcaaagatggactttttaatcacaagagctttaacaaatgggtggccatttggcaaaagaaaaaattacatccctacctccaaacaatacacaaaaattaactccaaat

SEQ ID NO: 28603 - DNA, 601 bp, Human
ctttgggaggccgaggcgggaggacggcttgagcccaggagttgaagaccagcctgggcaacatggcaaaaccctgtctctactaaaaatagaaaaattagcggggcacgggggtatgtacctgcagtccacctacttgggaggctgagacgggacagtcacctgagcccagatggcagaggttacagtgagctgagatcatgcaactacactccagcctgagccacagagcaagaccctgctgcattaaaaaagaaaaaaaaaaaaaaagagagagagagagagaaaagaaaagaaagaragaaaagaatacccaagaaaacaccgaaaaaaaaaattacaaggggaactagcactaacagacattaaaacatgctataaagtctttataatcaaaacagtgtggtaccagtacatggacagacagaccagtggaacagaatggaaagctcagggatagacataatacatatgaaaacttagtacataataaagacagtatctcaaatcactggggcaaagatggactttttaatcacaagagctttaacaaatgggtggccatttggcaaaagaaaaaattacatccctacctccaaac

SEQ ID NO: 28604 - DNA, 601 bp, Human
agacaaaataacagcattataaaaatattacttctaagttcatttaaaatttgatgcaattgcaacaaaaattccaacaagcttctttcatagaattaagtaagatgatatgaaaattcatatgaagaaaacaaacatgcaagaatagccaagaagggccgggtgaagtgactcacgcgtgtcatcccagcactttgggaggccgaggcgggaggacggcttgagcccaggagttgaagaccagcctgggcaacatggcaaaaccctgtctctactaaaaatagaaaaattagcggggcaygggggtatgtacctgcagtccacctacttgggaggctgagacgggacagtcacctgagcccagatggcagaggttacagtgagctgagatcatgcaactacactccagcctgagccacagagcaagaccctgctgcattaaaaaagaaaaaaaaaaaaaaagagagagagagagagaaaagaaaagaaagaaagaaaagaatacccaagaaaacaccgaaaaaaaaaattacaaggggaactagcactaacagacattaaaacatgctataaagtctttataatcaaaacagtgtggtac

SEQ ID NO: 28605 - DNA, 601 bp, Human
ccagtggcatttattacagattggttcaatattgggaaactcattaatatcataaaccatatatattaataggtctaaagtattcatatgattacctttctagatgctgaaaaaacatacaaaattcaatccacagtcctcatgaaaacgctcagaaaaacagcactagacagataatctaacacaataaaaaatatatacatatatatatagatatacacaccttagggataaatccagcatcttacttaacggagaaatacaagaggcatttccattaagattaggaacaacgtaaggrtagccactctctcccctgctgttcaacactgtgctagatataccagcccatgcaactagacagaaaataatcaatgaagccttaagaattggcaaggaagatgtaaaactatctttatttccatatggtaggttagtacacctggaaaaccctagagaagcaataataaaactaactcaaacaataattcagataggtagcagcatataaaattaacatatagaaataaaatcaaccagttagagaatatacaagaagagaaagccccatctacagcagcaacaaaaagattaaatactt

SEQ ID NO: 28606 - DNA, 601 bp, Human
gtgctctgtaatcagtttaattcgactactaattcaacatgatttaactaggaaaccattattagcaaacagaattcaacatcatattaagaaaacaaaatagcaagaccagtggcatttattacagattggttcaatattgggaaactcattaatatcataaaccatatatattaataggtctaaagtattcatatgattacctttctagatgctgaaaaaacatacaaaattcaatccacagtcctcatgaaaacgctcagaaaaacagcactagacagataatctaacacaataaaatatatatacatatatatatagatatacacaccttagggataaatccagcatcttacttaacggagaaatacaagaggcatttccattaagattaggaacaacgtaaggatagccactctctcccctgctgttcaacactgtgctagatataccagcccatgcaactagacagaaaataatcaatgaagccttaagaattggcaaggaagatgtaaaactatctttatttccatatggtaggttagtacacctggaaaaccctagagaagcaataataaaactaactcaaacaataattcag

SEQ ID NO: 28607 - DNA, 601 bp, Human
ggaatgctcctgcacagataaggcctctgtgccagcctgctgtctatacagacagtgtgatgtgcagggacacctctgcttttgcaagtctggagctttgggagttgtcactggcagagaatgagtacgtgaccagccctaatggaaacttggacttgagtctctagagggcttccctgggcaaaaacacgtacacatgtcaatgcagcttgctgctaggaaaggggccagctctgtgagaccctgcctggcaggagagaggggagagcttaggaagctgcgcctggatttctccaggctytctccgtgtgaggcatctttttcccttacagagccgctgtgcatccttgctgtgccactataatgaatcttagctgggagtatgaccacaggctgagtcccgtgagccctaaagcaccgagcctgggagaggtgctggggaccctgacataatttgtgtcagaagtgctgacacaagtgctctggcaattatgttggtttcatggtttccccttatctgaactgagtttgtgttgggttcacatcactcctagtgcagcagcggtgtcagctacgcccgaacaggtgaaaagacaggaac

SEQ ID NO: 28608 - DNA, 601 bp, Human
aataaagaatacagtgttagagtagatcatatgagaaaactacaatgaagcaacacaactgtacaagacagagttaacaaagcagacctagcttcagaagggcttgcttacagcgctgccctaggctggcatctgggaacttggctctggaatgctcctgcacagataaggcctctgtgccagcctgctgtctatacagacagtgtgatgtgcagggacacctctgcttttgcaagtctggagctttgggagttgtcactggcagagaatgagtacgtgaccagccctaatggaaacttgracttgagtctctagagggcttccctgggcaaaaacacgtacacatgtcaatgcagcttgctgctaggaaaggggccagctctgtgagaccctgcctggcaggagagaggggagagcttaggaagctgcgcctggatttctccaggctttctccgtgtgaggcatctttttcccttacagagccgctgtgcatccttgctgtgccactataatgaatcttagctgggagtatgaccacaggctgagtcccgtgagccctaaagcaccgagcctgggagaggtgctggggaccctgacataa

SEQ ID NO: 28609 - DNA, 601 bp, Human
gcaaaaaattagccagacgtggtggcaggcacctgtaatcccagatacctgggaggctgagccagtagaatcgcttgaacctgggaggcggaggttgcagtgagccaagatcatgccattgccctccagcctgggcaacaagagtgacactctgtctcaaaaaaaaataaagaatgaaatactacaactgggcctttaattataggcgcaaaattgtatagatgaaaaatcaaatgtaattagctgactcaggagccaaactcaagatgccaaagcaaaaaagtaaaattggtttcattamtttataccctgacttattctgtaacagacttagcatataacaaatcactacttccaatagccctggtaccctagacagggctatttcctttttttttttttcccagacaaggtcttgctctgtcatccaggctggagtgcaatggcatgatcttggctcactgcagcctcaacctcctagactcaagtgatcctcccacgtcagcctcctgtgtatctgggaccacgggcacacaccaccatccctggctaatttctttattatttgtagagacaggtctcactttgttgctcaggctgg

SEQ ID NO: 28610 - DNA, 601 bp, Human
aggaattcgagaccagcctggccaacatggtgaaaccctgtctccactaaaaatgcaaaaaattagccagacgtggtggcaggcacctgtaatcccagatacctgggaggctgagccagtagaatcgcttgaacctgggaggcggaggttgcagtgagccaagatcatgccattgccctccagcctgggcaacaagagtgacactctgtctcaaaaaaaaataaagaatgaaatactacaactgggcctttaattataggcgcaaaattgtatagatgaaaaatcaaatgtaattagctgwctcaggagccaaactcaagatgccaaagcaaaaaagtaaaattggtttcattaatttataccctgacttattctgtaacagacttagcatataacaaatcactacttccaatagccctggtaccctagacagggctatttcctttttttttttttcccagacaaggtcttgctctgtcatccaggctggagtgcaatggcatgatcttggctcactgcagcctcaacctcctagactcaagtgatcctcccacgtcagcctcctgtgtatctgggaccacgggcacacaccaccatccct

SEQ ID NO: 28611 - DNA, 601 bp, Human
ttgtgaatttttgccaagtgcacaatgataacaaaaaaaataagtattgcagataagggctggaaaagaatatttaaaaaacagtggccaagttagtatgctgaggctggaagcgagttttctatggtttttccctattttttattattgtgatagtgtctacatagttaagatttttaaaaatttacaaaacaatattaaaaaaaaaagaccgtatcttccaaacacattaaaggataaaatactggctggtgcggtggctcacacctgtaatcccaggactctgggaggctgaggtagstggatcacctgaagtcaggaattcgagaccagcctggccaacatggtgaaaccctgtctccactaaaaatgcaaaaaattagccagacgtggtggcaggcacctgtaatcccagatacctgggaggctgagccagtagaatcgcttgaacctgggaggcggaggttgcagtgagccaagatcatgccattgccctccagcctgggcaacaagagtgacactctgtctcaaaaaaaaataaagaatgaaatactacaactgggcctttaattataggcgcaaaattgtatagatgaaaaat

SEQ ID NO: 28612 - DNA, 601 bp, Human
ctataggattccattgatgtgagaagtccagaacaggcaagcccacagagacagaaagcaggctggttgccaagggctggtggaaggaagaaggagtggctgataatgggtataaggtttcttttagggaatgttcctgaaggagatgttggcacagccttctgaatatactaaaacccaccaaactgtgcgacctaaaagggtgaatttcacgatacgtggattttatctcaattttttaaaacactaatggaataaaaacactttaaaaggcaaatcaggtcaggcgcgatggctcacrcctgtaatcccagcactttgggagggcaaggcgggagggtcatgaggtgaggagatcgagaccatcctggctaacatggtgaaacccgtctctactaaaaatacaaaaaattagccgggcatggtggtgggcgcctgtagtcccagctactcgggaggctgaggcaggaaaatggcgtgaacccgggagacggagcttgcagtgagccgagatcgtgccactgcactcaagcctgggagagagcgagactccgtctcagaaaaaaaaaggcaaatcacccagtgaaggtgtggtggagcc

SEQ ID NO: 28613 - DNA, 601 bp, Human
cacctggaggaacattttgctgaacacacagcaatggtgaatttctctatgacagggcgatcatgttaggattgatagagaaaatcccaattccaggagaaaaatgggccaacgaaatcaacgtgtaactcatacaagaggaaacagaattcgtaaacacaaccaaagatacccaccccacaaagaactgaagtgcacattacacaaggcgcccgttttacccccatctaagctgaaagctgaaagatgtaccacctagaatagccaaatgcccagcaagagatgaacggagaaacgccaygtggccgacccgcccagtggagcactactccaacacaggaagcagcgcggcactgacagcactacggcgtggacaaactgtgaaaacctgaggctgagggaaggaagccgggcacaaaaggacagatgctataggattccattgatgtgagaagtccagaacaggcaagcccacagagacagaaagcaggctggttgccaagggctggtggaaggaagaaggagtggctgataatgggtataaggtttcttttagggaatgttcctgaaggagatgttggcacagccttctgaatatact

SEQ ID NO: 28614 - DNA, 601 bp, Human
ttgaggcaaactgtgttagaatttgttttaacaagattaccaaggttgccagaagaggagtggaatttagggcaacaacagcaacagcagtggcactcaggagctgctgatgtggtccaggcaagagatgacaatggcatggactagggtgggagcagggagaaggccagagatggaaggatccaggatgcagtttgagggtaagactgacagctttgctgactggcgcaatgggagaaggaaggaaaagagaacttcaagctttttactgcataatcatacttgtgaaagtttcaaaagrgaagtcaggctgccctaagtgcatggcaaaagcctgaacatctcagcgtcatcagagtccaggctccacgagaagctgagcaacatctttccaagagttgcgggaacagtggtgcctcctcccaccacggaggctggggaggtgaagtgcatcctgtgaggtgcttaccagtctaaagggtcattcttcatccttaaattatccctggggaaatagccaggtggatagcggaggttgtggtactgatcccagagaactctcttgcttcgcgggggagtaggaattatcttcaccttaatg

SEQ ID NO: 28615 - DNA, 601 bp, Human
gcacagggagagcggctatggggactgcgggggaagcagtgccagcttctgaagggctgcatgggtcacaccagggggcttggccgggtgaggaagtcagaataggcagtcactggagagcttgaggcaaactgtgttagaatttgttttaacaagattaccaaggttgccagaagaggagtggaatttagggcaacaacagcaacagcagtggcactcaggagctgctgatgtggtccaggcaagagatgacaatggcatggactagggtgggagcagggagaaggccagagatggaagsatccaggatgcagtttgagggtaagactgacagctttgctgactggcgcaatgggagaaggaaggaaaagagaacttcaagctttttactgcataatcatacttgtgaaagtttcaaaagagaagtcaggctgccctaagtgcatggcaaaagcctgaacatctcagcgtcatcagagtccaggctccacgagaagctgagcaacatctttccaagagttgcgggaacagtggtgcctcctcccaccacggaggctggggaggtgaagtgcatcctgtgaggtgcttaccagtctaaagg

SEQ ID NO: 28616 - DNA, 601 bp, Human
cacagactccaggtcctctcctgcaggccaacgggcttgccttggtctatgaacttcccaccacttcctgtctacccgtctctggtctgagcccctccaatctggctgccagagacatcttattttaaaaggcaagtctgactctgtaactatcctggtcacatctttcaatgcttccccttcccctactttcagcatggagttcaaacgtagtccaaacataaaagcagaaatgagcttggctaatgcaccaagagaaagtcagcccagctgccctgcagggaacaggcacagggagagmggctatggggactgcgggggaagcagtgccagcttctgaagggctgcatgggtcacaccagggggcttggccgggtgaggaagtcagaataggcagtcactggagagcttgaggcaaactgtgttagaatttgttttaacaagattaccaaggttgccagaagaggagtggaatttagggcaacaacagcaacagcagtggcactcaggagctgctgatgtggtccaggcaagagatgacaatggcatggactagggtgggagcagggagaaggccagagatggaaggatccaggatgca

SEQ ID NO: 28617 - DNA, 601 bp, Human
tttccatccccgtccctcccaaatgagctcactttcctatgggacactgtatacaccctctaggggtcacctcattctcacctcccagcagcacagactccaggtcctctcctgcaggccaacgggcttgccttggtctatgaacttcccaccacttcctgtctacccgtctctggtctgagcccctccaatctggctgccagagacatcttattttaaaaggcaagtctgactctgtaactatcctggtcacatctttcaatgcttccccttcccctactttcagcatggagttcaaacktagtccaaacataaaagcagaaatgagcttggctaatgcaccaagagaaagtcagcccagctgccctgcagggaacaggcacagggagagcggctatggggactgcgggggaagcagtgccagcttctgaagggctgcatgggtcacaccagggggcttggccgggtgaggaagtcagaataggcagtcactggagagcttgaggcaaactgtgttagaatttgttttaacaagattaccaaggttgccagaagaggagtggaatttagggcaacaacagcaacagcagtggcactcagg

SEQ ID NO: 28618 - DNA, 601 bp, Human
ggagtgcagggacgctggaacaagccacgcagggccacggtgctaagacagcggcacagctaactgatatcactgccactggtcaactttccatccccgtccctcccaaatgagctcactttcctatgggacactgtatacaccctctaggggtcacctcattctcacctcccagcagcacagactccaggtcctctcctgcaggccaacgggcttgccttggtctatgaacttcccaccacttcctgtctacccgtctctggtctgagcccctccaatctggctgccagagacatcttaytttaaaaggcaagtctgactctgtaactatcctggtcacatctttcaatgcttccccttcccctactttcagcatggagttcaaacgtagtccaaacataaaagcagaaatgagcttggctaatgcaccaagagaaagtcagcccagctgccctgcagggaacaggcacagggagagcggctatggggactgcgggggaagcagtgccagcttctgaagggctgcatgggtcacaccagggggcttggccgggtgaggaagtcagaataggcagtcactggagagcttgaggcaaactgt

SEQ ID NO: 28619 - DNA, 601 bp, Human
atgccatggcccacagagaaggcctggatggctggcccactggcacaggcatcagcttaggagacctgtgtgctctggtctggacacacggaaatggctgataagaagaaaccatgtgcctggcaggtgcatgaaagagacaaaatgaccagaagaaatggccaaagacatgtttaatgtgtcctggaccatcactgtagcagtcgcgttcaagtaaattgctggcaaccatctgtgtctgacagaagagcttagcaaatagccgcgggagtgcagggacgctggaacaagccacgcaggkccacggtgctaagacagcggcacagctaactgatatcactgccactggtcaactttccatccccgtccctcccaaatgagctcactttcctatgggacactgtatacaccctctaggggtcacctcattctcacctcccagcagcacagactccaggtcctctcctgcaggccaacgggcttgccttggtctatgaacttcccaccacttcctgtctacccgtctctggtctgagcccctccaatctggctgccagagacatcttattttaaaaggcaagtctgactctgtaactatcct

SEQ ID NO: 28620 - DNA, 601 bp, Human
ctaaaaagtagaggaccaggatccagcaatacacagcgactaactgtgatctgatttcacttgtggtgctcaggataaagattttcattcacttgagaaggagcaaaatatatagcagagctgcttttaacttaaagaaaaaagagtacgaatgtccctgtctccaatcagcctgtcttgtatttcagctgaatgtcacaccgccaccacctgtttcagagcctcgccccaggctcacccagctgtggggcccacggcgcatactcccttggtagctatcactgaaaactgggattcactyctcagacatttaacaaacatccaaagtgggcggaaagaccatctggctagcacagcagtgccacttaccatactgactggcatcaaaacacgtgaagggggccccgaggacctctacaaagtagcccatgcttctcagatgctggtacatatccctgaaattggtgtggatgtgatcaccattcctgaaaaacaataggccacagcattaaaatgatcgatctttactggcaataaaggcatatctggccacagggccgcctctgcaagagcaccatgccatggcccacagagaaggcct

SEQ ID NO: 28621 - DNA, 601 bp, Human
atttctcctgccacaatccagtccttccacactaaggcttcaactgaaaccaactgtctgggtttgggtaaaactgcaaatttaagtgcttcggctgatgtgtagaattaattaaagcaaaatttattttatgaaatgaaaatcagtactttaccgaaatgcaccagagataactgcttagcctagacccagcaaggttcagtgaaggagaaggagatgagaaagaagcatagaaatgttcagtcacagattctaaagaaaccgattcaaaacataaaggtgattatgtttataatacatkgggagtccttgatcccaataaaggggaggacattattccctttgagtaaattaattactataaatataagtaaattaattattgtaaatatacaatatttaaatatacaataatttactcgaaatattctttaagaaacagttcctttggtgcatttaaatttatatatactcagtaacagagagtggaaaagaattaaacagaagtttaaagctgaagtatctcatatctaagattaacaaggaaagacaatgaaccctctatattattaacagtactcatactcaataaacatcttac

SEQ ID NO: 28622 - DNA, 601 bp, Human
ttagaagggagggggcctctcattctgaaatacacagtatcaaacttgcatgacagaaacgaatcttgtacattttcatttttctaaaaccttggtaatctggcaatcacagaagcagaacaatttataaagggtaacaaaaaaattcatcaagtaaccttgaaggtagttttttttttttttttgagatggtctccctctgttgcccaggctggagtgcagtggcatgatcttgggtaactgcaacctctgcctcccaggttcaagcgattctcctgcctcagcctcctgagtagctgggactacaggcgcgtgccatcatgcccggctaaatttttgtatttttagtagagacagggtttcactgtgttagccaggatggtctcgatctcctgacctcatgatctgcctgcctcagcctctcaaagtggtgggtaccattcaagtaatattgcaataaattttaaaagaaaccaaaatgtcgaatgggcatgggatttcttattgcggtgataaaattgttctggaagtagacaatggtgatggttccacaattttgtaaatacactaaaaaccaccgaattgtacactttaaaagggc

SEQ ID NO: 28623 - DNA, 601 bp, Human
taataaaactatccttaacgtccacgtacagaaaatggcaactttagaagggagggggcctctcattctgaaatacacagtatcaaacttgcatgacagaaacgaatcttgtacattttcatttttctaaaaccttggtaatctggcaatcacagaagcagaacaatttataaagggtaacaaaaaaattcatcaagtaaccttgaaggtagttttttttttttttttgagatggtctccctctgttgcccaggctggagtgcagtggcatgatcttgggtaactgcaacctctgcctccmaggttcaagcgattctcctgcctcagcctcctgagtagctgggactacaggcgcgtgccatcatgcccggctaaatttttgtatttttagtagagacagggtttcactgtgttagccaggatggtctcgatctcctgacctcatgatctgcctgcctcagcctctcaaagtggtgggtaccattcaagtaatattgcaataaattttaaaagaaaccaaaatgtcgaatgggcatgggatttcttattgcggtgataaaattgttctggaagtagacaatggtgatggttccacaatttt

SEQ ID NO: 28624 - DNA, 601 bp, Human
taacccatggccaagtgactgtgaaaacaatcattatgtgcctaaaggtgaaatataacctattaaacacagatccagttactgatcaaacttgcttttgataaaaggaaaaaatcccttccaggtaatataaaaataagttctatattccagttgcaagtagataaggtgagaaatcctctcttttcatcgttttcaactaataaaactatccttaacgtccacgtacagaaaatggcaactttagaagggagggggcctctcattctgaaatacacagtatcaaacttgcatgacagaracgaatcttgtacattttcatttttctaaaaccttggtaatctggcaatcacagaagcagaacaatttataaagggtaacaaaaaaattcatcaagtaaccttgaaggtagttttttttttttttttgagatggtctccctctgttgcccaggctggagtgcagtggcatgatcttgggtaactgcaacctctgcctcccaggttcaagcgattctcctgcctcagcctcctgagtagctgggactacaggcgcgtgccatcatgcccggctaaatttttgtatttttagtagagacagg

SEQ ID NO: 28625 - DNA, 601 bp, Human
ctttatgggaataaaatgcccctttaaaaaatttcgttttcacactgtagtagaacacctaaagaaagcacatatccttaaatctacttctgattctccccacccacctaccaaaaacaaggatctcccagagggtacaagccaatgagaccaccgctttgatcccttgtttacagctagaacctgaagtgatactgtctatgagaaatgcttttagaaagaatcactaacccatggccaagtgactgtgaaaacaatcattatgtgcctaaaggtgaaatataacctattaaacacagawccagttactgatcaaacttgcttttgataaaaggaaaaaatcccttccaggtaatataaaaataagttctatattccagttgcaagtagataaggtgagaaatcctctcttttcatcgttttcaactaataaaactatccttaacgtccacgtacagaaaatggcaactttagaagggagggggcctctcattctgaaatacacagtatcaaacttgcatgacagaaacgaatcttgtacattttcatttttctaaaaccttggtaatctggcaatcacagaagcagaacaatttataaa

SEQ ID NO: 28626 - DNA, 601 bp, Human
ctttctcccctttacaaaatgagaaaaatagtctgtgcccaacctcaagcccccaaatccaacggatgcatcgagagactgacataaagacgcggagggaagaggactggcatgcctatttgcctccccttcacgcctcgagataacaaacgctcttcactgataaaggctaagaaaagcccgaattccaggtctggaaggacagccaagagccagccctccagtaaaagagtgagtcagaccagagaagggcgccccctcgtggcagtgcccacaaagtccaggcagcacggcgtaggargcctgggaggggcaggccccaaggaagtcagggaagggactctccaccacaacgcgggagtcccgcctccgctggcctcaggaaggtgaagatggagaagaggcatcatggccccaacaagtagctttgttttgcttattaaatgtgtgcacactcagacacctatcaaaatattccaagcaatcaaagtgactgcaacatctccagctgagcctggctcaagtgaacagatgtcggctgatctgccagcatctcacgggcgcctttccagagacaaagggaagaaaggatctgagtgcc

SEQ ID NO: 28627 - DNA, 601 bp, Human
actctcccacctcagcctcccaagcagctgggactacaggcacacgccaccacgcctggctaatttttgtatttttagtagagacgcggtttcactgtgttggccaggctggtcatgaactcctgaccttgtgacccactcacctcggcctaccaaagtgctgggatcacaggcgtgagccaccacgcccggcccatttttgatttttaaaaagacccatcccagtctagggatttacataaatgccaggaatgtagtcaacttcagcctgaaacggaggggcacacacacacctctcagygcacgctgttagtgcctcattcttgtcactcaccacccgccctgtgcctcgagttccccagtggtcacagcgcattagaaggttgcctttcagtcctggtgtcattatcatctcaccaggtaaaaacatggagcacttttaccattctttctcccctttacaaaatgagaaaaatagtctgtgcccaacctcaagcccccaaatccaacggatgcatcgagagactgacataaagacgcggagggaagaggactggcatgcctatttgcctccccttcacgcctcgagataacaaacgct

SEQ ID NO: 28628 - DNA, 601 bp, Human
taaagggcacttctggtcaagtgcttaatgcccctgaaagatgaaaaaagctgccattttaaatgtaaggcctaggaccaccctctcaggcatttacaatttaataaagactcttaccaggagatctcaggtcttaaaatctctgtggaaataaaacattaacctcctttaagtgtgactttaaccctcacttttaattttaattttattttattattattttttaaaacagtgtcttgctctgtcacccaggctggagtgcagtggcacgatctcggctcactgcaacctctgcctcccrggttcaagcaactctcccacctcagcctcccaagcagctgggactacaggcacacgccaccacgcctggctaatttttgtatttttagtagagacgcggtttcactgtgttggccaggctggtcatgaactcctgaccttgtgacccactcacctcggcctaccaaagtgctgggatcacaggcgtgagccaccacgcccggcccatttttgatttttaaaaagacccatcccagtctagggatttacataaatgccaggaatgtagtcaacttcagcctgaaacggaggggcacacaca

SEQ ID NO: 28629 - DNA, 601 bp, Human
cagaggctctcctggggagaaggaactgtactgacaccccagggggtggaggcaaggctcaacacccatgcagcatctgttcacttgagctgggcttcgagtcggcagggccctgaccactggaagtgtgacagcagagaaagggcaatttgttttcagggacacctcagagtcgaggcactgggctagcaacagctcccgttcacaaaggatcctttctgagagggaaggcgcaacctggtattgaaacctggagcttctgtttccatcttgtttctcctgtgtctgccccttcaagttscattaacatcaacctggactagacaagatccgtgtgagaaaaatgccattaagtactttcctctcattaaagggcacttctggtcaagtgcttaatgcccctgaaagatgaaaaaagctgccattttaaatgtaaggcctaggaccaccctctcaggcatttacaatttaataaagactcttaccaggagatctcaggtcttaaaatctctgtggaaataaaacattaacctcctttaagtgtgactttaaccctcacttttaattttaattttattttattattattttttaaaacagt

SEQ ID NO: 28630 - DNA, 601 bp, Human
ctgtggttcccatgagccttctacgggcagcgctgtaaggaccagcacaccagggacttagacgcactgatacccaccccactaagtgccaagcagctggcggccccacggcaccagcacaggccccagaggcgggttgaggctccaccaccacataccgcccaggcgatctcaggcagttatctaatttctctcagctctcatttcctcatctggaaactgggaataataacatctattttcacaggattactgagaggggacagtgaggtaatccatgggagcatcccagcctgctgcrtgggacctggcaagtgctctagaatgttggtgattcttcctgaagatctgtaggagccactgtcctcacctgtgagagcgggacggtaaacacactcagagtggcgtgagggtcggggtgcacgtgggaaagcagctgcacactgggtcctcgatcatggccctctggggactaaggatggcctctcggcaggttagagccgctgagtgctgctctacccgcagccattacgaaaaccactcagcggcgcacacaaactggccccacttgctggcaggcacagccactggctgaagtagc

SEQ ID NO: 28631 - DNA, 601 bp, Human
agcaatgactcacaagccccgtggaaagagtggaagggcacaggcggacactaacctgggcgccgtctcgtttaaaggctgtggcttggcccaagacaagcgtggacaggctggtagaggccgaggttttgggtctcccaaatgggcctccagaaccttggagtaccgatgaagatggtttcctgtggttagcagcaacatcaacaaaaaagaaaatcatctctattactaaaatgcaaaggaaaaaggagggccttattatgagtctgtctgctttcccacaacacagcacagagcccckgtgctctattaagctatcctccatgagccgcaggagccacgcctgattggttcctcccggacaatgtgtgtttccattgctgaaggtgggtgagaaaatcagaaccgttcccttgaagatgggcagatgtgtgcacagcactggctggtcaaactttgctgaccaccactgacacacgcaaggctacacctgcgaaatctaagctacagaccggtttcatggaaaaaatacttctcttctaaaatatttaattctctggccaaataaaaaaccactctgcattttcaaaattctttctat

SEQ ID NO: 28632 - DNA, 601 bp, Human
tgaaagttaaactgacagtgttaagttacggaatcaatgacatttaggctttatgactttgtagctgaatatctatgggctatatttccattctaacagtgatatcctgttccagaatctcattctttggtgatggcactttctagtggagcagtcatggtaacagtccacacccattaccatgtggctgctttacagcatactgacggaaggactgaggagccaccggagcaggagttcctctcagggaggacgctgacacttccacagctgccctaggtatgggcacctgatgccaacraagaagcccaaagcgcctctccacttcacagatggaagcctgcccccagcactgggctgacagcatctggagctgtctcctggtctcaaatctcttttggagactcagaatatgcgtcgatctaggtctctggggaccgagaataattttcaacaagatatgaaaagcaagataaatgtaaaacccagcagcgtactgagaagaaggaattactgagtgattgtgaaaatcaaattccaggagctgtccattatcaacatgctggatgggccggttcagtatgtgatggattatttgatg

SEQ ID NO: 28633 - DNA, 601 bp, Human
aggcttaatcagtctgaaagttaaactgacagtgttaagttacggaatcaatgacatttaggctttatgactttgtagctgaatatctatgggctatatttccattctaacagtgatatcctgttccagaatctcattctttggtgatggcactttctagtggagcagtcatggtaacagtccacacccattaccatgtggctgctttacagcatactgacggaaggactgaggagccaccggagcaggagttcctctcagggaggacgctgacacttccacagctgccctaggtatgggmacctgatgccaacgaagaagcccaaagcgcctctccacttcacagatggaagcctgcccccagcactgggctgacagcatctggagctgtctcctggtctcaaatctcttttggagactcagaatatgcgtcgatctaggtctctggggaccgagaataattttcaacaagatatgaaaagcaagataaatgtaaaacccagcagcgtactgagaagaaggaattactgagtgattgtgaaaatcaaattccaggagctgtccattatcaacatgctggatgggccggttcagtatgtga

SEQ ID NO: 28634 - DNA, 601 bp, Human
tgagcactcattataacccgccctattttataggatttaattttacacttcaggcttaatcagtctgaaagttaaactgacagtgttaagttacggaatcaatgacatttaggctttatgactttgtagctgaatatctatgggctatatttccattctaacagtgatatcctgttccagaatctcattctttggtgatggcactttctagtggagcagtcatggtaacagtccacacccattaccatgtggctgctttacagcatactgacggaaggactgaggagccaccggagcaggrgttcctctcagggaggacgctgacacttccacagctgccctaggtatgggcacctgatgccaacgaagaagcccaaagcgcctctccacttcacagatggaagcctgcccccagcactgggctgacagcatctggagctgtctcctggtctcaaatctcttttggagactcagaatatgcgtcgatctaggtctctggggaccgagaataattttcaacaagatatgaaaagcaagataaatgtaaaacccagcagcgtactgagaagaaggaattactgagtgattgtgaaaatcaaat

SEQ ID NO: 28635 - DNA, 601 bp, Human
agagactcccactcgatactcccagctcggcaactgcctgaatgccaatgagcactcattataacccgccctattttataggatttaattttacacttcaggcttaatcagtctgaaagttaaactgacagtgttaagttacggaatcaatgacatttaggctttatgactttgtagctgaatatctatgggctatatttccattctaacagtgatatcctgttccagaatctcattctttggtgatggcactttctagtggagcagtcatggtaacagtccacacccattaccatgtggstgctttacagcatactgacggaaggactgaggagccaccggagcaggagttcctctcagggaggacgctgacacttccacagctgccctaggtatgggcacctgatgccaacgaagaagcccaaagcgcctctccacttcacagatggaagcctgcccccagcactgggctgacagcatctggagctgtctcctggtctcaaatctcttttggagactcagaatatgcgtcgatctaggtctctggggaccgagaataattttcaacaagatatgaaaagcaagataaatgtaaaaccca

SEQ ID NO: 28636 - DNA, 601 bp, Human
catctttgtctctgaagaaaccactgtctccagggagaatacgaaacatacaaggaaccaacagtgggagagagtctgagcagcaaaacgtggggtccccatctgccttgcctgcaggcgggggacgatcaaatgaacgtgtgcgcttcctgcactctgtggtgcacagtatcattattaactctgggatctgaaaaactcgttcaggccaatacaacttagacccgaagaagacagagaggttgatacgctggcaacagcagcacagagcttgggaggacaccggagctagagcgaagakcgcgatgggaaaaacactactctggcttaagtgagggggaagaatacagtaagtttgcaaattaaaatttctctatttttctgttatttattcatttggaaactgtcagcctgtctctttcactttgggcaagtgaaagcaaagacgtccagtcctatcagcaattaggctgaaagtcaacgccaagctggcgggcaagggctggtctgagtagaggttccctaggcaggcaagagagagactcccactcgatactcccagctcggcaactgcctgaatgccaatgagcactcattataa

SEQ ID NO: 28637 - DNA, 601 bp, Human
agcctgtcagggggaggagctgaagcctgctgagtggacctgagcctggggctatcgaggtcctctccctaaggcctggagcagtcggaggcaatggtgattccagaaccactgcatataaggaagtgggcaaactggtgccgggaaccagacagcatctttgtctctgaagaaaccactgtctccagggagaatacgaaacatacaaggaaccaacagtgggagagagtctgagcagcaaaacgtggggtccccatctgccttgcctgcaggcgggggacgatcaaatgaacgtgtgcgmttcctgcactctgtggtgcacagtatcattattaactctgggatctgaaaaactcgttcaggccaatacaacttagacccgaagaagacagagaggttgatacgctggcaacagcagcacagagcttgggaggacaccggagctagagcgaagatcgcgatgggaaaaacactactctggcttaagtgagggggaagaatacagtaagtttgcaaattaaaatttctctatttttctgttatttattcatttggaaactgtcagcctgtctctttcactttgggcaagtgaaagcaaaga

SEQ ID NO: 28638 - DNA, 601 bp, Human
tgatctacggggagatgtgaaatgccatttgcgtccacggccacctaaatgccactgacagcaactatggtggccgtttccacgtcccgagggagaaagatcaaaatcaagtccctgttcatgagattctactgagtttacaatatgaccagcaggagcctgtttttgcataaagctaaacatgaccaagcgcctcgggaggacactccaagcgaggccctggaaggagcctgtcagggggaggagctgaagcctgctgagtggacctgagcctggggctatcgaggtcctctccctaagrcctggagcagtcggaggcaatggtgattccagaaccactgcatataaggaagtgggcaaactggtgccgggaaccagacagcatctttgtctctgaagaaaccactgtctccagggagaatacgaaacatacaaggaaccaacagtgggagagagtctgagcagcaaaacgtggggtccccatctgccttgcctgcaggcgggggacgatcaaatgaacgtgtgcgcttcctgcactctgtggtgcacagtatcattattaactctgggatctgaaaaactcgttcaggccaatacaact

SEQ ID NO: 28639 - DNA, 601 bp, Human
agaagccaagagccaaggccaccacagctcccaggaaggcagagacagggagagtctggcccgcctcctgggggagggagggagactcctttgaacaaaatacaggatgactgagcacaatcacaaagcagccgagaactcacctccaggaatgtcccaggcgccgctctctccaggggacaagggcctcacttgagggcgattcgatcgaaagttgggtaacaccaccttgtccaggtcaatggagagtagcttctgatgtttccaaaggttacttcaggaaaatggattaaaacaaaayaaaaataagccattgtactagtctaggtactagtctaggaagttcaactgaaactcaagacagagcaagtgatctacggggagatgtgaaatgccatttgcgtccacggccacctaaatgccactgacagcaactatggtggccgtttccacgtcccgagggagaaagatcaaaatcaagtccctgttcatgagattctactgagtttacaatatgaccagcaggagcctgtttttgcataaagctaaacatgaccaagcgcctcgggaggacactccaagcgaggccctggaaggagcc

SEQ ID NO: 28640 - DNA, 601 bp, Human
acaccccagctcagtcaagtccctcccaggggggcagggcagagaactgaaggggccttctgggctgagggctgggagccagggcggctgctgccattggctgggacccaaaccagcagacaggcatcctgtaagggacgttaataggtggctggcagaactttcataaagagcgtgcaagttactttgaacatgtttaagtagatcacccagccgttgtaaaataaattcaaatgtgaaaatctaggtagcattttctaagggaaacaacaatctcttaatctgtcaggcctgcccttgytcatgctggtttgtgccacaaaagaagccaagagccaaggccaccacagctcccaggaaggcagagacagggagagtctggcccgcctcctgggggagggagggagactcctttgaacaaaatacaggatgactgagcacaatcacaaagcagccgagaactcacctccaggaatgtcccaggcgccgctctctccaggggacaagggcctcacttgagggcgattcgatcgaaagttgggtaacaccaccttgtccaggtcaatggagagtagcttctgatgtttccaaaggttacttc

SEQ ID NO: 28641 - DNA, 601 bp, Human
aagagtacaggggactctagagcaaaagaactgcccaggctcggctggaaaggcctggtaccaattgccttgggtagtggagaagaacctgccctaggcagtctatgtagccagtcaggatccctggagagacagacaggatgagaccacctaagggacacaccccagctcagtcaagtccctcccaggggggcagggcagagaactgaaggggccttctgggctgagggctgggagccagggcggctgctgccattggctgggacccaaaccagcagacaggcatcctgtaagggacgttaataggtggctggcagaactttcataaagagcgtgcaagttactttgaacatgtttaagtagatcacccagccgttgtaaaataaattcaaatgtgaaaatctaggtagcattttctaagggaaacaacaatctcttaatctgtcaggcctgcccttgctcatgctggtttgtgccacaaaagaagccaagagccaaggccaccacagctcccaggaaggcagagacagggagagtctggcccgcctcctgggggagggagggagactcctttgaacaaaatacaggatgactgagcaca

SEQ ID NO: 28642 - DNA, 601 bp, Human
gggtgccccttcctgatcccatttctggacaattcctggaacccagagaaactcctcttggtagctataaactctttggaagagtacaggggactctagagcaaaagaactgcccaggctcggctggaaaggcctggtaccaattgccttgggtagtggagaagaacctgccctaggcagtctatgtagccagtcaggatccctggagagacagacaggatgagaccacctaagggacacaccccagctcagtcaagtccctcccaggggggcagggcagagaactgaaggggccttctgkgctgagggctgggagccagggcggctgctgccattggctgggacccaaaccagcagacaggcatcctgtaagggacgttaataggtggctggcagaactttcataaagagcgtgcaagttactttgaacatgtttaagtagatcacccagccgttgtaaaataaattcaaatgtgaaaatctaggtagcattttctaagggaaacaacaatctcttaatctgtcaggcctgcccttgctcatgctggtttgtgccacaaaagaagccaagagccaaggccaccacagctcccaggaaggc

SEQ ID NO: 28643 - DNA, 601 bp, Human
ggggcgtggcggaagaagcaccgctggcagtgccccgcctctgggaaagcccttcatggaggggacgtgtggctgaaagccaggagaggccatcagaggaccctggttcagaatgtcaatacgactgggcaaggccaagggctctggaatttaccttcagcgcaccccgtgacctatgcgcaaggccctcaggaccctggcaccaccacgtggtgtccagggctggactgcacagacaggggtgccccttcctgatcccatttctggacaattcctggaacccagagaaactcctcttggyagctataaactctttggaagagtacaggggactctagagcaaaagaactgcccaggctcggctggaaaggcctggtaccaattgccttgggtagtggagaagaacctgccctaggcagtctatgtagccagtcaggatccctggagagacagacaggatgagaccacctaagggacacaccccagctcagtcaagtccctcccaggggggcagggcagagaactgaaggggccttctgggctgagggctgggagccagggcggctgctgccattggctgggacccaaaccagcagacagg

SEQ ID NO: 28644 - DNA, 601 bp, Human
cccacctcctggttgtagcggccaggcatgatccctgtaagaggacagccggttgaacaggcaggaacgccacagagctaccatgacggcctttttctatgacggctggattcatcagaaactaaatgcgagctaatttcactagctgggcttgcagggcatacatcatttttaagccttagctaaagtaacccaggctattaataaagagtggatgagagcaaagagcagccacttcctgtggggtggaggctcggtggatctctgctgcccttcctccctgggatccccgcagacggaygatcaggcccagctatgcttctgtcacaacctaccgaagggaggcccagaggcgctctgtgtttctctaaacacaagggaagatgggcacgtctctatccaggggagaaggaggggcctgtggttccagctgagtgggaggaggagaaagggggcgtggcggaagaagcaccgctggcagtgccccgcctctgggaaagcccttcatggaggggacgtgtggctgaaagccaggagaggccatcagaggaccctggttcagaatgtcaatacgactgggcaaggccaagggctctggaat

SEQ ID NO: 28645 - DNA, 601 bp, Human
cctgcagtcagaagaccccagacagcctttccagttctcccgagtctttggtgcgcacagctgccggcgggaagtctcactggcggcagagccactaagtccctcctgacgggatccacaggaatcttctcgatgtaccaggagcctctgcccatcacaggagggcaggcccatgtagaacagactctaacaaacctgcagctggaaactggatcccttttaaaccagccgccaccacagctcggctcacccaccagcgccgtccgtgaaggctctctctggccctcacggtcagccaggytgccggtcacaccgaaggggtctttggcgggtgaacctgctgcatgagctgcgggcgcttcaccctgggcttcctccgcttcggcctgctcttggccttgttgatttgtaccacaaagaaggccaggaccaccatggctcccaggaaggcaaagacaggaatggtctggcccacctcctggttgtagcggccaggcatgatccctgtaagaggacagccggttgaacaggcaggaacgccacagagctaccatgacggcctttttctatgacggctggattcatcagaaactaaatgcga

SEQ ID NO: 28646 - DNA, 601 bp, Human
gacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaaygaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcat

SEQ ID NO: 28647 - DNA, 601 bp, Human
ttgaaataacacaggaatacaccaaagataagtcgcaagacatggactggtaatgcagacttggatgtcttgtgtataatgacaatagctgaagctctacagatagaggaattctgtggtagccagccttcaagatcgctccccatgatccccacctactgttattgacaaccttgtgctgtctgtcccctcccacatcataccagggttggtatggtggaagtggtggtatgtcactcccaagcttaggttctaaaataactgaggcagctgtctgggttgctctctctctctgagagargccagttgccatgtcataagcagcccttactacacagataactacgtggagaggaagtgaggcctccagccaacagccagcaaggaagtgaagcctgccaacaaccatgagagggaggctggaagcagacctgcagtgcactcaagcttccaggtaacagaggcctggtcaacacactgaccgctacctcatgagacacactgaccctgagccacccagtgaagccactccctgattggtgccctctcaaaaactgacatagtaaatgtttgtggttttaagttgctaagtttgggttaa

SEQ ID NO: 28648 - DNA, 601 bp, Human
gaaactcagctttggagtcttacttcaggaacaagaaacggtttcaccttgacgattgtagggattatcatacgaagctttctaaccagaaaataatagcacactcttaagaactgtgacaaattttgccctcacccagtttgaaaaacatcataatttttgtttccagtggtaatgcaaactacacaatctaaaagcctcctgccctacaagacagtaagagaaatcccatgagtcaaaaaccaaagaataccctaaaacccgagcagtaagcaggtgccaaggcttgggctggggcgargccggggagaagtcaggggtcactgccaatctccacaagctgaacggccttgggttttcacccttgggttttcacggatcctcagagagagaaaaaagacagggctttaggccccaagggatgacatcttcaatataatgggggcccggaaagaactgtcaataggcaaaaagaaacaataaggaagtttgtctgtcagtcagcctggactttgggtggggaaagtaaacaaaacaaaagcctccctcctgagaattcaaaccacaggctggccctcatttaggctacagtttgaattta

SEQ ID NO: 28649 - DNA, 601 bp, Human
gccccgggaggaacccagggccacaagtgcattcaacgtacagatgatcagtgtgtcaatgtatcctgcattgcacattaattcccacagctagctgcattcttcatcgacacacaagccaagcaatccaccactaagagtcataaaaagcactttgaacaacacagaaagacaaaaatacagcaacatcagaaaggtaagtaccttatttcttgatgttattatctgtttaatgactactcggtctgccagcaacaacacttttgtcactgaagaaagaagtaatcttgcagcctttatyactcctgttttgtctgtaaaaattgtgatctgcccatcagattccagatggttcaagttggttatgtctgtaagtgctgcaattgtttctcctaacaagaaagacgaggggagaaagttaaacaggcatacaaattaaaatctagacttctctctaaccttgaaggtaaggcacaatgaggagaaactcagctttggagtcttacttcaggaacaagaaacggtttcaccttgacgattgtagggattatcatacgaagctttctaaccagaaaataatagcacactcttaagaactgtg

SEQ ID NO: 28650 - DNA, 601 bp, Human
tatttttatcaactaggtttctgctacatacattatcatagtgctcaccttttctttccaaatgttgtacacatttaaagcttttaccaataagccttaacaagtggataatgattctctaagaggagacattacttgcattcaaaagtttaggcacagcatacccatcatttaagaattgcacatatagaagaaacactacttttaaactacagacagagttataaacaattataatagacaagcattgccaaattacttacaattaacctaaaaagaacttttctttttttttttttttaagcaacgctcagacatgcatagccccgggaggaacccagggccacaagtgcattcaacgtacagatgatcagtgtgtcaatgtatcctgcattgcacattaattcccacagctagctgcattcttcatcgacacacaagccaagcaatccaccactaagagtcataaaaagcactttgaacaacacagaaagacaaaaatacagcaacatcagaaaggtaagtaccttatttcttgatgttattatctgtttaatgactactcggtctgccagcaacaacacttttgtcactgaagaaa

SEQ ID NO: 28651 - DNA, 601 bp, Human
aatgactacatatacaaaggaagggatcatttatgtagccaagtctaaaaggtgggaatgggcaggaccacagtaatcaaatcttcagagaactgggaaggggtgaggatgaaagtcagcacacacaagctttaaggttcagtgaaccaggatgacaggaaccctaacattctcaggaaagcagaaggaacctcatcatcttcagagtatagagtcgaaagggaagtgtgggactttaagggtgggaaaattagtctggctcagtcaggaatgggccatcaggggtgaataaagagtgtgygaatctggtagagccagtgactaaaatgttatgtgttttcttgatgtaagaaacaaagtaaatagatgtgaaacatattttcaaatacttttctttaaaataacattattagattgttttagtcgcaacaagataagttaaaaaaaaacacagatatcctctgtttacttatttttcctgagaatatgatgaatatttggcatgttaatctgccctggcagctcaggaagttcaggcgactaacactgataaggcacgttgccaccactgtgagaacctccatctttcaaagaggggaag

SEQ ID NO: 28652 - DNA, 601 bp, Human
tgattcacgcctgtaatcccagcactttgggaggctgaggcgggcggatcacctgagattaggagttcgagaccagcctggccaacatggtgaaaccctgtctctactaaaaatacaaaaagttagctgggcgtggtggtgcatgcctgtagtcccagctactcgggaggctgaggcatgagaatcacttgaacccaggaggtggaggttgcagtgagccgtgatcacgacactgcactccagcctgggtgacagagagagactccatctcagaaaaaataaaataaaataaaataaaaamcaaatatcatgttgtagtttgagaactacagactttagaatcagatataactgagttcgatctgctagcacagtgaccttgggaaagtttatccttgtctcaggttcagtttccctatatgtaaaacagtagttaacaatacctacctcatagggatgttttgaaaattaaatgagatcatgtatattaagtacctaacacataggcagtgcaaataaataatggcttgggttattactattaatctaatacggtaagaataacaaatatctaacaagatactataagaatacatatgat

SEQ ID NO: 28653 - DNA, 601 bp, Human
ttttctagatatacaatcatgtcatctgcaaacagggacaatttgacttcctcttttcctaattgaacaccctttatttccttctcctgcctaattgccctggccagaacttccaacactatgttgaataggagtcaccactgccactttcttttccttttgagacagtctccctcccttgcccaggctggagcgcagtggcgtgatctcagctcactgcagcctctgcttcccaggttcaagtaattcttgtgcctcagcctcctgagtagctgggattacaggcacatgccaccacacycagctaatttctgtatttttagaagagatggggtttcatcatgttggccaggctggtctcaaactcctgacctcaggtgatccacccacctcagcctcccaaagtgctgggattacaggcatgagccaccatgcccagcctcaccactgccactttctaccaccttggtccaggtcaccatcatctctcaatagattactgtaatagcctcttgagtggtctccctgcctctgcccttgtctccatgcaaactattctcaacatggcagctagagtgatactgttaaaatgtaagtcaga

SEQ ID NO: 28654 - DNA, 601 bp, Human
attggtgtataagaatgcttgtgatttttgcacattgattttgtatcctgaggctttgctgaagttgcttatcagcttaaggagattttgggctgagacagtggggttttctagatatacaatcatgtcatctgcaaacagggacaatttgacttcctcttttcctaattgaacaccctttatttccttctcctgcctaattgccctggccagaacttccaacactatgttgaataggagtcaccactgccactttcttttccttttgagacagtctccctcccttgcccaggctggagcrcagtggcgtgatctcagctcactgcagcctctgcttcccaggttcaagtaattcttgtgcctcagcctcctgagtagctgggattacaggcacatgccaccacactcagctaatttctgtatttttagaagagatggggtttcatcatgttggccaggctggtctcaaactcctgacctcaggtgatccacccacctcagcctcccaaagtgctgggattacaggcatgagccaccatgcccagcctcaccactgccactttctaccaccttggtccaggtcaccatcatctctcaatag

SEQ ID NO: 28655 - DNA, 601 bp, Human
gatattgattcttcctacccatgagcatggaatgttcttccatttgtttgtatcctcttttatttcattgagcagtggtttgtagttctccttgaagaggtccttcacgtcccttgtagttggattcctaagtattttattctctttgaagcaattgtgaatgggagttcactcatgatttggctctctgtttgtctgttattggtgtataagaatgcttgtgatttttgcacattgattttgtatcctgaggctttgctgaagttgcttatcagcttaaggagattttgggctgagacartggggttttctagatatacaatcatgtcatctgcaaacagggacaatttgacttcctcttttcctaattgaacaccctttatttccttctcctgcctaattgccctggccagaacttccaacactatgttgaataggagtcaccactgccactttcttttccttttgagacagtctccctcccttgcccaggctggagcgcagtggcgtgatctcagctcactgcagcctctgcttcccaggttcaagtaattcttgtgcctcagcctcctgagtagctgggattacaggcacatgccac

SEQ ID NO: 28656 - DNA, 601 bp, Human
atggcattgaatctataaattaccttgggcagtatggccattttcaagatattgattcttcctacccatgagcatggaatgttcttccatttgtttgtatcctcttttatttcattgagcagtggtttgtagttctccttgaagaggtccttcacgtcccttgtagttggattcctaagtattttattctctttgaagcaattgtgaatgggagttcactcatgatttggctctctgtttgtctgttattggtgtataagaatgcttgtgatttttgcacattgattttgtatcctgaggstttgctgaagttgcttatcagcttaaggagattttgggctgagacagtggggttttctagatatacaatcatgtcatctgcaaacagggacaatttgacttcctcttttcctaattgaacaccctttatttccttctcctgcctaattgccctggccagaacttccaacactatgttgaataggagtcaccactgccactttcttttccttttgagacagtctccctcccttgcccaggctggagcgcagtggcgtgatctcagctcactgcagcctctgcttcccaggttcaagtaatt

SEQ ID NO: 28657 - DNA, 601 bp, Human
aaatgtaaattatgtaagttaaatgcatttagtcgggtgttctaattattaatttattacacagtaaaaccaaaattgtcttacctttgaagctgtgagaagcatcattgtacacttttcaagaactgccctagctgctgccatttttgcctttttcttttcatctttcaaatcctaaatatgaaataaaatcacggaggagtctaagaccatgtgaacaacccaatttcttaaaaaagtatttattcaacactaatactcaagaattcactaacattgttaagtgaaaaaaaaaaaaaaaccaggataaagttttacaaactgtcactgcttcaatataaacacatcaacacaatatgagtagaaagaaaaagctactcttagtaagggctagagagccagaaactgagacacaggtagaggctgcacatggctgacattctggtgttctgtcatacctgacattctcacgtcaaatgcacacactgcgtcctaaccagaaacacccagcctatgtcttacctaattaaaagtaaattgtctactgagcatctattgactattatttccttcaaaacagacacttaaaagtcgattcttt

SEQ ID NO: 28658 - DNA, 601 bp, Human
gttttctgatctgttaaaggagggcattgtactagatgacttcttagggccctcccaactcagacactgctcttacccagaaagcatcttcaccatgtctatgacttctgatgagaagtcagacttcctggagtcacactgcctagtttcaaatcccaactctggtacttagtagccagcaagttaatatcctttctgtttctcaagctcctcaacagtgtaatggaaataatagcaatagttctttgaggattatataagttcatatatttaaagcactcagaaaagggctggcacagamtaaggactcaataactgttagtgtgtattactgttgatttttaaattttaattattactaatactattactatagtctcaaagtaccaaccctctaacacagagaaaagcaggaattctagcagaaatgatttgctgctcaccatcatcctatggatggtactgctcaaaaagatatggcactgctcaaaaaacaggaagggaacattcttttgaacaggaggctacagctaaaccatacagctaaacagagccagagtagctactataaccaaagaccagtgttctttgtaaatacacc

SEQ ID NO: 28659 - DNA, 601 bp, Human
gaagcactggggaagacatccatttttcctttgttaattcagcaaagactctcctagtcacctaactggtctccctacattttgtttaaagtccccaacagcaccttactgacccaaacatcctctaccagagggtctgtataatctaaaatgtaaaccatctgatactgccacctccctctaatagttcctcgccatctatagagaatcaagcccaaacgtctatgtagtatagcacaaaatcctctatggcctgtctttatatacttctctaacagtctatctcaccccctgaaccccmtaacaacctttcacttcagccatcctgtttggagttccttgactatgtgatgaacacatgctcatgtgtgcagtctttctctctcagctttctacgatgcatcatgccatttcaaccctgtaaaacactacagtccatgaaatatgtcacacagacaacttgggccaagaggcaacaagcggtaatgatcatgattatggtcacaatgaatgtgataataaggataccttacatttgtttaacacttcaaagtcctttcacaaatgttattttaattaatccttatgtgtgacccatttt

SEQ ID NO: 28660 - DNA, 601 bp, Human
aaagatttgcatctgagaaaatgcctaggcaaagtcctggaagataagttacacccaaatatgaaatgtgctgagcccagggggaaggatggtgtggaagatgtggggtgtgagaagcactggggaagacatccatttttcctttgttaattcagcaaagactctcctagtcacctaactggtctccctacattttgtttaaagtccccaacagcaccttactgacccaaacatcctctaccagagggtctgtataatctaaaatgtaaaccatctgatactgccacctccctctaatagytcctcgccatctatagagaatcaagcccaaacgtctatgtagtatagcacaaaatcctctatggcctgtctttatatacttctctaacagtctatctcaccccctgaaccccctaacaacctttcacttcagccatcctgtttggagttccttgactatgtgatgaacacatgctcatgtgtgcagtctttctctctcagctttctacgatgcatcatgccatttcaaccctgtaaaacactacagtccatgaaatatgtcacacagacaacttgggccaagaggcaacaagcggtaatg

SEQ ID NO: 28661 - DNA, 601 bp, Human
ccctgtgtaacagtaggagttgtgtagcactggtgagcttacagtttctctcaagggcaggagtgatatctaattcatcctttaaccccctggtgccagtggtaatgctgtttctagaagatgaactgggtattcaatggctgaatacccttgtccctttttcattctgttatcaaccagctctttcccatgtagcttttcccttaggtgaaaaatgcttctgctaatcttaaagttggtgaggaatgaaacagtattaagagtattaagagtgcaatatttagagtactaagaaaattgrcactttgtgatcattaataagttctttagcatacttttgaaaaagtaccaatgtgagattcaataaatttaataaattttattaaatacctatatcatggcaagcactgtagcactgtactagaggctgggcatacatgacaagtaggacacaacccctgccctcagggaggttagaatctgtctatagttgccatccagatcttgtactctctgcctctatgaacaaattgggtcccaggagaaacaatagattaaagggtaacacgaaccccatggttttattgactttgtgtggaat

SEQ ID NO: 28662 - DNA, 601 bp, Human
caggtctacaagacaatatgtctacagtttaactttcacatcctcatcctccacaatacatagtatcattttataattaaaaagaaaattttacaaataaaatttcttaaaacctattaaaataaacttaaacattactgagaagattattataatattatattggtcaccaacagattctctgggaacaaagcagatatcaataaaggtataacattgtttctacttcctatccaatcatggcaaggtggttacagaatattaaaacagaaagaacctttggaaagacctagtagtgccyacatattttatatataaagaaatttgggaaaaaaaaaagaaatttggctcagagaagtaacttgcccaaggtctcacagctaaactatgtcagagttactacaagctacatgttctatcaacactgtcttccaatggagctaacactggattaggcagactggtataataaggacagaccctatatcagaggaaattactgaaaatcttgacgcttaaaacagaaaatcagagaacattttttttttcaatgttaaaaagatttgctgcaagattcctaaaataagcagtttccctatag

SEQ ID NO: 28663 - DNA, 601 bp, Human
ttcagtggttgctaattctggttatcataattattattttaacactataatgtactatttgcctaatttaagatagttattttgcttctgattggatctttttttcccccagatatagactcttgctctgtcacccagcctggtgtacagtgacacaatcatagctcactacagcttcaaactcctggactaaagctatccccctgcctcagcctcctgagtagctaggactataggtaagcaccactgtacatgggtaatttttgtttgtttgtttttattttttattttttgtagacasagggtcttgctgtgttgcccaggctagtctcaaactcctgtactcaaacgatcctcctacatcagcctcagaaagtgctgggttacaggtgttagccaccatgcctggtcccaattgaatcttgtaagtaatgtcataacattgttttgtttgtgttttagtctcatgtcctaattattagcatgaaatgtatttgaatcttaggttgaaatgtgaatattacataacatatggcttcttatgtcatgataacttaatctccaaacatgttataacaagtgcattgtaaacagcttcctt

SEQ ID NO: 28664 - DNA, 601 bp, Human
ctaatatattaatagttggtacctttgaatgaattacagctagctgttcctccctctggggtgggcatagtgtcacaggcacagcacttgccaagcagatggcagtgttataagaacaaggttcccctcttcagggaaagcaggcacataacttgccatggactacaggctagattttggcattgctctcctctcaactagtgtacaaactgttcaactgttccctcagtatgtctaacattttaaaggaagtataaaaataacattgccaaagcagagatatccagaaataaattatccmagaggcatgctcaatgtccttaaattatccttttgtgaggcagatggcaaagactaggagtggaagctaaggctttgggaacagaaaaagcttctcaagttatgcaggttattaacaacatgctctgccactatcctggggaagaaaatatggctattcctaatatctctgctgcaataaaacaataaaccaaaaattgcaaccagatggcaagcagggcctgaggataggagcaacaactgattgcatatggcaggagagtcaagccctccagttctattggaatacttttgcagccaa

SEQ ID NO: 28665 - DNA, 601 bp, Human
tgatggaggggattaggtggtcacagtattttaagttagagagtcactgaaaaggtgagggagctacaggaaaatcgaggggaagtcatttgggatggggcagaaacacttctggagtgttcaaggaacagcaagtaagccagaggaacagactgacatgagcaagaggaaggtggccagtggccatgtaatggagaagcatagatggtaaggactggattttcttctgagtgagaaagtcattggggaacttacagaagattaatatgatcagggccatgttagctaatatattaatagktggtacctttgaatgaattacagggccatgttagctaatatattaatagttggtacctttgaatgaattacagctagctgttcctccctctggggtgggcatagtgtcacaggcacagcacttgccaagcagatggcagtgttataagaacaaggttcccctcttcagggaaagcaggcacataacttgccatggactacaggctagattttggcattgctctcctctcaactagtgtacaaactgttcaactgttccctcagtatgtctaacattttaaaggaagtataaaaataacat

SEQ ID NO: 28666 - DNA, 601 bp, Human
tactgtttggtgtttgagatacattaatacattaatatcccccaaaatatacaaataaaatactactttttccaaataagcattattccatttttcagctggaaaagttgaagctccgagatacccagtaacttgtgccagaccctattacgagtatacacagagttgatatctaaactcagatctacctgatccaagttcaggctctttccatcacatcacactgccactcacaaaacacttgtaaagagggcagaaatcatcctggtacttttacgtaccaccacatgggctaaataartgtgttgaataaataaataaattgttgcagagactgctatgttttcatcaaaatctgtttgtcttccctctggatacataggaagattacatttcccagcctccctggtggagacatatggccacgagactgagttctgtccccacttgaatgtgggtcaccacttccatcctaactgatccaaacctccctcgtgcccctcagtgctctctcccttccacatctgatggttcaatgcacaggctccagtagggactttgaggtcctgagggctagcgaggcacaaaatgaaaggggacc

SEQ ID NO: 28667 - DNA, 601 bp, Human
actagatggatgcaatgtcaatgtttcagcagcagaaattatctaaagaaacacaatatacacctgtgtgaatttcaaaatcttagccctcagaatcactttgaagaccaaaggtaagtaagtctgctgttcaattcaactcaataaacaactatgaagtaatttctatacacaagctccatgttgggcaatatgaagatgcacagtaggacaaaatttgctgtttcttataatctgacctgcagacaaatagtatgcattattatatacaaacctgcattcagggagcaattctcttcaytcaagtaaaactctgtttgaacaaagttgttcccatagaataattcaaacagttatactcagaccacaaaaagtgtactgtatacagagtagcaaaggtagcagtaatagtggtggtggtagtagcagtggtaatagtaggaatggtagtgataataataagtaacatatatacacacccatgagtacttggtagatacatgcttgagatactgtttggtgtttgagatacattaatacattaatatcccccaaaatatacaaataaaatactactttttccaaataagcattattccat

SEQ ID NO: 28668 - DNA, 601 bp, Human
ataaatacaaagcatcaaaatgatttgccattcagactatcacagaaatttttaaatgtggaagcatggtaaacatttatcatactttacaaatgatgttatagctataattctattatgccctgatttttaagcaaattaacatttatcctaaatgagtatttttaaaatatgaaatgtttaaatgggcatactcaataaaaaatatgtaatttgatataattgtaaatgacattttatttaaaaaaataagcaagctttgacactacagaagccatttgaagagaaaaaatataaacaygtaaatataaataacaggacacacagtacaatggaaaataaacaaaacttccactcggtattaaaataaagaataaaaatgatgccttcctatacattgtatggcactattctacatgttgtagaaataccaatgaacttacccaccacaggcaatattccaagattatgtagtcatcaaggaaagagattccatccaagtggaaggaaagcaattcaaaaatcaaataactacattcatttcattatgaagttagtagaattaaaacatagaattactgcattatagaagagctgttgt

SEQ ID NO: 28669 - DNA, 601 bp, Human
gaccctagtagcctgtggcttttacttttccttaaacttccctagctattttttttaaagagcctaactttggtagaagaaaggcaaatctcagagacagaaaaggagaacactgaattaatgttgcattagatgtccggtgagaggaatctttcagagggtgtcagttcaccattggagaagggatgagcttcatttgtacaaagaagcaaggagtttacctttgcttctgcagatctagaggttttctacggtggggccagactggctagtcctccctagagtaggagaaaggacatasggagagatggatgccagaaagtaggagagattgagattaagtaagagaaattggacctaatgttttctcataaactatttagttttaccacaaggtaacagtggtcatgatgctgatgctgatagaggtaacacttgttgagaatttactgtgaattaacttattttatttaatcttcacacttaccatattaggtagttttgtcatcattatccccattttgcagatgtaaaacttgaagcatagagagattaagttaggaaatagcagaggcaggattggaacctaggcagtccactt

SEQ ID NO: 28670 - DNA, 601 bp, Human
ggtggctcatgcctgtaatcccagctctttgggaggctgaggcaggcagattatgaggtcaggagatcgagaccatcctggctaacacggtgaaaccctgtctctactaaaaatacaaaaaaaaaaaattagccgggtgtggtggtgggcgcctgtagtcccagttacttgggaggctgaggcaggagaatggcatgaacccgggaggcagagcttgcagtgagctgagatcacgccactgcactccagcctgggtgacagagcgagactccatatcaaaaaaaaaaaaaaaaaaaaaagmccagcctgggtatcacagcgagactcccatctctgggggaaaaaaattaaaaaatctgggcatggtggccagcacctgtagttctagatatgtgggaggatcccttgaacccaggagtttgaggctgcagtaagctatgatcacaccactgcacaccagcctgggtgacaaagtgagaccctgtctccaaaatataataataataataaaataaactggctaaattatgtttagctgttatatcaaagaagtagcataaacaaaactctatcatattataaacattaaaaatagttggaa

SEQ ID NO: 28671 - DNA, 601 bp, Human
tctgttagggttatcttaaaataacaaaaatagacaaattgctatttgtactttcaaactgttctgacaatagcttaaggcacaaaaactgttttttttaagtcacagaattaatttgcagtatcatgatcgcttttacaccagctacattcagttcctaatgttgtatttcagtattaaatgccagtcccttttcaaaaagtacactaattaagtttggaccattttttgatttggggatttgatttatcatttgttcttcccctacaccatcaagcattcccactatcatttctaaaaytccagacttaagactttaatatctctcttcattgcaagttctctcttctgatactcaccatctgttgttcttcaccacactgttactattgataatcatcagtaattttattttttttttttttgagacagtcttactctgttggccaggctggagtgcagtggcacgatcttggctcactgcaacctccatctcccaggctcaagcaattctcctgactcaccctcccgagtagctgggattacaggcctctgccaccacgcctggctaattttttttgttgttgttgttttgtttttg

SEQ ID NO: 28672 - DNA, 601 bp, Human
ataaaacaaaacactcatgtgtacacttagcttaggaaggaaaatcatcactaatactttaaggaaaaagatcttctcatacatatatttttatttcccttattaccatgactttttacttctgaccaactattctgtcaccagtttcaccacagaacaaaacagcctcgtggagtttagatctgctcatggaacatagcccttttgagattttctaatgatgtttactattaaagaaacaggtgaagttgaaggacagaaaataaaaataaaggaactcttgttacacacacatgcacacacacagagagaaagagacaaagacagagagagagagaataaacaaatatgaccaatgatctctctggctcctccttgaatggtcacatcatctttatctccatccttggtctagttgactataaggcaactgataaaacatttaagaaagtaaggaacaccctcaaggtttttaggtttagttttattcagaattttatactttatattattcttttaaatatagttgcattttcatgatttttatttttacttttactaatgatgatgattattaaagtttaatgacgactgaaatgga

SEQ ID NO: 28673 - DNA, 601 bp, Human
acaataaaacaaaacactcatgtgtacacttagcttaggaaggaaaatcatcactaatactttaaggaaaaagatcttctcatacatatatttttatttcccttattaccatgactttttacttctgaccaactattctgtcaccagtttcaccacagaacaaaacagcctcgtggagtttagatctgctcatggaacatagcccttttgagattttctaatgatgtttactattaaagaaacaggtgaagttgaaggacagaaaataaaaataaaggaactcttgttacacacacatgcrcacacacagagagaaagagacaaagacagagagagagagaataaacaaatatgaccaatgatctctctggctcctccttgaatggtcacatcatctttatctccatccttggtctagttgactataaggcaactgataaaacatttaagaaagtaaggaacaccctcaaggtttttaggtttagttttattcagaattttatactttatattattcttttaaatatagttgcattttcatgatttttatttttacttttactaatgatgatgattattaaagtttaatgacgactgaaat

SEQ ID NO: 28674 - DNA, 601 bp, Human
attttaccaattgcaagtactctactagtaagtgagttcagctttgaataggttgttagtttgaaatctggagccagagaaagcaagtcagtgccttccctgctctgtggcctctgtgcttacagctgctctcctcttttcacaagggcttccagggactcaagacaacttctgcagtattcctggagtccaattattatgtcccccaaacctccctggcttctctgttcaacaagattcttataatgcttgaattattcttatgaaatgatatattaaaattagccactatatgtagttytctatacattccttatgttatgactccagaattcaattcctttaactaatttgctcttggaaggctaaatttcaactctctagcttcatagatatcacaactgctaatctcatatcccaagttataaagagattatacttaggattctgaatttaatatgtgaaccaatgttcaatggttccctatttttgaaagagaaagtttgttttcatgtaaactatctggaactcagagtgtattttccctagaaggggagaaaatattccatcctagttagaccaggctagtccactgatgcct

SEQ ID NO: 28675 - DNA, 601 bp, Human
aagtccaagctttgctatcttggcttgctcctatgaaacagacgttttaatcacaacgactttatcactattcatgttaaaggaagattagatgtaggaattggtcttacctcagagtcaggcttgtctggctttaatgatttcaggtttgcattattcttctgtgacaataaaaagattaagattatcttaaaaagcagtacattaaactgtaaggaaatacaatagtaatacaaagcataacaaagtacttgtaacaaaagtttaaaatattcagtatgtaatgactgaatattttaccaattgcaagtactctactagtaagtgagttcagctttgaataggttgttagtttgaaatctggagccagagaaagcaagtcagtgccttccctgctctgtggcctctgtgcttacagctgctctcctcttttcacaagggcttccagggactcaagacaacttctgcagtattcctggagtccaattattatgtcccccaaacctccctggcttctctgttcaacaagattcttataatgcttgaattattcttatgaaatgatatattaaaattagccactatatgtagttttctatac

SEQ ID NO: 28676 - DNA, 601 bp, Human
aggatgtaaaattatttcaatgatggaaagagtgggcagaaacctagcagaagatcccttctaaatctaaatcctaattaaatacatgtgtcttgttgttgcattcacttacgtaaattgtcatagtaactacttttagtctttttaccatatatttgataccgactttaacctgtcaatgatttaacatggaacttttttctttacaccagatatcattatactgatttaaaaaataaaaatacaactacatttacctagtaaataaatacagagaataggccatactggacatgttccrtccatattgaacaatctcattctcctgatcttcccacttctcaatttcgcagtcagcgtcagaggtgagcaaacccagcttaagtccaagctttgctatcttggcttgctcctatgaaacagacgttttaatcacaacgactttatcactattcatgttaaaggaagattagatgtaggaattggtcttacctcagagtcaggcttgtctggctttaatgatttcaggtttgcattattcttctgtgacaataaaaagattaagattatcttaaaaagcagtacattaaactgtaaggaa

SEQ ID NO: 28677 - DNA, 601 bp, Human
gacaggagccagaaaactggagatatcaagtatttcccaggtttccaaaaatgaaaaagatagatttcagaaactgagtgaaaagcttgaagttattccttgagaaaattctagaagggatttttgagcagataactgattttaactaagcagaattactataccttatgtataaattactaaaatggaagactgaaatatgactaacattgacatcaacaaggcatttgatcaagagtcttgtaatatgatcaagacagagaatataggtcagataacattaaagttaggggaattctcyacataatgaatggtgactcacagagatttggcacgctattgacatagtcctcatagctctattctttgatctgtgtctaatcaatcttcatctgtatctagtcaatcactgtataaaggcataaaagacatgttttcttaacgtactgatgctggctgggagaggcattaacaatgcaggataacaaaaaagcaggatgtaaaattatttcaatgatggaaagagtgggcagaaacctagcagaagatcccttctaaatctaaatcctaattaaatacatgtgtcttgttgttgcattca

SEQ ID NO: 28678 - DNA, 601 bp, Human
cccatctacctattcttttgcttatttttcattttgttcaaaacttgggtgggaatagggggtgctatttatttatttatttatttttgagatggagtctcaccctgtcacccaggctggagtgcaagtggcgcgatctcagctcactccaagctccacctcccggtttcacgccattctcctgcctcagcctcccgagtagctgggattacaggcgcccgccaccacgcccggctaactttttttttttttttttaagtagacaccgggtttcagtgtgttaaccaggatggtctcgatytcctgacctcgtgatccgcccacctcggcctcccaaagtgctgggattacaggcgtgagccaccatgcccggcagggggtgctatttattgagtcccaaatcccacacagttgtagagatccttcactactttaattgagcttcagtctctagaatactgaagcaacctgcaggtgtgtcccacggtggataacctttccaaaatcagaatgagtaggacaggagccagaaaactggagatatcaagtatttcccaggtttccaaaaatgaaaaagatagatttcagaaactgagtgaaa

SEQ ID NO: 28679 - DNA, 601 bp, Human
taccactctcatcagaagattgaggaacagcagattaaaaactaccaagaagaattaagaactctaaaaaatgaaaagtaaattacaataagaataaccaaatgcattaagaagagcaatggactagggataagtcagaaaatctggaatctagtagcaaccagttctgccacttaggagatgtgaacatatcattcctgttctccagtaaaccgtcatgaaaatcaaatgaaatgatgaagcaaaaaccacattaaaaacaataaggtactagtatgtttgaaatattgaaaaactatamggcactagaaaaccttaaatatctaaattattaagaaatatgaatgattacatgtaaatcattaagaaatcatataaattattaagacaaccttaaacagtaacctgaagaagggctataaatctgcccaggaaaactgctacaaggtatttatctattacagaaaaatccattttctattctggaatgtcatcactactatccaataactatattctaggaagaagtcctattccacagagcttcccctcgtagtgcaacccctcatgtttcccagtgtccatgggatactctacaatt

SEQ ID NO: 28680 - DNA, 601 bp, Human
aaactatatgagtgataaagtgatagaaatttctttcttttttttttttttttgagatggagtcttgctctgtcacccagactggagtgcagtggcgtgatctcagctcactgcaagctccgcctcccgggttcacgccactctcctgcctcagcctcccaagtagctgggactacaggtgcccgccaccacacccagcgaattttgtgtatttttagtggagacagggttccaccgtgttagccaagatggtctcgatctcctgacctcgtgatccacccaccttggcctcccaaagtgytgggattacaggcgtgagccaccgcgcctggcctaaagtgatagaaatttcaaatctcagatgtacatgggaatgccaaaggagactatatgagtgataaagtgacagaaatttcaaatttacacacaagaatgctcttggttctagagaggcaaacaggctaacatggggatcagggaaaacataaaaggaattttgcaacccacttgccaatctaaagcctctaactagagggagtagaattacagatgggcctatgtggagtcctgttaagacacatggcacaagagtggatgttag

SEQ ID NO: 28681 - DNA, 601 bp, Human
ctcacataggaagaaggtaagtagtggatcttttgtagtaaaacacccctacagggcggtatgacagaatggacttgggccaaactgaaaaaaaaaataaattcagaatttcaactatcttaagggaaatagctcatttatagtctgctttacagaaaaatccagaagacacattttctataatacttctgattatgttgacaatcatcctcttaagctgaaatccctttcccacagaatgccaaataaaactatatgagtgataaagtgatagaaatttctttcttttttttttttttttgagatggagtcttgctctgtcacccagactggagtgcagtggcgtgatctcagctcactgcaagctccgcctcccgggttcacgccactctcctgcctcagcctcccaagtagctgggactacaggtgcccgccaccacacccagcgaattttgtgtatttttagtggagacagggttccaccgtgttagccaagatggtctcgatctcctgacctcgtgatccacccaccttggcctcccaaagtgctgggattacaggcgtgagccaccgcgcctggcctaaagtgatagaaatttca

SEQ ID NO: 28682 - DNA, 601 bp, Human
ctggctgggtgtggtggctcatgcctgtaatcccaacattttgggaggccaagggtggaagataactttagcccaggaattcaagatcagcctgggtaacatatggagacctcctcactagacaaaaaagaaaaaattagccaggcatgggtggcacatacttgtggtcccagctacttgagaggctgaggcgggaggattgcttgatcccaagaggtgaatgctgcaatgagccatgatcacaccactacactccagcctggatgacagaggaaaccttgtctcaaagaacaaaacaaarcatacatatatacacatacacacatacacacacacaccaagtaatggtagtataaagattaaccatatctaaaatgaaaagcagttcaaattacattaatcatgagttcaccaaaaacttgacaatacaaaattctgcaactaaaatatcaataaaattttttattacaaaatacatcttccattataacaagatacaaatacctccaatccattttctccaccaaaaaggcacatatgaggaaaccagtgcgattgaagccatgagtacaatgaacacctagaaaataaagtagctttg

SEQ ID NO: 28683 - DNA, 601 bp, Human
caacagaagtttataaaatgggcaaatcacaatcctcaccctcaagtcattcaatctattaagggacacattcattctgaaaaggttttaatataaggtattcagaaaattctgaaattctaaaaataaattgctatgagtatatagtagagacctagatagggtctgtgaagaatttagtcttgaaggttgaggtctgactctgcagcaaaacatcagtcaaaaaaacaacaatgtgagcaaagtaaaagcatattgattttacaggaactttcaacagatccaggcactaagagtctagatcatcaaagagaggataagcataggctaaatctgacataggaaactgagatcattgtggagagcatctgaatggtcagagctagaaagtacatgcagtacagaaccaccaacaatgcatactgcaaaattcaaaatcatatgtgtacttcaactgattatattcaaaaaaggacctactatgtgaaaatctttgtaaacataaataatgatgctccctcagtcaacaagaaaattcagttagtaatatattctcttaagaatattgggtactaaagtcgtaatctctcaggatctaaaa

SEQ ID NO: 28684 - DNA, 601 bp, Human
gccagtcgtgttggcacatgtctacagtcccagctactcaggaggctgaggtgggaggatcacttgagcccagaaggtcaaggctgccactgcactccagcctgggcaacagagcaaaactttctctccaaaaaaaaaaaattttttttttagaaagggctaggatgaatcatctgacaaacctagctaaagaaacatggccaatattccatttttataaatctcaataagcttgcagaaaaaggaaaaaaaaaacctattataatatttttaaacattaccagttttaaccgttcttttctccttttgccaaaagaagcacttgacccgggttctgattccttctttccatcctcatcctcatcttcgtcttcatcatcctcaaaacaccaatctggcaatagaggtgggggtggtgcttcctctatgtcaccataccgacgaaaaagttccttcaaataatcacccttgtagattcctggtggtctggcttgggcaaaagtagcaactgctgcttcgatactataggaaacaaacaccatgcaatttcctcgctatcctctatttatgcaggcttatcaaaaactcacttattatattc

SEQ ID NO: 28685 - DNA, 601 bp, Human
gaaaatgaggcagatccaaatttcacctcttccctcttatcaaattgagagactagctcaaacattaatcagtagcagtagagtcaaagacacgaaacaaatactagacagtgaaaacaagaattttctattactttaggaaaatatgtgagtcatctaattttgactcaactgtctggttattgcattgattgtcttgaacgaaatctgacacctttaaagtattctattgcaaacatactaacttcaaggagccaagaagatatgtcaatgcttgtattaagtgttgtaaaataagagyaaattttatttaaaaatttaaaaatatttattacccttcccagccacagaattgatgacacttctgctgtacctctcctaactttggttgtgttgttacttgagttacacctttaacagtaacaccttccaagaaaatagcgccctttaaaaaaaaaataagaaaaataagggaaagaaaaatattttattagagttcaaattcatttacaaagaagagactgagagataaattagtttgttctcacaaatcttagcaagtcaatatatctaacagaaacggtctgctgtataaactccc

SEQ ID NO: 28686 - DNA, 601 bp, Human
ataaattacagaactatttctcaaacttgcctaattacaatcacttggtcacttgtacggacatgtaggcccctgggagattccaattcatatggtctaggatatgctattggaaagggtcatattttaaacaagcaattttttaaccctacaattttcacagtcaagatagtttggaaaccccaatttatggtctctatatacacaatggtaaaccattcagacatttatgtgaaaaagatgtccaaaacacattgctaagtgtggggaaaaagacaagttactaaccacatgtaacatwtgtttctcttcatgcaaaattatataactatccatatgtatacatatttgaccagagcactcatttaacaccctttacatatctttaacaaatttctccaccaaagaaaatatctcaaagtcttacttatgctcaaagattcagttggcagatctctctttaagaggaccttaattcaatataagtatacataagaaataaatgaaatttaacatcctaataaaagttagatttggctgggcgcagtggctcatgcctgtaatcccagcactctgggaggctgaggcgggtggatcacga

SEQ ID NO: 28687 - DNA, 601 bp, Human
ttaacaaaaaaaaacagatatggcaactataattctagcccaagtaaattgacatcatgaatcatactgctatttttaaaacttcacaagaatctattatgccgctctcagttatccaagtttgaggtgaaataaatagtattgctaagttaaatctgtagatggttaaatatctaatttttaagcattatttcctacctagaatgccctcagcccacgtccatcaaaaatctttctatagaaatctttctgtttctaatgccaactcctacacaaaacatatttagttcctaactaactrgatgtgatttatttctcctctaaactacctcaggacttaaatacctctctttgggttattgttttattcaaaggtctcttccatcattaccattcattctccaccctgctcaattaagcaaaatgtttcaagggtgaggccttctcctcaaccctctaagcaatacccgtactcttggtatagcaactcataataggcactcaacaaacattagttcaattataaactatactaaactttgacaaatgctattacttaagtcttttcctttcttatattttattaattataatgctaaaa

SEQ ID NO: 28688 - DNA, 601 bp, Human
tatattgaacagtttggcttttgtgctatgaataacagggaaccactgaagggttttcaaaacctgtgggccttcaaggctcatctctgtaactcattccttgaaatctttcatataaggctcccttggttctaatcatcacagtccatataggtgatgaaatgttctggaattagatagtggtcttgattttatgaccttgtggaaaagactaaaaaccactagattgaacatcttaaaatagtgaatttcatagtatgtaaattgtatctcaattttttttaaaaaaagaactaaattwaaaaaaaaaaaaaatcctaaaagcagttcttcagattgaagaggaataacagaaccccagatacataacatatattaaatgtcagctatatacatattggttatacatgttatataattattagcacaacaaagttactaaaaggatatttccttttaacatcaaaatataaaatgtcatctcttgattgtttattttttctaagtttacagactttctaaaatttcaacaataagcatgtagtgttttataaaaaattaatagttgaaaaagacatggaatttttccaaaattcttgcc

SEQ ID NO: 28689 - DNA, 601 bp, Human
attaaagcagagctcagtgtcaagaagtaaaggagacagaacttccctactcacaaagaaacaaagccaccccgccaccccttatgtctagttataggccaatgaatgttattccaagatctgtgatgagattaagccagttctggaaagcagtacttatgaggaatacagtcaaacagaacaaaataaaacttgatgttttctggccctgaggctcttaaatttgaagttctttgttttaaatacagaatttcaatcaaaaaattagatgtgtgcattaaaaatgtccagaaaaaaatgycttttaataacctggattaatgcaatcctgaattaatactgcaatttattacccattcaacagctcataatcagtttctcttttgttttgttgctgttttggtgacagaaataaactcatgagatttaaaagaaaaaagtacaggataattaaaatcagaaatgttcattttatgaaatgctgtcttattttatcagagttatgccattattctttactcacttgcaagttaaagaaacctaaaacaaagaaatgtgtgaaaattaacaataagagaaagaaaaggagatataaaaggat

SEQ ID NO: 28690 - DNA, 601 bp, Human
ataggaaaaacagaagattgtattataagattatacaaacttgcaattaaatcatataaattccaaacaagtaaaaaaaaaaaataagaaatatgttaaaccttgttagtaatcaaggaaaagcaaattaaaacaggatgataccatttcacacacatcaaattggtaataatataaatgtgtgataaaacgaactttggcaaactgaaacaactatttctgagagaaatttagcaatgcagataatatagctgaagctgctgatttaatcaccatctccatgatacactaatgacggaayagagtttttaaaaacacttcccaggtaattacattccaagaatgagaacaactgtcctagcgaaattttcatgtgcgcacaagaaaaaaacataaaattgttcaatatagtagtaatataaaagcaaaaaatggaaaccttaatgttcatcaaaaggaaaaaggataaattctgtatatttatacaatttaatactcaatggtaattaaagtgaatgaactaaatctagacatattagtacaaataaatctcaacattatcttgttgagcaaaggtcagcaaaggtatagtacaataaca

SEQ ID NO: 28691 - DNA, 601 bp, Human
ttttgctatgtcccacaccttaccatccgtcaagtatactagcaggccgggtgcagatggctcacacctgtaaacccagcactttggaaggctaaagcgggcagattgcttgaggccagaagttcgtgaccagcgtagccatcatggcaaaacctcatgtatttgtatttttgtgctaaaaatacaaaaattagctgggcgtagtggcacacgcctgtggtcccagctactcggaaggctgaggcatgagaattgcctgaacacgggaggcagaggttgctgtgagctgagatcatgccaytgcactccagcctgggtgacagaggaagactgtctcaaaaaaaaaaaaaaaaatgtatgctaacaaaccatctaatgctcctgacctccatgactcaatccttcaaaactaatttgtgtcactttctcggtctgcaattccatgcttcagtgactcaactatacccagggaagttggaatactctcacctctctaataccactatatcttttatatacctttgttatgtttatgattttaaagttataattatttctttacatttatatttcatcaatagtctgcaaatttgctttaatt

SEQ ID NO: 28692 - DNA, 601 bp, Human
taaagaactaagttaaaatgccttattcaagtaatctggccctctacttaacaatccattctcattttttgctatgtcccacaccttaccatccgtcaagtatactagcaggccgggtgcagatggctcacacctgtaaacccagcactttggaaggctaaagcgggcagattgcttgaggccagaagttcgtgaccagcgtagccatcatggcaaaacctcatgtatttgtatttttgtgctaaaaatacaaaaattagctgggcgtagtggcacacgcctgtggtcccagctactcggraggctgaggcatgagaattgcctgaacacgggaggcagaggttgctgtgagctgagatcatgccactgcactccagcctgggtgacagaggaagactgtctcaaaaaaaaaaaaaaaaatgtatgctaacaaaccatctaatgctcctgacctccatgactcaatccttcaaaactaatttgtgtcactttctcggtctgcaattccatgcttcagtgactcaactatacccagggaagttggaatactctcacctctctaataccactatatcttttatatacctttgttatgtttatg

SEQ ID NO: 28693 - DNA, 601 bp, Human
aactattttatcagcataattatcaaggctgccacaatgtacataatagtctgtgtaaacagcatcctctggagttattcagtgcacagcgtgcacaaacatatataccaaccctaataattagtttgactaacaatacaactatctaaacacacaaagagacttattttaaaatacaactgtataaaacagtatgagaaagtggcacaattctactgtaagttgatcgaaatatttcacatctaggccgggtgtggtggctcacacctgtagtcccagcactttggaaggctgaggcagraggatcacatgagcccaggagtttgaggctagcctgggcaacagagcaagaccaccacttccaaattttaaaaaataaaaaataaaataaacaatttcacatctgaattaaagtattaatatacttactatttataggtacagaatcattttaaaatagaaaaaatatatactcactagtcttttttaattatttatataaattagttgaaaccctttaacagtaccctattacagtataaaaactaaaatccacagaattcagaaaagtacaagcgagtaacacaccaaaataggtcgc

SEQ ID NO: 28694 - DNA, 601 bp, Human
tggtttttatagttttgaatagatctgaaattatcatggtttctgttgttgttgttgttcaataaattcaacttgtatacagcccagtatcctgccctttaaacttctcttttgggtgcatgggcacaagatcaccagtttagagagtagaacctacaagccaactggagccaaacagaatacagacttgacgtatctttcccatcaaacaaggatgaagtccaaatgactatgccccattaagcaaaacaacaaaggcagcacactttgggtctaacaccttaatttttgttttaaatakaataagcactggtaagttgtcatactcacccatggcagtgttgtaggcattaggaaaacttttgtctgttctctgtctcatgaagacccagctgttgttctcaaatttgcattctataattttgttgtcatactgtttcagctcttttgtcacctgttttgaaagagaattgaggaaaatatttaaataacttgaaaggctttttgcttctactatgtgacaggcacattaggaaatgataaaaatacctcagtaactcttcatgcagagagctctttgtcatctgaagtatctaatcaa

SEQ ID NO: 28695 - DNA, 601 bp, Human
acatggatgctagttccaatgagaactcctaaatgtacaacagtaacttttaaactgcaaagctgaaattggcaatttcaatattttctcattagcttatcatatcatcatcatcatcctcctcatcaactgcacattctaaaagtaaagtttgattaacctgttatcttggtttttaccttttttcaactccactaaaaatgcaatccagaacaacaactgctactggtagtggtataccttataaacttcaattaatttgtgttgttccccatgaaagaaacttactattctgaattcscaaagcattcatattgtacccaaagaacactctgaagaatagcatagcagattttgtctttttaaatggttttcgtttactttgttctccattgtttataaagctattttaagagctggaaattacattttcccctgataattttgtcttttaccatctggcaaacaatggtttttatagttttgaatagatctgaaattatcatggtttctgttgttgttgttgttcaataaattcaacttgtatacagcccagtatcctgccctttaaacttctcttttgggtgcatgggcacaagat

SEQ ID NO: 28696 - DNA, 601 bp, Human
acagggatctcagaaatgtaggaaatccatggtaaatgatagcaagaatgtttaatgccattgcctggattttttaaaaggaaaatttgctacagttgtaacacaacttctaaaaaatactgttttatgggctcacagtttccagattgttaactttataaattaaatgtgaagctacccatatataaacaaggcctctttttcattgatttccatcttgtttaaacctttggatatttcaatcttcagattccacaaggtaaggctgagtttatcagataaataagatgtttaagtccaygatgtattgcagcactgaggaaacgaatgcatcaagtatttacaggctggctacgataactttctttttttaaaaaaaattcaaatgtgtatcaacatcaagccacagtcgtttttcaatttctctggctacaaaaatgggcaacagcgttttttcctcattcctctttcttcttaaccctcaagtcacaggcaggtcttaggttaaagggcgtggtcttttgggaggtggtggtggcatgagctccgtgtcagggtccagatgatgttttcgcttctgtccttgagaagctgcagtaca

SEQ ID NO: 28697 - DNA, 601 bp, Human
ttgaatacagggatctcagaaatgtaggaaatccatggtaaatgatagcaagaatgtttaatgccattgcctggattttttaaaaggaaaatttgctacagttgtaacacaacttctaaaaaatactgttttatgggctcacagtttccagattgttaactttataaattaaatgtgaagctacccatatataaacaaggcctctttttcattgatttccatcttgtttaaacctttggatatttcaatcttcagattccacaaggtaaggctgagtttatcagataaataagatgtttamgtccacgatgtattgcagcactgaggaaacgaatgcatcaagtatttacaggctggctacgataactttctttttttaaaaaaaattcaaatgtgtatcaacatcaagccacagtcgtttttcaatttctctggctacaaaaatgggcaacagcgttttttcctcattcctctttcttcttaaccctcaagtcacaggcaggtcttaggttaaagggcgtggtcttttgggaggtggtggtggcatgagctccgtgtcagggtccagatgatgttttcgcttctgtccttgagaagctgc

SEQ ID NO: 28698 - DNA, 601 bp, Human
tctaaatgacttttataatactgcagatggtattatgttcaggggctaaatgggatctacttataaggccaactactctatgtcactataattgaaaggaaagaataaattaagaaaattaagtcctgctaaaatgcacaaagacttgaagaaaatatctgggtgtattaaaagtgagatgctcttttcacgtaactcatttgaaaggttacaattaccataaacattttaactccattaaagatcattggcaaaagcttgctttcgtatctgcaaaagggctctgcctttccacaggctyggagggaaagcagcacaccgtggaagagtcactcgtcctggggaagcaggcatcagactatttgaagttgcataggcattttttttttaatccattttgtaaaagatactatggaaccttgagaattttccctccttcaatagtcattgtggcatcagttgttttaatccctttagcgcccaaatgtgcaaaaacactctagtaaaaaacgttacaatggcgttttggataaattcactatacattacatgacttgggaacaacgaagaaaaaagcccaagcttgactcaactatttcat

SEQ ID NO: 28699 - DNA, 601 bp, Human
agaatgctcaagtaagtctttgaacaggattaagacaaatttttaaggagtctaaacaaagtactatgggaacttagagaaaccgcttctgactggggggctgtgaggggtcagggaagaaagaaagtagggaggggaatgctccagattgcagcttggatgcttaggggcagtcacctttttttggcaataggagaaaagttataaattgtggacaaagacttctttattctcttcaatgctctaaattcctcctgcagatgatgaaggtagggcagctgaaaagtcacctgggactaargaatctcagctctaggagtttataaactacgtggctatctcaaggaggcatgagtgtctgaaaaattttcaatatcaaatgtaatctaagcaaacttcccaattaccattcagtgcttttatggagccaggggaatatttcatgaagccctatttaggcaggaacagacacttaggatttggtttactatccttgttgcctccttccttctccgtctttaatgcatcttaaataatctccagttatatcctaaaattctcacaatttcttaaaaaattaaagtattacatactatattct

SEQ ID NO: 28700 - DNA, 601 bp, Human
tcaccttgttagatctgacccaagtctctaggcatgactcatgctgcccactgagcaccaccctctagagtttccttaattagcctcttctctgttccaagagcaggacctgcttccaacgttgcatagctgtgccccttcaaccactctgttcctgtctttaagggccttctaattgagatgactacccccgcctgcctaatctccatcacccacttgtgagggctcctctctctctgtttaccctctgtgtaccatgacactactctcaactttcatccctctcctgggaatttcaccrctactgtgtcttgtcagcaatgatgtgctcatgattcaatgacagcttggcttttttggtcccaattcatctagaactacctctaataaacacacgttttaaggggatagggtttttattaccgcaccgggcataggattgaacggatccctccccattccttcagtattacacgtgagggaaggtgcagctgtgtggattcatgggtgcagactctgctcaaggagcagcaaagttagcctttgtgtgaagactgcatttggaccctatgaacatcatgttctgtgccaactaagtact

SEQ ID NO: 28701 - DNA, 601 bp, Human
gggtttgagcttttaaatatcttacaaatttctcagctaatgctgatacagcaagaatataaggtaactttaaaaacaaataagaaaagaaaatgaatcaatgtaaatacaaatattaagtaaattgacagtattggtgttaacatggctattgcaaaacttgtgatggcaataggagaataaagtctgaagtcagggaaaggctgccatagctgatagttgagccatatttttagtcctcctggaaaaacaaggcttttccctgtgggcctcactgacagttttcaagtagagattttttctcccttcatttactctaaccgtgactcagaacccagtatctcctagtagtattacctagatgatgtttgagttatccctccatattcctgcaatggtgcatctaacctagttggatacttttaggcacaactcttttccctttgataggccaaagattcttcttgctttaaattaaaatctggctctccatttgttctccatttgaacagcagaaagagttcaaaccttcctacgtgacaactcttcacccttttgatggctgttctgtgttctgcttagctttatcttctccatgcta

SEQ ID NO: 28702 - DNA, 601 bp, Human
agggtaatatttgtttaacacttaggaagcgtgctacatccatgtgttctatgatataaatcagtgtttgtcaaacttaaatgggcatatgaatcctactgtgaatattcactaggtctggagttgggtttgagcttttaaatatcttacaaatttctcagctaatgctgatacagcaagaatataaggtaactttaaaaacaaataagaaaagaaaatgaatcaatgtaaatacaaatattaagtaaattgacagtattggtgttaacatggctattgcaaaacttgtgatggcaatagragaataaagtctgaagtcagggaaaggctgccatagctgatagttgagccatatttttagtcctcctggaaaaacaaggcttttccctgtgggcctcactgacagttttcaagtagagattttttctcccttcatttactctaaccgtgactcagaacccagtatctcctagtagtattacctagatgatgtttgagttatccctccatattcctgcaatggtgcatctaacctagttggatacttttaggcacaactcttttccctttgataggccaaagattcttcttgctttaaatt

SEQ ID NO: 28703 - DNA, 601 bp, Human
aagccaaaaccatggcacagtctcattgcttgtacacaaaataattttaggcaaatatttcttaatttaatatttgtatgcttattttaaagcctattaccttattttatcaaaatttgccatcaattataacttccacaaataaaaaaatgcagctaatttaaactgcaatgcttctttcatagattgtaatatgcatcctcatttcagggataaatttgtaaaaaatataaaaaaatcagaattgatggaaatagggtaatatttgtttaacacttaggaagcgtgctacatccatgtrttctatgatataaatcagtgtttgtcaaacttaaatgggcatatgaatcctactgtgaatattcactaggtctggagttgggtttgagcttttaaatatcttacaaatttctcagctaatgctgatacagcaagaatataaggtaactttaaaaacaaataagaaaagaaaatgaatcaatgtaaatacaaatattaagtaaattgacagtattggtgttaacatggctattgcaaaacttgtgatggcaataggagaataaagtctgaagtcagggaaaggctgccatagctgatagtt

SEQ ID NO: 28704 - DNA, 601 bp, Human
gatttcgctacagcagcggttctcaaactttgtggtttcaggacgccttcgcactcttaaaactaaatgactgaaagccccataagatttggtttatgtaagtcatatctattgatatttaccatattgaaaattaaaattgagaaattaaaaaatatttattcattaactaaaaattactgtcaaattcattacattaacataaacattttattttattattttattgagatggagtctcaatgtgtcatccaggctagagtatagtggcgcaatctcagctcactgcaacctccacctsccgggttcaagtgattctcctgcctcagcctcctgagtagctgggattataggtgcccaccaccatgcccagctaatttttgtatttttagtacagacgggttttcaccatgttggccaggctggtcttgaactcctgacctcaagtgatcctcccgcctcagcttcccaaagtgctgggattaaaggcatgagccaccgtgcctggccaacataaatattttaataaaaattaccatattttccaaaacaaaaagactagtgagaagggtagtgttttcattttttgcaaatctcttta

SEQ ID NO: 28705 - DNA, 601 bp, Human
gaattcatccacatggctttcttctctcatttctttgaagatagtccctaatgtaatggcttaggtggatttcgctacagcagcggttctcaaactttgtggtttcaggacgccttcgcactcttaaaactaaatgactgaaagccccataagatttggtttatgtaagtcatatctattgatatttaccatattgaaaattaaaattgagaaattaaaaaatatttattcattaactaaaaattactgtcaaattcattacattaacataaacattttattttattattttattgagatrgagtctcaatgtgtcatccaggctagagtatagtggcgcaatctcagctcactgcaacctccacctcccgggttcaagtgattctcctgcctcagcctcctgagtagctgggattataggtgcccaccaccatgcccagctaatttttgtatttttagtacagacgggttttcaccatgttggccaggctggtcttgaactcctgacctcaagtgatcctcccgcctcagcttcccaaagtgctgggattaaaggcatgagccaccgtgcctggccaacataaatattttaataaaaatt

SEQ ID NO: 28706 - DNA, 601 bp, Human
aagctgcagggcccctacccttattctattaaaacagggggccagattcaaaggctcctagattgaacataggtcctgagggatctatggccaggtctaggagcttaaagtgtgcaagtgggaataagctaaaggggatattttattctaacaaaaaagtatgaaggttttttttttttatcctctgagtgtcgattttgggaatattttagttcagtcccatgtgtgcatgtctgaatcaattagagccatggtgaactcaataaaagaggcttcaggaagcactgtctttctttcttttttttgagacagagttttgctcctgtcacccaggctggagtgcaatggctcgatctcggctctgcaacctccgcctcccaggttcaagcgattctcctccctcccctcctgagtagctgggatcacaggtgcccaccaccacacccagctattttttttatatttttagtagagagagggtttaaccatgttggccaggctggtcttgaactcctgacctcaggtaatctgcccgccttgacctcccaaagtgctgggattacaggcgtgagccaccgcctccatcctaggaagcactttc

SEQ ID NO: 28707 - DNA, 601 bp, Human
ttgggtgactgctgaagctgcagggcccctacccttattctattaaaacagggggccagattcaaaggctcctagattgaacataggtcctgagggatctatggccaggtctaggagcttaaagtgtgcaagtgggaataagctaaaggggatattttattctaacaaaaaagtatgaaggttttttttttttatcctctgagtgtcgattttgggaatattttagttcagtcccatgtgtgcatgtctgaatcaattagagccatggtgaactcaataaaagaggcttcaggaagcactktctttctttctttcttttgagacagagttttgctcctgtcacccaggctggagtgcaatggctcgatctcggctctgcaacctccgcctcccaggttcaagcgattctcctccctcccctcctgagtagctgggatcacaggtgcccaccaccacacccagctattttttttatatttttagtagagagagggtttaaccatgttggccaggctggtcttgaactcctgacctcaggtaatctgcccgccttgacctcccaaagtgctgggattacaggcgtgagccaccgcctccatcc

SEQ ID NO: 28708 - DNA, 601 bp, Human
aaaataaaagcaaggtctctctcatatgcctgagtttgtgaaatgagattcatacctgccatatacatctttgggaaactttgggaaagcaggtgcagaggtatgcttatatttgcaaagtgatcaatgctatgacctagacctggtggatgtccggtaagtactgaatggtacatgataattctccacattaagtgagtcaatggctcctgagcttcctctgtagcagccactctgcagcccagagaggtataattggtcggcccatccagtatcagcctcttccttaaatagaccaacmttttctgccctcacctgctgctttcctctaaagcaaacaccacaaaacccctcaaagcccaagtccttggagaaggaaagaggcaagagtgaaggtgcatgtaatagcagctttcatctgctacttcaccgcagaacagataaactaagttttgttctgtcttcagattccgaaggaccagcatgcaatttctaatattctactccaaagaaaaatgagcatgcccatattatcaaagacatctgtaatcaacactcacccggtcatcgagggtcttgactatgactttgtcattttccc

SEQ ID NO: 28709 - DNA, 601 bp, Human
tgagtcccccgtgtagtgctgtgtaaggttctgaaaatgtgacatattcctgaggcagtggtgagggcaccccaagagtgactgaacacatttttccccagcccactgaaaaaggactggaattagaggttaagtttaataacaaaaaataaaagcaaggtctctctcatatgcctgagtttgtgaaatgagattcatacctgccatatacatctttgggaaactttgggaaagcaggtgcagaggtatgcttatatttgcaaagtgatcaatgctatgacctagacctggtggatgtccrgtaagtactgaatggtacatgataattctccacattaagtgagtcaatggctcctgagcttcctctgtagcagccactctgcagcccagagaggtataattggtcggcccatccagtatcagcctcttccttaaatagaccaacattttctgccctcacctgctgctttcctctaaagcaaacaccacaaaacccctcaaagcccaagtccttggagaaggaaagaggcaagagtgaaggtgcatgtaatagcagctttcatctgctacttcaccgcagaacagataaactaagttttgt

SEQ ID NO: 28710 - DNA, 601 bp, Human
ggacttgtttctgaataaatcctccagggaggctgtgagtcccccgtgtagtgctgtgtaaggttctgaaaatgtgacatattcctgaggcagtggtgagggcaccccaagagtgactgaacacatttttccccagcccactgaaaaaggactggaattagaggttaagtttaataacaaaaaataaaagcaaggtctctctcatatgcctgagtttgtgaaatgagattcatacctgccatatacatctttgggaaactttgggaaagcaggtgcagaggtatgcttatatttgcaaagygatcaatgctatgacctagacctggtggatgtccggtaagtactgaatggtacatgataattctccacattaagtgagtcaatggctcctgagcttcctctgtagcagccactctgcagcccagagaggtataattggtcggcccatccagtatcagcctcttccttaaatagaccaacattttctgccctcacctgctgctttcctctaaagcaaacaccacaaaacccctcaaagcccaagtccttggagaaggaaagaggcaagagtgaaggtgcatgtaatagcagctttcatctg

SEQ ID NO: 28711 - DNA, 601 bp, Human
tttgttttccaaaaacctaagtccttaggaaaactttgagggtttcacagaaaagataaaaggaaggagttttgctggtatagaccaaattttttgaggaaggaaaggccttccactccaccacccaagactagaaaaagagaaacagacacccaaggtagccaaaggggaggtagaaaagtctatgtatcctgaatctttaaggactgggacttgtttctgaataaatcctccagggaggctgtgagtcccccgtgtagtgctgtgtaaggttctgaaaatgtgacatattcctgaggcrgtggtgagggcaccccaagagtgactgaacacatttttccccagcccactgaaaaaggactggaattagaggttaagtttaataacaaaaaataaaagcaaggtctctctcatatgcctgagtttgtgaaatgagattcatacctgccatatacatctttgggaaactttgggaaagcaggtgcagaggtatgcttatatttgcaaagtgatcaatgctatgacctagacctggtggatgtccggtaagtactgaatggtacatgataattctccacattaagtgagtcaatggctcctg

SEQ ID NO: 28712 - DNA, 601 bp, Human
ctgctctaatagttcaaacatttgggggtgcatcatggttctttgctgaatattttcagaatattatttaattttttttccctctgtttttttcccacctctctcccccattcaagctggctctgcactccatggctcaggagagacagaaaatagggcaagaacagctactagggaggctgaggcaggagaatggcgtgaatccgggaggcggagcttgcagtgagccgagatcacgccactgcactccagcctgggcgacacagtgagactccgtctcaaaaaaaaaaaaaaaaaaaaatagggcaagaaaagaaaaagagcttgtaatacttcctggattttgttttccaaaaacctaagtccttaggaaaactttgagggtttcacagaaaagataaaaggaaggagttttgctggtatagaccaaattttttgaggaaggaaaggccttccactccaccacccaagactagaaaaagagaaacagacacccaaggtagccaaaggggaggtagaaaagtctatgtatcctgaatctttaaggactgggacttgtttctgaataaatcctccagggaggctgtgagtcccccgtgta

SEQ ID NO: 28713 - DNA, 601 bp, Human
gaggtttccttcagctggaatgtcttcatgaaaattttgtttagaaaccttcaaagctcagctccagcaccaactcttccacgacccatctcctctctcccctattgcttcaaggctcccataattatttgtacctctgctctaatagttcaaacatttgggggtgcatcatggttctttgctgaatattttcagaatattatttaattttttttccctctgtttttttcccacctctctcccccattcaagctggctctgcactccatggctcaggagagacagaaaatagggcaagaayagctactagggaggctgaggcaggagaatggcgtgaatccgggaggcggagcttgcagtgagccgagatcacgccactgcactccagcctgggcgacacagtgagactccgtctcaaaaaaaaaaaaaaaaaaaaatagggcaagaaaagaaaaagagcttgtaatacttcctggattttgttttccaaaaacctaagtccttaggaaaactttgagggtttcacagaaaagataaaaggaaggagttttgctggtatagaccaaattttttgaggaaggaaaggccttccactccacca

SEQ ID NO: 28714 - DNA, 601 bp, Human
gaagaacgcaggaacactgctttacccatttctccaacgtagcattccctgagtggctactgatatggtttctcttcaaagtacacctggattgggggttccctggggacaaaggtagggcatctccttgtgttccacattctcccaaataagcaagagctcagtgtagcttcagccataatcacaggccttgtcatgcactgtgactggcaatggaagatgttgtaccctttgcttttcatccccaaatcatctgactctccgaagatcctttgattattgcaccattcagatggccaaygcccatcaaaagcttgaaaaattaactaaggatggcttcaaaaaatatgaatcaaagaaattactcaccagtcagcatgaactgataggcattgtcagagatggagaagatgtggggcggggcctcctggcgctttttgcctctgtaggcagccaccacctcgggcttgtacaccggcagccacttgtaggggttgacggtgacacagaagaggcctgagtaggtctgggaagatcagaacatttatcatttggatctcgtttttactcagagagagacatgaaataaaaaggtgtttac

SEQ ID NO: 28715 - DNA, 601 bp, Human
tagatgatttttaagcatctacaggtctcagattcagatgctagactcttttttttttttttttgagacggagttttgctctttttgcccaggctgaagtgcagtggcgagatctcagctcaccgcaacctcctcctcccaggtgcaagcaattgtcctgcctcagcctcctgagtagctgggattacaggcacccactaccatgactggctaatttttttgtatttttactagagagagggtttcatcatgttggccaggctggccccgaactcctgacctcaggtgatccacctgcctyggcctcccaaagtgctgggattacaggtgtgagccaccgcacccagccttgcttctacttctagcatctgttccaagtcaagtcaggtgaaggttgaacagacagacttgatattaggcatcatggcatgacagtgttaccatgtccttactccccaggtcattctggaaattaaaggaggtgaaggggagcctgagtttggggaagaacgcaggaacactgctttacccatttctccaacgtagcattccctgagtggctactgatatggtttctcttcaaagtacacctggattgggg

SEQ ID NO: 28716 - DNA, 601 bp, Human
aaccatagaagctaggagagagagacatgggccagattctctctcagcgtcctcagactaaccaatcctgatgacaccttgacttcggacttcaatcctctagaactgtgggaaagtacatttctattgtgtaagccccccagtctgtgatactggagcagccatagcaaactaatagaaattgtggtattagtcttccctttaaaattaatgtaacatgaactaatttcaagaaaaatattaagtttgcagacatggcaaggattgtgattgtgagacagaaatgacagaagtttggacrccattgcattagatgatttttaagcatctacaggtctcagattcagatgctagactcttttttttttttttttgagacggagttttgctctttttgcccaggctgaagtgcagtggcgagatctcagctcaccgcaacctcctcctcccaggtgcaagcaattgtcctgcctcagcctcctgagtagctgggattacaggcacccactaccatgactggctaatttttttgtatttttactagagagagggtttcatcatgttggccaggctggccccgaactcctgacctcaggtgatc

SEQ ID NO: 28717 - DNA, 601 bp, Human
tacttgtgaaaagtgatactggtttttcatttacaatagagcatggattgaactgtgtcctcctaaaattcacatattgaatttctaacccctagtacctcagaatatgaccttatttggaaataagatgtaaacaagatgcaggggtaattactcaagatgaggtcatgctggagtagggcaagcccctgatctaatatgactggtatccttataaacagaagaaatttggagacacacaagcacatggggagaatgccatatgaagattaaggcagggatcagggtgatgcttctacarataaaaaacaacaaagatttctgctagcaaaccatagaagctaggagagagagacatgggccagattctctctcagcgtcctcagactaaccaatcctgatgacaccttgacttcggacttcaatcctctagaactgtgggaaagtacatttctattgtgtaagccccccagtctgtgatactggagcagccatagcaaactaatagaaattgtggtattagtcttccctttaaaattaatgtaacatgaactaatttcaagaaaaatattaagtttgcagacatggcaaggattgtgat

SEQ ID NO: 28718 - DNA, 601 bp, Human
actcactgtagtgaatcccacagtgtagaagttactcatgtttatagatctttaactccctgctagtcctttcccatcgcccttttccataaagaaagcaagtgtcaggttcagagcttgtggggccacagcttttcatcagcatttatagatgctggttggtttcattgcatttttcttttacctttaccttctacttgtgaaaagtgatactggtttttcatttacaatagagcatggattgaactgtgtcctcctaaaattcacatattgaatttctaacccctagtacctcagaatrtgaccttatttggaaataagatgtaaacaagatgcaggggtaattactcaagatgaggtcatgctggagtagggcaagcccctgatctaatatgactggtatccttataaacagaagaaatttggagacacacaagcacatggggagaatgccatatgaagattaaggcagggatcagggtgatgcttctacaaataaaaaacaacaaagatttctgctagcaaaccatagaagctaggagagagagacatgggccagattctctctcagcgtcctcagactaaccaatcctgatgacac

SEQ ID NO: 28719 - DNA, 601 bp, Human
agaggtactgggaggatgtcacctgcagagaccctgcccctcccccataccttgccctagacatcttttccacttggcttttcctctgcatcctttgtaacagcctttataacaaactggcaaatgtaagcaaagtgtttctctgagttctgtgaagcactctaggtaattaccaaacctgagacgggggtcgtgagctcctcccaattaatagctgcttgcttagaagttcaggaggcccggactggtccctggtatccaaagtggggtcagttttgcaggactgagcccttaacttgtrtgatttgatgctttctctaggtagttagtatcagaattgaattgaattgtaggacacccagttggtgtctgcagagaattagagaattgtttggcatggaaaaaccccatacatttgatggcagacacgttctgtgtgaggatacagagaggaaagaaagaatttttcctatttgccgtttctactgagcgcataccctgcatacacttggtgctcatccacgctttaaagtatacttattccagtaagcctccggatgcaggtggggctgctcacctgcattttgcctggctgtgtctc

SEQ ID NO: 28720 - DNA, 601 bp, Human
gatttttataacatgcacctctgttattgcatgtaatatgacccacctaatatagatatttgtcttcagaaggagaaatagaatgtgagcaaagcaagcgacccaggggatgatacaataacaacagtggttctcaaaaaggttttttatgtagcaaaaacttatgagaatgattattcagaaatccactacagaaagcagagttttcaccttcacctccatgactgctttatccttctgggtccagagcaatttagaaactactgtcaaacctagtggttctcaaagtgtggtccctggrccagcagcatgaacactacctgggaatatatgagaaatgccaggtatggtagttcacactcgtaattagcactttggaaggctgaggcaggaggattacttgaggccaacggtctgataccagcctaggaaagatagtgagactccatctctacaaaaaattaaaaaaaaactagccaggcatggtggttcctgtagtcttagctacttggaaggctgaaggatgatcgcttgagcccaggagtttgaagtcacagtgagctatgatggtgtgccactgtactccagcctgggtgacaga

SEQ ID NO: 28721 - DNA, 601 bp, Human
catacattatctgcttaattggtcctcaacgacactgtgcgcaaattcgaggacaaaaaatgttttcttgctttttcacccacagtgtctgaaatgtggatggtacttagtactagcctcaatattttctgaatgaaccccaggaaaagttagtgaaggatcagtaaaggcacatgtgcactgtaagtgctgtgtcttcagtatatttagcggcttaacagaagacaatggaagtcatccctagcctgcaaatatttggagggtggaaagaggacaaaataattagaatgattgtgacttctgggtcagggctaagagtagaggcccatgaactaagtaaatgggaatgagaagagggagtgcctgaaggtattgtctttcactttaagctggtgtcaggccagtgcaataactaacttggtccaggcatgggtaacatacctctgccatgtaacatgtgcccagatcttccacaaggaagaggagtttatttgggcactggggaggatacaggtgcaaactggcagtgcacagggtacaaagaacatatccaaggaaacaaaagtcaaggctcagagccatggtccttgatggattacct

SEQ ID NO: 28722 - DNA, 601 bp, Human
ctggttggattgttctgtctgacttttttttttttttttttttttgcttgtatcttaatagatgctacttctgagatttcttgcctgagtttcacatatggctgactacagacaaatctggctcagaggcccgggctcaggctcaggcctggctccctggctgccaaaagaacaactcagggtctaggtggcccactttctggggagtgggaggtaaaatttcatatgcgtgtttgtgtgtatgcacctgcttcatacattatctgcttaattggtcctcaacgacactgtgcgcaaattygaggacaaaaaatgttttcttgctttttcacccacagtgtctgaaatgtggatggtacttagtactagcctcaatattttctgaatgaaccccaggaaaagttagtgaaggatcagtaaaggcacatgtgcactgtaagtgctgtgtcttcagtatatttagcggcttaacagaagacaatggaagtcatccctagcctgcaaatatttggagggtggaaagaggacaaaataattagaatgattgtgacttctgggtcagggctaagagtagaggcccatgaactaagtaaatgggaat

SEQ ID NO: 28723 - DNA, 601 bp, Human
gactcaggtagctctacccaagcacctgtccctcttcccacaactcaggggatgcccacaggctccttctccagctctcttcttgggactactccattcttgactgcctgcctggttttcatcctgttctcttatacctggattcttaaatcttcataacaccttttaattgtaactggttggattgttctgtctgacttttttttttttttttttttttgcttgtatcttaatagatgctacttctgagatttcttgcctgagtttcacatatggctgactacagacaaatctggctcaraggcccgggctcaggctcaggcctggctccctggctgccaaaagaacaactcagggtctaggtggcccactttctggggagtgggaggtaaaatttcatatgcgtgtttgtgtgtatgcacctgcttcatacattatctgcttaattggtcctcaacgacactgtgcgcaaattcgaggacaaaaaatgttttcttgctttttcacccacagtgtctgaaatgtggatggtacttagtactagcctcaatattttctgaatgaaccccaggaaaagttagtgaaggatcagtaaaggcac

SEQ ID NO: 28724 - DNA, 601 bp, Human
cttgatgtctgagatcttgagtctaatcacttagtatccctggatttcagttttcccattagctcactaacatgtctctcagttcataaactcaataattctgtccgtaaacaaacaaataaatggcatgcttacatctgtcgccaacaattcttcactgtcattgatattggccaccatgacctctccttggctcagaaggaagggatgccagaacatgggcacctctccaccgggtgcccagtgctcccaagctgggtcagcaaggactcaggtagctctacccaagcacctgtccctsttcccacaactcaggggatgcccacaggctccttctccagctctcttcttgggactactccattcttgactgcctgcctggttttcatcctgttctcttatacctggattcttaaatcttcataacaccttttaattgtaactggttggattgttctgtctgacttttttttttttttttttttttgcttgtatcttaatagatgctacttctgagatttcttgcctgagtttcacatatggctgactacagacaaatctggctcagaggcccgggctcaggctcaggcctggctccctg

SEQ ID NO: 28725 - DNA, 601 bp, Human
caccaaatgaaggctaagaagctggtcatggggcagtgtctctaggatgatggacaagaccccttttcgcaagctcttgaagcttttgtatgggtggagccaacaagggtggagatgaattgctcacagacggtatactttaattaaaaatgtaagctctgtagttaggcagacctgtgtttaaatactctgtcattgggcctggtgcagtggctcatgcttgtaatcccagcactttgggaggctgagctgggtggatcaccagagatcaggagtttgagaccagcctggccaacatggygaaaccccaattctactaaaaatacacacacacaaaattagccaggcatggtggtgcatgccttgtagttccagctacttgggaggctgaggcaagagaatctcttgaacccaggaggcggaggttgccgtgagctgagatcatgccattgcactccagcctgggcgacagagcgagactctgtctgaaaaaagaaagaaaagaaaagaagagaagaaagaaagagagagagaggaaggaaggaaagaaggaaggaaggaaggaaggaaggaaggaaggaaggaaggaaggaagggaaag

SEQ ID NO: 28726 - DNA, 601 bp, Human
ataaaagctccgtgaggccaggcgcggtagctcacatctgtaatcccagcactttggaaggccgaggtgggtggatcacaaggctaggagttcaagaccagcctggccaacatggggaaaccccttctctactaaaaatacaaaaattagccgagcgtggtgacaggtgcctgtcatcccagctacttgggaggctgaggcagagaattgcttgaacctgggaggcagaagttgcagtgagccgagatcgcaccactgcactccagcctggggacagagcgagactccatctcaaaaaaaacaaaaaacaaaaaaccaaaaaaaggctccgtgagaggaaggagcaacagccgcatctggcagaaggcatcttggtgaggacatgacttaggtaaggtgacttttagaattccttaggtgggcctttctcagtggatgggggccttgtagcagtcattagcctggccctttctgtgcttacaagttagtgaagactggggaaacctcattaaaaatatataacaacttaaattaaatttggtctaaaactgcctccatacatagcaaactataacctaaattagtatgtaaacaaactgca

SEQ ID NO: 28727 - DNA, 601 bp, Human
caggagttccagcattgttcagactcaagacaatatgcattatggaatattagatctggaagggaagatcatcaaagatggcatcatcatttcccaaatgagaaaggggcaagcttttgcagagctctttctatgtgctagacattgggtaggcatcatctgtatgttattaaatccccatgaagcccctttagctgtgcaggtttttccagatttctggatgaagaattgagggtctagttggtaagtagcctgtcatacagggagggtgtgataagactgggactggagttaggtcttsgtcccttcaaaacctagggtcattgctggtttggttttataatcatgttgcctgtcttccaccacaaaggtttcaacaaaaagaaatccttctctggggtacacatattgattatgcagtagggtttgcagcctgagcctgtagagtgtccattggtaggattgaaacatgtttggacgtgtttggtgagcacgtaggatagacccaataggccaacaccagcaggatgatattggagagtcaagcattcttggagtggcaccccctttagtggagaatgagcctatgccaggagctggg

SEQ ID NO: 28728 - DNA, 601 bp, Human
tttttttttttttttttggagacagagtttcgcaatgttgcccaggctggagtgcagtggcgcgatctcagctcactgcaagctccgcctcctgggttcacgccattctcctgcctcacctcccgagtagctgggattacaggcacccaccaccacgcccggctaatttttttttattttagtagagatggggtttcaccatgttggccaggatggtcttgatctcctgaccttgtgatctgcccacctcccaaagtgctgggattacaggtgtgagccaccttgcccagcccccagggayaacttcttggttgggacccttgcttcattgctgggtggggagatgagttaataaaaatctagggcagtctatgttaagtacttaatcagaggccagatgcgtgctttactctctcctcgaattatctccttttcttgctttgcccattcaggtagatggtaccattattcttcttcttgtcatttaaacttgaaaggggtgatacatccttctctctcttgcccctgacattcctttgttcagacaggcaccaagtcctgcttatttcactctcaaaatgcctggcctctccactgcttc

SEQ ID NO: 28729 - DNA, 601 bp, Human
cttttggctgtttcctacagttcatgggttatatattttcatatatttcagcagacgttcattgactttgagaaggacctggtggcctgcattgagctcatcaaaaaggcagagaaatgctgctccccagggactacttcttttttttttttttttttttttggagacagagtttcgcaatgttgcccaggctggagtgcagtggcgcgatctcagctcactgcaagctccgcctcctgggttcacgccattctcctgcctcacctcccgagtagctgggattacaggcacccaccaccasgcccggctaatttttttttattttagtagagatggggtttcaccatgttggccaggatggtcttgatctcctgaccttgtgatctgcccacctcccaaagtgctgggattacaggtgtgagccaccttgcccagcccccagggacaacttcttggttgggacccttgcttcattgctgggtggggagatgagttaataaaaatctagggcagtctatgttaagtacttaatcagaggccagatgcgtgctttactctctcctcgaattatctccttttcttgctttgcccattcaggtag

SEQ ID NO: 28730 - DNA, 601 bp, Human
gatcaaaagacactggtctcagtctcagggtgaggctggaaacacagagatataaacttgggagctatggggtggccacgggcaagagaggtccaggaaacttatctgcctagcaaggacacaacagaggagagactcaacagcccatgaatcccagaggagctggagggaggctgcctggctccagagggctcttcactttctaattccaggtcctcatggcgtccaatgggcacttaatgatttgcattccttcagttgcctctgaagcctaaaaatgaacttcctcttaatgtgaaaagctgatttcatgtgcatttctgatacctgcaactgaaggagctttaagataatggctcaaatagcaaaagatctcaatcaactggattcagagcatctccattacctgctggacattttgccctttagtgacatattcattgccaaccttcacccttggacagcacaggcccttcagcatttctgcagaattcagtcccatcaggtatccggctttgtcagccactgaaggaagagaaaaaaatggcatcatgcaaaaacagtagctgctaaagtgtccagtcagcccctggcttctccc

SEQ ID NO: 28731 - DNA, 601 bp, Human
cgtggtggttcacgtctgtaatcccagtactttgggaggctgaggtgggtggatcacaaggtcaggagtttgagaccagcctggccaacatggtgaaaccccgtctctacaaaaaaaagaaaaaaaaaattatctgggcgtggtggcgggcacctgtagtcccaactattcaggaggtggaggcaggaggatcgcttgaacctgggaggtggaggttgcagtgagccgagactgcaccactgcactccagcctgggtgacagagcaagactccgtctcaaaaaaaaaaaaaaaaaaaaaarttaatatctattcctgttttcatattaacatccctccaagagccacactgctccatggttccgcctccttgggtctttgggtaagtcaaataggtaagaaatgccacagtccttactggggttccatcacattcttggagataactgagcccttggattttaatgacccgtaaacctctttaagtgtcagaacagatttaggacattcattctctttgcaaataggcattcagttatctatctgaaggcttgcagcctgggggctaggggccccaatctgtgagcagaaaagaatcagag

SEQ ID NO: 28732 - DNA, 601 bp, Human
gcgtggtggttcacgtctgtaatcccagtactttgggaggctgaggtgggtggatcacaaggtcaggagtttgagaccagcctggccaacatggtgaaaccccgtctctacaaaaaaaagaaaaaaaaaattatctgggcgtggtggcgggcacctgtagtcccaactattcaggaggtggaggcaggaggatcgcttgaacctgggaggtggaggttgcagtgagccgagactgcaccactgcactccagcctgggtgacagagcaagactccgtctcaaaaaaaaaaaaaaaaaaaaaagttaatatctattcctgttttcatattaacatccctccaagagccacactgctccatggttccgcctccttgggtctttgggtaagtcaaataggtaagaaatgccacagtccttactggggttccatcacattcttggagataactgagcccttggattttaatgacccgtaaacctctttaagtgtcagaacagatttaggacattcattctctttgcaaataggcattcagttatctatctgaaggcttgcagcctgggggctaggggccccaatctgtgagcagaaaagaatcaga

SEQ ID NO: 28733 - DNA, 601 bp, Human
gtccacggtgccggcatagtgcaccagcgagaagtgagcctcagccttgcctttggcaggcttgggcttctggaagttgttggattttccaagatgctggtcatacagcttgttcttgaaggaggtgtctgttgccttggggaacatgcactcctcttccaggatggagaagatgcccataggctggaaagaggataacagagtctacatataatagtgcatacccatgcttcatggtctggagaagccaaaaaaccttctttggtgctttcactctggtaccaggaatgctggcatgtaygctcggtgagagcaagactcttggtctgtttgggggatgaccagaaagtgctaggcatagagtatgtgcttaattaatatttgctgaacaaaagaatataggataaaattatgtgtgtataaacctagcatacttttttcaataggtgtacaaaaaagtaaagtttcatatatagccataaagtaatgtgagtaatattttgaacaataatgtcccaatttctcagtagccaccttaggaagatatactcattccaacatgagcagtgctcaaatattatgggaattcctttttaaaaag

SEQ ID NO: 28734 - DNA, 601 bp, Human
gactatcttggccactgagaggtcctgtttacctccatagagcccagtctcttacagaagaggaagaataagagcaggaggaagaaaaatggagctgaaagagaaacatcatactcagctgaagctcatgtctgattactggttcttcacaagcagctctgggttaggagtcattacatagaacatcccacagagggaaagaaatgatagaattttacctgtctctgcaccagcatagttggaaaaaaggaaggagagaagcttcagcgaagacttctggtacagccccaccacagtctcrttcagggggtccttgtttttgtccagccagccggcgatgttgtagtccacggtgccggcatagtgcaccagcgagaagtgagcctcagccttgcctttggcaggcttgggcttctggaagttgttggattttccaagatgctggtcatacagcttgttcttgaaggaggtgtctgttgccttggggaacatgcactcctcttccaggatggagaagatgcccataggctggaaagaggataacagagtctacatataatagtgcatacccatgcttcatggtctggagaagccaaaaaac

SEQ ID NO: 28735 - DNA, 601 bp, Human
gacaggatctctatgttgcccacactggtcttgaactcctggcctcaaatgatccttctgcctcagcgtcccaaagtgttgggattacaggtgtgagccaccacgcctggcccctgtgtaaccactctggaaaagagttcagaagttactcaaaattttgaacacagttatcatatgacccagcaactctactcctaggtaccgtatatatataccgtgtatacccaaaagaattgccaatatatgttcacatataaacttctatacaaatgttcatagcaacatcatgcacagtagccaraaagttcatcggctgatgaatgtgcagacaaaatgtgatatattcatacaatgaactattatttgtccataagaaagaacaaagtcctgatacatgctacaacagggccagaccttgagaacagtaacctgagagaaagaagccagacacaaaagagcatccagtatataattccattcacatgaaatgcccagataggcaaatctacagggacagaaagttgatgagtggttgccagaggctagggatagaaatctgctcatggggacaggcatgatggctcatgcctataatcccagc

SEQ ID NO: 28736 - DNA, 601 bp, Human
gcaccaccacttttggctaattattttattttatcttattttattttgttttagagacaggatctctatgttgcccacactggtcttgaactcctggcctcaaatgatccttctgcctcagcgtcccaaagtgttgggattacaggtgtgagccaccacgcctggcccctgtgtaaccactctggaaaagagttcagaagttactcaaaattttgaacacagttatcatatgacccagcaactctactcctaggtaccgtatatatataccgtgtatacccaaaagaattgccaatatatrttcacatataaacttctatacaaatgttcatagcaacatcatgcacagtagccaaaaagttcatcggctgatgaatgtgcagacaaaatgtgatatattcatacaatgaactattatttgtccataagaaagaacaaagtcctgatacatgctacaacagggccagaccttgagaacagtaacctgagagaaagaagccagacacaaaagagcatccagtatataattccattcacatgaaatgcccagataggcaaatctacagggacagaaagttgatgagtggttgccagaggctag

SEQ ID NO: 28737 - DNA, 601 bp, Human
ttgtgttacttatttatttgtttgagatagggtctcactctgtcatccgggctggagtacagtggcccaatcatggctcgctgcaatttcagccacccaatctcatgtgatcctcccagctcaggctcccaagtagctggactacaggtgtgcaccaccacttttggctaattattttattttatcttattttattttgttttagagacaggatctctatgttgcccacactggtcttgaactcctggcctcaaatgatccttctgcctcagcgtcccaaagtgttgggattacaggtgtragccaccacgcctggcccctgtgtaaccactctggaaaagagttcagaagttactcaaaattttgaacacagttatcatatgacccagcaactctactcctaggtaccgtatatatataccgtgtatacccaaaagaattgccaatatatgttcacatataaacttctatacaaatgttcatagcaacatcatgcacagtagccaaaaagttcatcggctgatgaatgtgcagacaaaatgtgatatattcatacaatgaactattatttgtccataagaaagaacaaagtcctgataca

SEQ ID NO: 28738 - DNA, 601 bp, Human
gcctctcaaagtgctgggattacaggcgtgagccaccgtgcctggcaatgtttgtagtttctttcatgaatttacctcctttcattctttaatccctgcttatctctaaagagtaagtaactgaaagtaataaaacggaattttctcaacaatattttataagttgatttctttttctttcctacaggaaacaacccaatttgccatcttaatttggagtctgctttttctgaatgactcaattttctctgatacttaatcaagatgcagccttgggggaaaatgtcatgtcccagtctcycccatgttcctttcccttcatcccactttgtccccggggtctagcatgactgtgtgtttggattggggaagggaaggcaggaaagtcgctttcccaaatccgcatccacacagggtcttatgttagagttgatgttatctctaggcgaggttatgcaatgtagttacagagacattgtgattagattcaaagaaaatgattttcatcattgaagtttacgcatgtgcccatttcctatttattacattccctggcccagaggacattaggctttcatttttaaaaaatgatctcattatc

SEQ ID NO: 28739 - DNA, 601 bp, Human
ttcaccatattggccaggctggtcttgaactcctgacctcaagggatccgcccaccttggcctctcaaagtgctgggattacaggcgtgagccaccgtgcctggcaatgtttgtagtttctttcatgaatttacctcctttcattctttaatccctgcttatctctaaagagtaagtaactgaaagtaataaaacggaattttctcaacaatattttataagttgatttctttttctttcctacaggaaacaacccaatttgccatcttaatttggagtctgctttttctgaatgactcarttttctctgatacttaatcaagatgcagccttgggggaaaatgtcatgtcccagtctctcccatgttcctttcccttcatcccactttgtccccggggtctagcatgactgtgtgtttggattggggaagggaaggcaggaaagtcgctttcccaaatccgcatccacacagggtcttatgttagagttgatgttatctctaggcgaggttatgcaatgtagttacagagacattgtgattagattcaaagaaaatgattttcatcattgaagtttacgcatgtgcccatttcctattta

SEQ ID NO: 28740 - DNA, 601 bp, Human
gagatgtttagtagagagtttcaccatattggccaggctggtcttgaactcctgacctcaagggatccgcccaccttggcctctcaaagtgctgggattacaggcgtgagccaccgtgcctggcaatgtttgtagtttctttcatgaatttacctcctttcattctttaatccctgcttatctctaaagagtaagtaactgaaagtaataaaacggaattttctcaacaatattttataagttgatttctttttctttcctacaggaaacaacccaatttgccatcttaatttggagtctrctttttctgaatgactcaattttctctgatacttaatcaagatgcagccttgggggaaaatgtcatgtcccagtctctcccatgttcctttcccttcatcccactttgtccccggggtctagcatgactgtgtgtttggattggggaagggaaggcaggaaagtcgctttcccaaatccgcatccacacagggtcttatgttagagttgatgttatctctaggcgaggttatgcaatgtagttacagagacattgtgattagattcaaagaaaatgattttcatcattgaagtttacgca

SEQ ID NO: 28741 - DNA, 601 bp, Human
ggctggagtgcaatggtgcaatcttggctcactgcaaccttcgtttcccaggtttaagcaattctcctgcctcagccccccaagtatctgggactacaggcgagcgtcaccatgcctggctaatttttgtatttttagtagagatgtttagtagagagtttcaccatattggccaggctggtcttgaactcctgacctcaagggatccgcccaccttggcctctcaaagtgctgggattacaggcgtgagccaccgtgcctggcaatgtttgtagtttctttcatgaatttacctcctttyattctttaatccctgcttatctctaaagagtaagtaactgaaagtaataaaacggaattttctcaacaatattttataagttgatttctttttctttcctacaggaaacaacccaatttgccatcttaatttggagtctgctttttctgaatgactcaattttctctgatacttaatcaagatgcagccttgggggaaaatgtcatgtcccagtctctcccatgttcctttcccttcatcccactttgtccccggggtctagcatgactgtgtgtttggattggggaagggaaggcagga

SEQ ID NO: 28742 - DNA, 601 bp, Human
aatggggtgggaatggggtgtggatagcatttaactgggagtataacttaaactctcagtagaaaaggggagtcctttcctttagaaatcagagctgaaagcaaactgaataatttgcaagattgagatgtccctcttaatgtttgtagtttcttttttttttttcattctttttgttgttgttgtttgtttgttttaagatggagtctcgctgcgatgcccaggctggagtgcaatggtgcaatcttggctcactgcaaccttcgtttcccaggtttaagcaattctcctgcctcagccycccaagtatctgggactacaggcgagcgtcaccatgcctggctaatttttgtatttttagtagagatgtttagtagagagtttcaccatattggccaggctggtcttgaactcctgacctcaagggatccgcccaccttggcctctcaaagtgctgggattacaggcgtgagccaccgtgcctggcaatgtttgtagtttctttcatgaatttacctcctttcattctttaatccctgcttatctctaaagagtaagtaactgaaagtaataaaacggaattttctcaacaatattttat

SEQ ID NO: 28743 - DNA, 601 bp, Human
tcccggggctagccattccaggagatggcaaaaaagcctcctgcaagcacgtctttcacatgcaaaccagccatccaaagcccttaacccccgacccctacctttatcaggctctcacagggctcttacactctgggccaatacttccctgtcctggtcacctcagggccccgggtaccggccaacttgagaaagtccctacattttgaagcctgctgaaaccattcaaacttggcaatgctgaacctgcttggcctgttcatgctacctcgcctgctccatcccatgggaatgaccctcraggctctggcctgtgatttctccttactcccccaaccccaaacctagctctggtgcttcccctcgtggccctctgtggcaggccccctcctcttgagcactgtgtctttttttttttttgagaaggagtctccctctgtcactgaggctggagtgcagtggtgcagtctcggctcactgcacccaccgcctcctgggtacaagcaattctgcttcagcctcccaagtagctgggattacaggcatgcaccaccacgccaggctaatttttgtatttttagttgagacagggtttcgccat

SEQ ID NO: 28744 - DNA, 601 bp, Human
tcatgtaaatgtaaacatttcatgtaacggtggccaccctattgaacagtgcagacatggggcatttaatcatttctgaaagtcctatcaggtggtgattctctagagaaaacatggttgagagcaaggagaaaatgtctcagacattcagagaactggccaggtgcagtggctcatgcctgtaatcaccgcacttgggaggtcgaggtgggtggatcacctgaggtcaggagttcaagaccagcctggccaacatggtgaaactccatctctactaaaaatacaaaaattagccgggcgwggtggcaggtgcctgtagtctcagctactcgggaggctgcgtcaagagaatcgcttgaacccaggaggcggaggttgcagtgagccgagattgtgccactgcactccaacctgggtgacagagcaagactcagtctcaaataaataaataaataaataaatacaataattaaaaaattcatagaaccgccgatgtggagagaaccttagcaatggtctaattcgactcccatgagctctcagatgatgattctgagtggttaagatcccagctatgctgtttactagcttcgcggacttg

SEQ ID NO: 28745 - DNA, 601 bp, Human
ggctgcaaaagctgcagagtgagtacagggtgcacttgggcttcccatgggataacccgagatgtcttcttgcatctacacaaagatggggatggaaaaatctgcaggctgtggctgcagaagagtaacccagcaaagaagaggaggccggctgggcgcggtggctcatgcctataatcccagcactttgggaggccgaggtgggtgtatcgcctgaggtcaggagctcgagaccagcctggccaacatggtgaaacccagtctctacagaaaaatacaaaaattagccagatgtggtggyacacacttgtaatcccagctacttgggaggctgaggcagcagaatcacttgaacacaggaggcgggggttgcagtgagctgagattgagccactgcactccagtctaggcaagaagagtgaaactgcacctcaaaaaaaaaaaaagaagaggccgtgggaggggacccagaagggggttgaaggtagggcggcggtcatctgctgaccactcagcccctgctataggaattgggggagaaatggagcttggctggaaggagaggagctagaggggcaagcccctttggggaggtaatgtg

SEQ ID NO: 28746 - DNA, 601 bp, Human
ggtctagagtcacaatcaggctagagggtctgggatctgaatttggaaccacttgggctggcccactcactgtgggcatgggatcagttcctctagcaagagatgaagtctgtggaaactctgggggacttgggagctcaccaaatacccaggtcaagaaatgtcttagggaaatgcaaaaggtgccctcggaaggagagagatgcacaggagagagggaacctaccgctgcttgaagtcagcatagaggatccggctggggaatcccttcctgcaaatccggatgccctcgaggaccccrttacagcgcagctggtgcatgaccaagtagtggtccatcacacctggagagagaacgtcccgggggtgtgcctgtgaccccttcatttgttgttgatggtctgaggcaccatgagaccctccaacacatccacacttgagtgggagagtcagtgagtgggagagtcagtgccagctccaaggtagagggctgggggtggctagagcctgcctgcaggtcccgcagtgaaataatcccaccctcttggggagatgctagcaccccataaccgtggcagtaagagccaaagcattgtgcttt

SEQ ID NO: 28747 - DNA, 601 bp, Human
catcctggacaaggcccggacttgtgcaacccaatggtggctcagaggagagagttagtctagagctgcgggcctcagctgggtgtgatttggcaatgtctagagagttttgattgtcacagctcagtggggaggggtgtggtttgctaccacatctcttgagtagagggcagggttactgctaaaatcctcccacacccagcacagcctccacaataaaggatgatctagcctgagtgtccatagtacagaagttgagacatcctggtctagagtcacaatcaggctagagggtctgggmtctgaatttggaaccacttgggctggcccactcactgtgggcatgggatcagttcctctagcaagagatgaagtctgtggaaactctgggggacttgggagctcaccaaatacccaggtcaagaaatgtcttagggaaatgcaaaaggtgccctcggaaggagagagatgcacaggagagagggaacctaccgctgcttgaagtcagcatagaggatccggctggggaatcccttcctgcaaatccggatgccctcgaggaccccattacagcgcagctggtgcatgaccaagtagtggt

SEQ ID NO: 28748 - DNA, 601 bp, Human
atctgggaaggttggtcccacgctcaggcccactttgcccactccctccataacattccagggaaactaagcaccctctggggccagcaggctcttccttgctggagacccccagcctgcccgtttctgagatgtggatctttggaggcaggccaggatttgaagctgacctttgccacttactatctatccatgtgtgaccttgagtaagtttctcgacctcccaagaacctgatgagtaagtgccacccttatcaccatcactcccacctcgctggttagtgaggagtcagtgaagtaygtgcaggaggcttctcacagggctgatactcacgtgctcaataaatggcagctagtttgtctttgtttttgtttttttgagacagggcttcactttgttgcccaggctggagtgcagtagtatgatcaatcgcactgcagcctccatctcctggcctcaagaaatcctacttcagcctcccaaaagcatgggattaaaggcatgaaccactgcgccccgcttggtagctgattttattgtttatagtcattctcctcaaggcctcagtgtccctggagtcctctctatgttctcctctct

SEQ ID NO: 28749 - DNA, 601 bp, Human
agtgccctgcctgagggcgtccgtgacctcctaatgctcaatgcaaggaatagctttcattcctattctattgggtctttctcccatgtttgatgtattaatcagctcttaacttttgaaactttctctgccttaaattccatccacattttccctgtttcactgtattttgccatatggggttcctcttcctgctggagaaacccaggacttgtccttggtcatttcccagtctcttgccctggtagagttgatctgtcttcccaatttctttcttttctattcgtttttttttttttttgagatggagtcttgctctgttgcccaagctagagtgcaatggtgcaatctcggctcactgcaacctccgcctcctaggttcaagcaattcttctggctcagcctcccaagtagctgggattacaggtatgcgccaccacgcctggctaatttttgtatttttagtaaagactgggtttcaccatgttggtcaggctggtcttgaactcctgacctcaggtgatctgcccgccttggcctcccaaagtgctagggttacaagcgtgagccaccacaaccagcctgtattcctaatttctac

SEQ ID NO: 28750 - DNA, 601 bp, Human
ttggaggtcattcttctcctgcaggagggagaccattttctcctccagctccttccggcgagcctcagatcgggccagttcttccttggtcctctcaaagtcttccttcatggtggccatctccttctcggcctctgcactcttcagcaggggcttgattttgaagaacaggttcatccagggccagtgcttgacgttcataaaagagcggatgttgtactggatgcagaagatggagtccctgtacacccattaggactcaaattaataaatccagcaaggtctggtctctgcacccccmacctgtccccgacggaccccatcctccgtctttctcggttaggtgggaaggaggtgcagccaagcttggcagatcctctggatccagagtaggtctgcaaatgaggggcagaggaaacagaggtacgtgcacaggttggaaggtaggagagggcgtggagctacctgcgggctcctggtcacctggctgcccttcccaccaccctactgagagtgccctgcctgagggcgtccgtgacctcctaatgctcaatgcaaggaatagctttcattcctattctattgggtctttctcccatgt

SEQ ID NO: 28751 - DNA, 601 bp, Human
aatgttcctcccccttttctgtcctccagagtctgtgttttgcgttctcaagtagaaggtacttacagactggacctgcaattggaggtcattcttctcctgcaggagggagaccattttctcctccagctccttccggcgagcctcagatcgggccagttcttccttggtcctctcaaagtcttccttcatggtggccatctccttctcggcctctgcactcttcagcaggggcttgattttgaagaacaggttcatccagggccagtgcttgacgttcataaaagagcggatgttgtaytggatgcagaagatggagtccctgtacacccattaggactcaaattaataaatccagcaaggtctggtctctgcaccccccacctgtccccgacggaccccatcctccgtctttctcggttaggtgggaaggaggtgcagccaagcttggcagatcctctggatccagagtaggtctgcaaatgaggggcagaggaaacagaggtacgtgcacaggttggaaggtaggagagggcgtggagctacctgcgggctcctggtcacctggctgcccttcccaccaccctactgagagtgccct

SEQ ID NO: 28752 - DNA, 601 bp, Human
caagtagctgggactacaggcgcccgccactacgcccggctaattttttgtatttttagtagagacggggtttcaccgttttagccgggatggtctcgatctcctgacctcgtgatcctcccgcctcggcctcccaaagtgctgggattacaggcgtgagccaccgcgcccggccgcctgctagtttttaaaaatttttttacagagatggggttttgccatgatacccaggctggtcttgaactcctgggctcaagcgatcctcccacctcagcctcccaaagtgttgggcttacaggcrtgagctaccacgcccggcctaaagcactttttacatattattgtaaataatatatagaaaattactcttgctactttgaattgggttatttaattttgattatttttatttttattgatttttaaaagctgtggtgcatatacatatgacacatatatatccctcatgcccacagcaaaatatatctaactctgcgatgacggggagaaatcagggagagcacaaattctctttgcagacataatttccggcattcactgctttgctaagcccgggaccaggcatccttttacgagcaag

SEQ ID NO: 28753 - DNA, 601 bp, Human
tctgtataaaaacaaaaggtaaaagtatttggggatttattaaaaagggaaaattataaatgccttcactctgtgaaagagacaattatactgccccatttcttttctttttctttctttctttcttttttctttttttttgagacggagtcttgctctgttgtcaggctggagtgcagtggcacgatctcggctcactgcaacctccacctcctgggttcaagtgattctcctgcctcagcctcctgagtagctggcactaccagcgtgtgccaccacacctggctaattttttttttttgtatttttagtagagacggagtttcaccatgttagccaagatggccttaatctcctgaccttgtgatctgcccgcctcggtctcccacagtgctgggattacaggtgtgagccaccgtgtccagcctatactgccccatttctttgataaaactatgtatctttaaagcactttttttttttgagatcggggtctcactgtgttgcccaggctggagtgcagtggcatgttctcagctcactgcaacctcgactacctgggctcaggtgatcctcccacctcagccttctgagtatcttg

SEQ ID NO: 28754 - DNA, 601 bp, Human
aaacacccaagaattcgtgattgaatacatatgtcccagaagatgctgcagtgagtctcttggacagaccaagatcagctacttctgttctaaatcgggctatatcttcccatataagaatatttatttatatatttgtttatttattgagacggagtctcactctgttgccaggctggagtgcagtggcgcgatctcggctcactgcaacctctgcctcctgggttcaagtgattctcctgcctcagcctcctgagtagctgggactacaggtgcccaccaccacgcccagctaattttkgtatttttagaagagagggggtttcaccatgttggccaggatggtttcgatctcttgatctcatgatccgcccgcctcggcctcccaaagtgctgggattacaggcgtgagccaccacgcccggcccatataagagtattttaagacacacactgcagggtaatgcatgggaggagactggcaagcctgcatgctaatgtttgctgaacatctataaacatgagctgtgtgccaggcattttacaggcattaaccactctgatttttcaatagctggatgaggtgagtactctgactatg

SEQ ID NO: 28755 - DNA, 601 bp, Human
agaacagaaaattaaaaacacccaagaattcgtgattgaatacatatgtcccagaagatgctgcagtgagtctcttggacagaccaagatcagctacttctgttctaaatcgggctatatcttcccatataagaatatttatttatatatttgtttatttattgagacggagtctcactctgttgccaggctggagtgcagtggcgcgatctcggctcactgcaacctctgcctcctgggttcaagtgattctcctgcctcagcctcctgagtagctgggactacaggtgcccaccaccaygcccagctaattttggtatttttagaagagagggggtttcaccatgttggccaggatggtttcgatctcttgatctcatgatccgcccgcctcggcctcccaaagtgctgggattacaggcgtgagccaccacgcccggcccatataagagtattttaagacacacactgcagggtaatgcatgggaggagactggcaagcctgcatgctaatgtttgctgaacatctataaacatgagctgtgtgccaggcattttacaggcattaaccactctgatttttcaatagctggatgaggtg

SEQ ID NO: 28756 - DNA, 601 bp, Human
gagtgtagcggcatgatctttgctcactgcaacctctgcctcccaggttctagcgattccctgcctcagcctcccgagttgctgggattacaggcatgtgctaccatgcctggctaatctttgtatttttttgtagagatgggatttcaccatgttggccaggctggtctccaaacgcctgacctcaggtgatccttccgcctcggcctcccaaagtgctgggattacaggcatgagtcactgcacctggtccatatacatgttttttttttttttttttttttttttttaactagcaagracattgcttatagaaatttgcatataataatttgttcatttatttctttagagacaagggcttgctctgttgcccaagctaaagtgcagtggtgtgagtgtagcccactgcatcctcacactcctgtgctcaagtgatcctcccacctcagcctcccaagtagctggaactacaaggtatgtgccaccatgactggcttcttttttggtgtgtgtacagatggggcctccatgtgtttcccagcttgtctcaaactttgagcctcaagtgatcctcctgcctcagcctcccaaagtgctg

SEQ ID NO: 28757 - DNA, 601 bp, Human
caccgttcctcagcgtccatcagattttctgtttcctgaaagaaccaggtcattttatgttttgattggcctctttgaaaatgctacaaagaaagggtatcaccctctaaaagcttattatctacacctaagccaagaaatgggtcatgcacacacatgcatgcacatgtgcacacactgcacacacacgtgtacataaacttagatatcacccataaacacattttttctttttagatggagtttctctctgtggcccaggctggagtgtagcggcatgatctttgctcactgcaacctytgcctcccaggttctagcgattccctgcctcagcctcccgagttgctgggattacaggcatgtgctaccatgcctggctaatctttgtatttttttgtagagatgggatttcaccatgttggccaggctggtctccaaacgcctgacctcaggtgatccttccgcctcggcctcccaaagtgctgggattacaggcatgagtcactgcacctggtccatatacatgttttttttttttttttttttttttttttaactagcaagaacattgcttatagaaatttgcatataataatttgt

SEQ ID NO: 28758 - DNA, 601 bp, Human
tcactctgtcgcccaggctggagtgcagtggcgcagtctcagctcactgcaagctccgcctcccgggttcacgccattctccggcctcagcctcctgagtagctgggactacaggcgtccgccaccacgcccggctaattttttgtatttttagtagagacggggtttcaccatgttagccaggatggtctcgatctcctgacctcgtggtctgcccaccttggcctcccaaagtgctgggattacaggcataagccaccgcacctggccctatatttcattttcttacatttttccaccrtttagcagtaggtatttaatatttggtgtgcacacgccattgctcctaatggctacgtagtgctccctgctgtgttatctactacattttagttctccgttttccccgtggtggaccctggcactgcctccagctgtctcccgcaagcaatgccactacaaacaccctaggacatgtcgccttatggacaggtggaagaattccttgatctatacacccaggagcagaattgctgggtcgtagggtatctggattcttaatttgactgagtaattccaaataactttcccaaaggctgca

SEQ ID NO: 28759 - DNA, 601 bp, Human
gggcgcttttaaaatgcaaatgtgctacctctgaagggtaaaacatcaatctatattcgctcataatatgtctgtggaaatgtgtttgttaggttggctgaatagggtttagaatgaggcaggaaggggaggagaggcgtgaggtcctacgcaagaaaattcacgccgggcgcggtggctcacgcctgtaatcccagcactttgggaggccgaggcggacggatcatgaggtcaggagatcgagaccatcctgactaacatcgtgaaacctcgtctctactaaaaatacaaaaaaaaaaaattagccaggcatggtggtgggcacctgtagtcccagctactcaggaggctgaaacaggagaatcgcttgaaaacaggaggcagaggttgcagtgagctgagattgcaccactgcactctagcctggtgacagagcgagactccgtctcaaaaataaagacagaaagaaagaaagaaaattcagaacgggagtgctgtgttatcaggaagcaggaggagggcacccaacacggaacttgaaggaagtaagtgaaacctttttccacatccaacaggcttccagatcagaagttgctaactc

SEQ ID NO: 28760 - DNA, 601 bp, Human
ggaggggcgctcttgcaaagggattgtcatgattgggaaggttttgatgcttttacttgcagttctttaatcttcttttgaaactgcaaactgtggacttgttcgtcatctattttggcttgtaactgactgagttcaaactccttcctgcaaatagattaaaaaaaaataaagaacatgaaatacaagcctcttggagggggtgaaagttggcttttaggctgagacacagaggtggtaaaagaaatatctactttttcaatttctcttctatttgctgcttgtcattttctagatccayaatggattcctgggacattttcagatctccttccagcttcctcttcgccctttccaagtccgcccgcagtttcttctcctgctctaaggaaccctcaagctgagaagacacacaggtagaaaattaagcccctgctggggaagtgtttgccccgtttatccagtgtagccatacacgtggcctggggcttcctggggctcctgtagggtgctggctgcaagcctctggccccaggaggaagcaagtcttgcccctacctcccctctcttctgtcttccagaaaagactacccagggtggg

SEQ ID NO: 28761 - DNA, 601 bp, Human
tatgtttatgggttattcagaacattaaaatattattttcaaaaactaaaggaaatgacaggacatcttctctagctttagcaggaggaaggaaagaagcagctaaagaaacaagggggaaggagtgaggaggggcgctcttgcaaagggattgtcatgattgggaaggttttgatgcttttacttgcagttctttaatcttcttttgaaactgcaaactgtggacttgttcgtcatctattttggcttgtaactgactgagttcaaactccttcctgcaaatagattaaaaaaaaataargaacatgaaatacaagcctcttggagggggtgaaagttggcttttaggctgagacacagaggtggtaaaagaaatatctactttttcaatttctcttctatttgctgcttgtcattttctagatccataatggattcctgggacattttcagatctccttccagcttcctcttcgccctttccaagtccgcccgcagtttcttctcctgctctaaggaaccctcaagctgagaagacacacaggtagaaaattaagcccctgctggggaagtgtttgccccgtttatccagtgtagccat

SEQ ID NO: 28762 - DNA, 601 bp, Human
gaagtatgtttatgggttattcagaacattaaaatattattttcaaaaactaaaggaaatgacaggacatcttctctagctttagcaggaggaaggaaagaagcagctaaagaaacaagggggaaggagtgaggaggggcgctcttgcaaagggattgtcatgattgggaaggttttgatgcttttacttgcagttctttaatcttcttttgaaactgcaaactgtggacttgttcgtcatctattttggcttgtaactgactgagttcaaactccttcctgcaaatagattaaaaaaaaataaagaacatgaaatacaagcctcttggagggggtgaaagttggcttttaggctgagacacagaggtggtaaaagaaatatctactttttcaatttctcttctatttgctgcttgtcattttctagatccataatggattcctgggacattttcagatctccttccagcttcctcttcgccctttccaagtccgcccgcagtttcttctcctgctctaaggaaccctcaagctgagaagacacacaggtagaaaattaagcccctgctggggaagtgtttgccccgtttatccagtgtag

SEQ ID NO: 28763 - DNA, 601 bp, Human
tacaaaaacacatagcaaaagaggcagaaagatgcacatcccagtgaaattggcaattaattctcagaagacggggagggcactgggcttagggatggcgatcaaagcacccttaacaataatatttagctttactgggcctattttgagcctttgcaaggaagtatgtttatgggttattcagaacattaaaatattattttcaaaaactaaaggaaatgacaggacatcttctctagctttagcaggaggaaggaaagaagcagctaaagaaacaagggggaaggagtgaggaggggcrctcttgcaaagggattgtcatgattgggaaggttttgatgcttttacttgcagttctttaatcttcttttgaaactgcaaactgtggacttgttcgtcatctattttggcttgtaactgactgagttcaaactccttcctgcaaatagattaaaaaaaaataaagaacatgaaatacaagcctcttggagggggtgaaagttggcttttaggctgagacacagaggtggtaaaagaaatatctactttttcaatttctcttctatttgctgcttgtcattttctagatccataatggatt

SEQ ID NO: 28764 - DNA, 601 bp, Human
ttgtgatggagacttgttctagaagtctatggagcaggtagacacaaatccacgtctatcatggatagctctgcagatcatgttgccaaaagaaaggagcaaattgcagagtgatactctcagtgtgatatgctaagaatatgaagaaacaagaaccttttctgcatgtgtactatatattttttggggagtcttaaatgtgtacaaaaacacatagcaaaagaggcagaaagatgcacatcccagtgaaattggcaattaattctcagaagacggggagggcactgggcttagggatggygatcaaagcacccttaacaataatatttagctttactgggcctattttgagcctttgcaaggaagtatgtttatgggttattcagaacattaaaatattattttcaaaaactaaaggaaatgacaggacatcttctctagctttagcaggaggaaggaaagaagcagctaaagaaacaagggggaaggagtgaggaggggcgctcttgcaaagggattgtcatgattgggaaggttttgatgcttttacttgcagttctttaatcttcttttgaaactgcaaactgtggacttgttcgtc

SEQ ID NO: 28765 - DNA, 601 bp, Human
ccagcctggccaacatggtgaaaccccaactctaccaaaaatacaaaaattagccaggcctggtggcgtgtgcctgtaatcccagctacttgggaggctgaggcaggagaattgcttgaacctgggaggtagaggttgcagtgagctgagatggcgccactgcaatccagcctggggaacaagagcgaaacagtggtgccagatcatccaattgtgcttgaatcaagtgatcttgatgctttggtctgaaagtttgtgtccccccaaaattcataatttccagtccagtggtgttgggggrtggggcttttgggaggtgataaggtcgtgggggtggagcccttatgaatgggattagtgttcttataatagaggcctgagagaacttgttcaccccttctaccacatgaggatgcaatgagaaggcaccatctgtgaggaacaggcctccgacagacaccgaatttgctggcactttgatcttggacttcccagcctccaaaattgtgagtgataaatttctgttgtttataaattacccagtctaaaatattttgttacagaagcacaaatggataagacaaaggacgtgagtaaattt

SEQ ID NO: 28766 - DNA, 601 bp, Human
gagtgggggctgtttataggcatagtgtatgggggatgctggaggcccttcctacccagctacccctgcaggctggcctggctcgccgagagagaggtgtgggaggggaacatttacagaaccaagttcttagaggaagaaagaaaaccaagggaaaaagggcaaacacatgggaaagcaggaaagaaagagaaaaggagtcatcagccggagccagaggctgcagtcgcggagtgaagaagcaatcaaggaggcacagggctgcgtggacgcagaccctaaacactggcagcagggggcrctggagagaccactctagttctctgattcatatctcccttccttttctggacagatgccctgaccttccgggaaaccctcggtgagaggcccacagcctcgcttctagggtcaccactgcttcttccagtctagccaaacagctcctagtacagctcagagcaccctgcaaggagggcacgtgttaaatcgaggagcacacatgctccacgaggaattctttgctttgaggccatgcacagaggtgggttcactatgaagcttgtgaaataagcttcagggcccgcatttgcatgggcca

SEQ ID NO: 28767 - DNA, 601 bp, Human
gtatttttgtgaagtttgttcaaaacccttgtgtgtgttgacctttctctcctcctgctgctccataaaatagaaaataaaatgtatagagcatatgtttttctttagaatggtaagtatgagatggcagtggaggaagcagggacactaattccacgggcgtcctggaggagcttaggatctctttgagaagatgacacgcaaacatgaaggaatcaaagcagggagagttgaaacgcgatggcagcttgcaaggagaatcgtcaaaggggacaactgaaaaagcgttaagagacatgamgtgctgcttcccctggatgttaaaattgagaacagagagcagcacacggcaattctggagatagggaggctggagtgggggctgtttataggcatagtgtatgggggatgctggaggcccttcctacccagctacccctgcaggctggcctggctcgccgagagagaggtgtgggaggggaacatttacagaaccaagttcttagaggaagaaagaaaaccaagggaaaaagggcaaacacatgggaaagcaggaaagaaagagaaaaggagtcatcagccggagccagaggctgcagtc

SEQ ID NO: 28768 - DNA, 601 bp, Human
agccttggcggcaagagtgaaactccgtctcaaaaaaaaaaatcataattatttcagatttgtgaatgcagctcaatcaccaatcacttggaacatcaggtagataagtatttaatgatttgtaaacaaccctttgagaagatgtcacttttaagtggatctttgggatcctcttgtaatataagtgattcgtgaataattgcaagcaatacaagcctgtgaatatttgcaagcaatatattcagatgacagtgttaagcatttcattcaataacacagaaggttccccatggtgcaggcmgtatgaagagattcacctctctggcttccagttggcctgtatttttgtgaagtttgttcaaaacccttgtgtgtgttgacctttctctcctcctgctgctccataaaatagaaaataaaatgtatagagcatatgtttttctttagaatggtaagtatgagatggcagtggaggaagcagggacactaattccacgggcgtcctggaggagcttaggatctctttgagaagatgacacgcaaacatgaaggaatcaaagcagggagagttgaaacgcgatggcagcttgcaaggagaatc

SEQ ID NO: 28769 - DNA, 601 bp, Human
cataatcggccaggcgcagtggctcacgcctataatcccagcactttgggaggccgaggagggtggatcacctgaggtcaggagtttgagactagcctgaccaacatggtgaaaccttatctctactaaaaatacagaaattagccaggcgtggtggtgcatgcctgtaatcccagctactcgggaggctgaggcaggagaatcgcttgaactcgggaggcggaggttgcagtgagccgagatcatgccattgcactctagccttggcggcaagagtgaaactccgtctcaaaaaaaaaaatcataattatttcagatttgtgaatgcagctcaatcaccaatcacttggaacatcaggtagataagtatttaatgatttgtaaacaaccctttgagaagatgtcacttttaagtggatctttgggatcctcttgtaatataagtgattcgtgaataattgcaagcaatacaagcctgtgaatatttgcaagcaatatattcagatgacagtgttaagcatttcattcaataacacagaaggttccccatggtgcaggccgtatgaagagattcacctctctggcttccagttggcctgta

SEQ ID NO: 28770 - DNA, 601 bp, Human
ggctggacccagagccctgcccattctcaccattttgggtctgcagtcttgctttctgcatgttcagatcatggatcaactgtgtctgttgctcgtccttggctttgatttcactaaattgatcttctaccgtccggcacgttctttctatgttactctttaacaaacagaaagtcaacatgaatgggaagaaatggattcctagtgcccagcattgaactgaacagtgtaatcatttagtttcttgtcaggtaaaataaaaataaaagtacagaacaaaaaaaagttcagtttcaaaaaratcataatcggccaggcgcagtggctcacgcctataatcccagcactttgggaggccgaggagggtggatcacctgaggtcaggagtttgagactagcctgaccaacatggtgaaaccttatctctactaaaaatacagaaattagccaggcgtggtggtgcatgcctgtaatcccagctactcgggaggctgaggcaggagaatcgcttgaactcgggaggcggaggttgcagtgagccgagatcatgccattgcactctagccttggcggcaagagtgaaactccgtctcaaaaaaaa

SEQ ID NO: 28771 - DNA, 601 bp, Human
gcttgcttttggtcagctgtgaaatcagagactccttctcttccactcggtggctcagctcccctaccaaacagatgtggcccccacgtcagtgttactgaccaccctctcccatggcccggctggacccagagccctgcccattctcaccattttgggtctgcagtcttgctttctgcatgttcagatcatggatcaactgtgtctgttgctcgtccttggctttgatttcactaaattgatcttctaccgtccggcacgttctttctatgttactctttaacaaacagaaagtcaacaygaatgggaagaaatggattcctagtgcccagcattgaactgaacagtgtaatcatttagtttcttgtcaggtaaaataaaaataaaagtacagaacaaaaaaaagttcagtttcaaaaaaatcataatcggccaggcgcagtggctcacgcctataatcccagcactttgggaggccgaggagggtggatcacctgaggtcaggagtttgagactagcctgaccaacatggtgaaaccttatctctactaaaaatacagaaattagccaggcgtggtggtgcatgcctgtaatcccagct

SEQ ID NO: 28772 - DNA, 601 bp, Human
ctgaggccaggagtttgagaccagcctgatcaacatggagaaaccctgtcactactaaaaatacaaaaccgggcatggtggcacatgcacgtaatcccagctacttgggaggctgaggcaggagaatcacttgaacccaggaggcagaggttgtggtgagccaagatcgagccattgcactccagcctgggcaacaagagtgaaactccatctcaaaaaaaaaaaaaaaggcaataaatgacacactttgcctaagaaggaaaactcagctgttgctgtattcttgccaaaggacagcccrctcctgcagtggctcttctcagtacttgttcaggcttgggttctcaccacttcccctttcccctcatctaccaaagatctttaccatacaacagaaagatgggagacaaatatggcgcttgtcctttttcagaagaaaaaggtggagcttgggaaaattccaaaagattgccctataagtcttagccagcgtacagcaacctcggaattccattcatgcagttttttggactcttagtcccctattctgatacttgaatatgaattggcagcaccaagtacctactgtgtgcactgttct

SEQ ID NO: 28773 - DNA, 601 bp, Human
ccataagtgcaatggaaataaagcaatgttatcatgtctagctaggtactgttgcctgctgggactccatgcctggggtctaccctctatttcttaatagggtaaataagcaaatgctaaggaagtgtggttcacactgaggccttttccttgatataatcagaaggattggaacaattaaaaagggaataattttctcactacttgatgcaatggtatggaatgctgtgaccaggagaagcctgaaagcatcttttgatgtcaccactgggctatgtccccacactggggattgctgatrtgagcttcgctgtttccacggctggacttcctcctcctaggcagagaagacatgcctagaggcctccatccctcactccctcccattggagggatgtaagggcaacagtttagctccgactataatggccacaagacgccctctggtgccaccatcaaagagagagttctgtcagcccacttcagtaatttgtacattttcatctttttaaaaatgcaatagaccaagcgtggtggctcatgcctgtaatcctagcagtttgggaggccgagatgggcggatcacctgaggccaggagtt

SEQ ID NO: 28774 - DNA, 601 bp, Human
ggggaggatccaagtgtcaccgagagattctcaaaatgcttggtggcaaagcaggtccctaaggagcacctccagggagctaggtggaatggacagttcccgagaagaaggacagggagacccccagagggtggggggtacaatccgagtgtttcagaaaccacaaaggcgtgggcaggaaagaatctctcaagatatgaagactcctggtcccttggcttgtgtcctcgggccccctctgctattgccaccctggagcccctacttggcctcctccagctcctctgtgcgctgaatggcrtccgtctcgtatttggtcctccactgggcaacctcactgttggccttggacagcgccctctgcagctcggccttggcttcctgctcctcctcatactgttcccgcagcaggtcacagtcgtggcgggaggactgcagggcgtgcgccatggcgttcttggcctgggaatgacagcagtgacaaattgcaaaaacatttgacccttttccaagttcaggtattttcatttaaatcgctttcccccaacttgaattatccctatgctgtcttcaccaattttgccatatcagcatatcacct

SEQ ID NO: 28775 - DNA, 601 bp, Human
gggaagagaaatgaatagcgtggaagggactggtgtttgatgagaccaagacctaggatttggtgagtggggaggatccaagtgtcaccgagagattctcaaaatgcttggtggcaaagcaggtccctaaggagcacctccagggagctaggtggaatggacagttcccgagaagaaggacagggagacccccagagggtggggggtacaatccgagtgtttcagaaaccacaaaggcgtgggcaggaaagaatctctcaagatatgaagactcctggtcccttggcttgtgtcctcgggmcccctctgctattgccaccctggagcccctacttggcctcctccagctcctctgtgcgctgaatggcgtccgtctcgtatttggtcctccactgggcaacctcactgttggccttggacagcgccctctgcagctcggccttggcttcctgctcctcctcatactgttcccgcagcaggtcacagtcgtggcgggaggactgcagggcgtgcgccatggcgttcttggcctgggaatgacagcagtgacaaattgcaaaaacatttgacccttttccaagttcaggtattttcatttaaa

SEQ ID NO: 28776 - DNA, 601 bp, Human
cagccatcctgaccaccaccgattactgcatcaggagatgctgggtgtgtttggattatacaggattcttgatagccaaaaatgattgtctgtgcctctatgttaaacataactgagagattctgcgctgctctcaggatgttaggtgattgattttctgcttcctgagaggaagacattgaagaacataatgaacacatttatttattttcaaaggggaactgtgccagagaacgcctaggagataaagtagcagcccgtggatgtttcagcccctgggatggctgaatgttactcccartggagactcagggtctcctggcaggaaaggccccatggggtggtgaagggcagcctctttcagttccctgtcctcctgaatttctgaatgtcatatcctagacacttacctccacttcttctaaggcgacctgcagatctgacttttcctgctccactagcttcttggtcttttccgcttcctgaagattcttgccagtttctgcaatctgctcagttaagtcggaaatctcttctgcaaaggacaggcttgatttaggctgtttcaacaggctccagtttatagtataggcatttgcca

SEQ ID NO: 28777 - DNA, 601 bp, Human
tgaagagaacaatattcagagaggtctgagtatttggcttgctcccaaatatccctaatagtgatgaaactgggactaaaactttgcatcgctcatgaacaaattattttatgacttgagatagagtatctttcttaattagtgaaaattttattgagggtatctattataatagtgaccataaatcaggagtcaacctattctctaaaatgacagggcaactgctctcctgttatcctgtgtcggttcgtatttccctagaaaccaccagccatcctgaccaccaccgattactgcatcrggagatgctgggtgtgtttggattatacaggattcttgatagccaaaaatgattgtctgtgcctctatgttaaacataactgagagattctgcgctgctctcaggatgttaggtgattgattttctgcttcctgagaggaagacattgaagaacataatgaacacatttatttattttcaaaggggaactgtgccagagaacgcctaggagataaagtagcagcccgtggatgtttcagcccctgggatggctgaatgttactcccaatggagactcagggtctcctggcaggaaaggcc

SEQ ID NO: 28778 - DNA, 601 bp, Human
caaggaaccctgacgaaagcaaaggagtgattgagagtgccgtggacatccaccttcatgaatgggtattttcatccccatacgatcaaatgggtatgcgtttttttaaaaaaattaaatttaaatttttttttttttttggtagagacagggtctgtgttgcccaggctggtcctgaactcctgggctccagtgatcctctctccttggcctcctaaagtgttgggattacaggtgtgagccatggtgcccagagcccaaataggttttgtgtttttttttttttttggacagagtctcrttctgttgcccaggctggagtgcagtggcacaatctcggctcaatgcaacctccaccccctgggttcaagcgattctcctgcctcagcctcccgagtagttgggattacaggtgcccaccactgtgcctggctaattttcgtatttttggtaaagacagggtttcaccatgttgcctaggctggtctcgaactcctgaccttccaggtgatctgcctgcctcggcctcccaaagtactaggattacagttgtgagccaccatgcccggctgcaaataggtattcttatacccattttata

SEQ ID NO: 28779 - DNA, 601 bp, Human
gcaggaggccattcctgcgctccacgatggccagctgctccttgaggtcctcattgctcctcagggcgtcatcgagatgcagctgggagtcctgcaggggagacccagagtgaggccagagccgcctggcaggctggggcccgtccaggtacgcagaggcggccaccgtgctcaccttgagctggccctggaccgtgcgcagatgcttctgggtctctgccatctggcggttggagtggcccagctgaatctccatctcattaaggtctccctccatcttcttctttagcctcagggcgtsgttccggctgcggatttcagcatccagcacgctctgcagggcctctgctgcccgctggctgtttctttttagctgctcgatttcttcatccttctcaatgaccttgcggtctagctcggatttcacctggctcagctctagctgcacgcgcaagatcttgctctcctcgtgttccaaggaaccctgacgaaagcaaaggagtgattgagagtgccgtggacatccaccttcatgaatgggtattttcatccccatacgatcaaatgggtatgcgtttttttaaaaaaattaaatttaaat

SEQ ID NO: 28780 - DNA, 601 bp, Human
agagattgcagtgaactgagatcgcaccactgcactccagcctggcgacagaaagagactctgctctgtctcaaaaaaaaaaaaaaaagatgtcaaaatatgttcatgattgttaaattcaaaaaagaggttgcaaaagattgctcatactttgactatatatatatgtatttatttttaattaaaacttttttttttttttttttttttgtagagacaaggttttgccatattgcccacgctggtctcagactcctgagatcaaacaatcccaaattcctgggattagaggcaaaaatayaatatttatataattcacaatgggcctaagaatgagagaccccagaatgttaataatatgcttgacttttttcttccatgtatttacttgttttttctatttttttaaacaaaggagttttaaaaacttttataaaaataattattttgtgtttttgttgttgttgtttgtttgtttatttttttggcagggtctccctctgttgcccaggctggagtgcagtggcatgatcatagttcattgcagcttcaactcctgggctaaagcaaacctcccaccttggcctcccaaagtgctggg

SEQ ID NO: 28781 - DNA, 601 bp, Human
gaagtcaggagatcgagacaatcctggccaacatggtgaaaccccgtctctacaaaaatacaaaaattagctgggtgtggtgacaagcacctgtaatcccagctactcaggaggctgaggcaggagaatcgcttgaacctaggaggcagagattgcagtgaactgagatcgcaccactgcactccagcctggcgacagaaagagactctgctctgtctcaaaaaaaaaaaaaaaagatgtcaaaatatgttcatgattgttaaattcaaaaaagaggttgcaaaagattgctcatactttkactatatatatatgtatttatttttaattaaaacttttttttttttttttttttttgtagagacaaggttttgccatattgcccacgctggtctcagactcctgagatcaaacaatcccaaattcctgggattagaggcaaaaatataatatttatataattcacaatgggcctaagaatgagagaccccagaatgttaataatatgcttgacttttttcttccatgtatttacttgttttttctatttttttaaacaaaggagttttaaaaacttttataaaaataattattttgtgtt

SEQ ID NO: 28782 - DNA, 601 bp, Human
aagctgggcacagtggctcatgcctgtaatcccagagctttgggaggctgaggcgggcggatcacctgaagtcaggagatcgagacaatcctggccaacatggtgaaaccccgtctctacaaaaatacaaaaattagctgggtgtggtgacaagcacctgtaatcccagctactcaggaggctgaggcaggagaatcgcttgaacctaggaggcagagattgcagtgaactgagatcgcaccactgcactccagcctggcgacagaaagagactctgctctgtctcaaaaaaaaaaaaaaaagatgtcaaaatatgttcatgattgttaaattcaaaaaagaggttgcaaaagattgctcatactttgactatatatatatgtatttatttttaattaaaacttttttttttttttttttttttgtagagacaaggttttgccatattgcccacgctggtctcagactcctgagatcaaacaatcccaaattcctgggattagaggcaaaaatataatatttatataattcacaatgggcctaagaatgagagaccccagaatgttaataatatgcttgacttttttcttccatgtattta

SEQ ID NO: 28783 - DNA, 601 bp, Human
gaagactgattaaatgaaagggccataatatacaagtagaatagcctacttttctgtcattaaaaatcatatagaagactatttaaagatgtcgaagctgggcacagtggctcatgcctgtaatcccagagctttgggaggctgaggcgggcggatcacctgaagtcaggagatcgagacaatcctggccaacatggtgaaaccccgtctctacaaaaatacaaaaattagctgggtgtggtgacaagcacctgtaatcccagctactcaggaggctgaggcaggagaatcgcttgaaccyaggaggcagagattgcagtgaactgagatcgcaccactgcactccagcctggcgacagaaagagactctgctctgtctcaaaaaaaaaaaaaaaagatgtcaaaatatgttcatgattgttaaattcaaaaaagaggttgcaaaagattgctcatactttgactatatatatatgtatttatttttaattaaaacttttttttttttttttttttttgtagagacaaggttttgccatattgcccacgctggtctcagactcctgagatcaaacaatcccaaattcctgggattagaggc

SEQ ID NO: 28784 - DNA, 601 bp, Human
ctaaaaggaaaagcaagggagacaggaaacaaagggaacagtcagcaaagaaactgaataataactgcaggatacgctcccagataaagaaagagcagggatgtccaggtgtcggggggttgaactttgctggtgcatcaagctaaaggaagaagccccgatcgccctcttttggggctggagcaagagacatacctgtgccagaattgcagcctgcactgacagatgagaaaagctggggagggaaggaaacctgagattgggagaaaacggaaactgcagattttatgtaggatgggcygtgttgatcaaagtgaagcttggtccaaaatgtaaatgcatcaaaatgagtaattttatgactgtagagtatatgttaatagttttttccatgtatgtgcgtgcatctgaatctgcatagcaaatggaatgtgaacattaacatacatcattatattacatttactgaggtgtgagcataccaaaatagatgtgtgtgtgtgtgtgtgtgtgtgtgtgtgtgtgtgtgtgtgtgtgtgttttggggcataggaacaggtgaaacagaaagaggtgagaaatgaagctcacagggaatttt

SEQ ID NO: 28785 - DNA, 601 bp, Human
ctttcctccctctctttcatttcctgtctccctgggacaagagacattcgaacagcctcctccgcagagccctcctccaaaatgtcaaccactagtggagcccattttaaaatgattgaaataaaccacatgggtctaaaaggaaaagcaagggagacaggaaacaaagggaacagtcagcaaagaaactgaataataactgcaggatacgctcccagataaagaaagagcagggatgtccaggtgtcggggggttgaactttgctggtgcatcaagctaaaggaagaagccccgatcgcmctcttttggggctggagcaagagacatacctgtgccagaattgcagcctgcactgacagatgagaaaagctggggagggaaggaaacctgagattgggagaaaacggaaactgcagattttatgtaggatgggccgtgttgatcaaagtgaagcttggtccaaaatgtaaatgcatcaaaatgagtaattttatgactgtagagtatatgttaatagttttttccatgtatgtgcgtgcatctgaatctgcatagcaaatggaatgtgaacattaacatacatcattatattacatttac

SEQ ID NO: 28786 - DNA, 601 bp, Human
gtgcctggggaggatatcctcgggtggtttgcataaagaatgacagtatttggaggctttcctgctgggaaaagttgtctccttctcttttcctcctcctcatcctcctttcctccctctctttcatttcctgtctccctgggacaagagacattcgaacagcctcctccgcagagccctcctccaaaatgtcaaccactagtggagcccattttaaaatgattgaaataaaccacatgggtctaaaaggaaaagcaagggagacaggaaacaaagggaacagtcagcaaagaaactgaayaataactgcaggatacgctcccagataaagaaagagcagggatgtccaggtgtcggggggttgaactttgctggtgcatcaagctaaaggaagaagccccgatcgccctcttttggggctggagcaagagacatacctgtgccagaattgcagcctgcactgacagatgagaaaagctggggagggaaggaaacctgagattgggagaaaacggaaactgcagattttatgtaggatgggccgtgttgatcaaagtgaagcttggtccaaaatgtaaatgcatcaaaatgagtaatttta

SEQ ID NO: 28787 - DNA, 601 bp, Human
aagaaaagagttccttttcggaagacctttaaactgcatagattctcattttctcttctgaaagcatttcgttttgtctttgggactctcctgtagctaactggagagaacaacattattctctccatacccttaaatgatgtcagtgtttcatgaattttcttttctaaaaattatactacaatatgaacacattttagtagcattcacttataatccaagacattttgcaatccctcctccgtttttccatttttcattgtacatagagctatatgaggcattacagaggatactaaamtgaacgaaaatcataaaccctgcagtcaagaatctttcagtctaatgaagttatgagtaaagatgaatacaatgaggaatagtaaataactttgagataaagaaactaaagtatatcataagactgatgcaacttgacacagaattgtgattatttttgatgtctccagttttgatagtcaaaggagacactatcaatagatattgcaagggcaacaggcataaactaatattatcttggacaatttgatatatagagtcaccctactcttaagtttctttacttttgcttttacttttt

SEQ ID NO: 28788 - DNA, 601 bp, Human
ctttgttatagagaatggagggattttcctggtggtggtttaagtaattgtactgagttttccacttaaaaacaaaaacaaacaaacaaaaaaaactttgaaaaatagtgaatattgaatttactgggaatgtattaaaaagtcctgagataaattcttaaagtataatttatatttttggtaacaatatagcatattttacatattaaaatccatgcacttaaataggtcatatatttataaaaattattatattaaaaactaaaatctgatttcttggtctttatgatataaatttcamaaaatccttaaaattattttggaataaatcaagatgaaatcacacagttgggaatttaggcttttatgtctgtggataaagaatgtttagacttatagcacagaaatactctgaagttaaaatgtatttgggaaatagtttgtcatattccctttcaagaacaacgatgctttaaatatatataagtcaagcaaaatcaatatttaggactgttagaaatggaagtctttctacagctatatcactttactacaataaagtattttagaaccatgagactggcaaagttttctaaacagc

SEQ ID NO: 28789 - DNA, 601 bp, Human
cattgtttttaagtagtctgatataatttcagtgataaaccattgcaaaatgccagtggaaaaaactgaatagcaaaacacctcagtttttttttttttttaacaaatgtcaacactggatagttaaaagcaaaaggatttaaagagtaaaatgggaaaatgctcataattccactggaatacattcaagtatgggaactgttcttaaaaaggcaaaactaatggaaggaaaaagcatgtatcacagatagctgaattgtagcacacagggtatgagctttccttatattttatataaaakaattaatcaaaaataaaatgtgtagctttataatatgagatttaccaggatagtattcatatttaacccacttgccacaaagagaaacattcttactttgttatagagaatggagggattttcctggtggtggtttaagtaattgtactgagttttccacttaaaaacaaaaacaaacaaacaaaaaaaactttgaaaaatagtgaatattgaatttactgggaatgtattaaaaagtcctgagataaattcttaaagtataatttatatttttggtaacaatatagcatattttacata

SEQ ID NO: 28790 - DNA, 601 bp, Human
acatcaaccttcccaaactgtgccaggccatggtggagatttttctggcatcagttttattcttgaagaattacgtcaaatcctggggagatttggctacccaccattttatcccaacagtcagaaaaaatacactctatatagataaatttttttttaatctattttcctattatcccacatgttcctgatagaggtactcatgaagtcctggcattgtttttaagtagtctgatataatttcagtgataaaccattgcaaaatgccagtggaaaaaactgaatagcaaaacacctcagwttttttttttttttaacaaatgtcaacactggatagttaaaagcaaaaggatttaaagagtaaaatgggaaaatgctcataattccactggaatacattcaagtatgggaactgttcttaaaaaggcaaaactaatggaaggaaaaagcatgtatcacagatagctgaattgtagcacacagggtatgagctttccttatattttatataaaataattaatcaaaaataaaatgtgtagctttataatatgagatttaccaggatagtattcatatttaacccacttgccacaaagagaa

SEQ ID NO: 28791 - DNA, 601 bp, Human
gatgagcccacatcagatgaccaccagttactgcttttaatttaagtagaattggacataattaaaacaaattcatttcagaagctgtcaagagagtcttctgcgacagtggtgtgtggagtctgcggccatgactaataagttagttagcagttccctctaagtccatagtggccaatggcaattagacagaaactagagacctctgatagcttgtgacatattgaacttgctggaggttaagtttttgagctttttatcttggattagtatcacattaaaaatttattgtaaattctargtatacagaatattgcacaagattataaagagtttttcatctggatgataatttattgaatattcagttgtttcatatcactcctaaggaagcatgagcatgtaccacaagtgatttacaattgtgaaagcttaacttaaaaaaaagaaagtttaattatttaaggtaaagaaatgcagccttattatttttgttgaaaaggaattaaatgacatcatgcaaaatcacaacatttacttatcttctgagtctcttactgtatgtagtaagcatctaccacaatattttgctatttgggaa

SEQ ID NO: 28792 - DNA, 601 bp, Human
atctgccattttgcacataagcccaaaggtgctcagcttttcgtgcttgcttcggttagcctgctcttgctgcaaataggccatgattttagcctggacttgaggctcatctggctcacacttcaaaagttccagtatcagatgtgggatgcttgctggagagctcgtctggtaactatccatatatgaatagcccattatggactcgggtgagctggtataggggtctgggtactcagacttgatggcccggctaggaaagtggccatatgtttggtaaccttgcaggctgccgtgaggsggcattgtcatgctaatgggggatgttacaaagggacttctgtcatagtctgtaggaggcaaggcagcatggttcagaggtaggcctttggaggcagagtggatgttttgaattgcagaggaaatggtcaggtcagagggcatagcttggatcacctgagacatggcttctagcttaagtccattggctcggatgagggcttttttctgttgcttcagggccctgtctctcttgtacattggcccaaacttattccttcctccacgcattcggtcggcccttacagctgttgggggtggg

SEQ ID NO: 28793 - DNA, 601 bp, Human
actgttcctctgacctagaaggattttaagcaatggtgtcttcctcaacttacaaaggagagtacaatcaaatatcctcactttaggggtaaggcacttccttatagaagctgaatcatctggacagcttagaacacccatcttattctctttgcacttcctcctctgaaatttccccgcactttctctgaccctgtgtaatggggcttacctgtgaaagtacacagtgaaaagcactatgcaaagggcagtcattaattaggtggatgaattatgcctcttatcactattggctgcagasctgtgtctaatgtttttccccttacatctttgatttcccttcatttatcaggccatcagaagcatttgttttaactaaattaaaaaatgtatttatctcctacaagtgagtaccaagctgcctttaggggaattttgcatgctgtattggggtaataccatttactttttcccatgatatcaacaacatggcctcaatacagtgcttcatggaaacacacttctagcagtgtttgaaagttcacattccacacaaatccatgatagcaggtcaatatgtctctggggcaggcgagttatt

SEQ ID NO: 28794 - DNA, 601 bp, Human
tgtttcagaagtaatcattttctcaacagggcagttgagaaaatactgtaagtaaacctggaaatctataatgagtgaattgtatttcttctggctgaggctgaaaaaggtggcgagtttagttaaagtttcatctagtaattgcctgtcactgttcctctgacctagaaggattttaagcaatggtgtcttcctcaacttacaaaggagagtacaatcaaatatcctcactttaggggtaaggcacttccttatagaagctgaatcatctggacagcttagaacacccatcttattctcyttgcacttcctcctctgaaatttccccgcactttctctgaccctgtgtaatggggcttacctgtgaaagtacacagtgaaaagcactatgcaaagggcagtcattaattaggtggatgaattatgcctcttatcactattggctgcagacctgtgtctaatgtttttccccttacatctttgatttcccttcatttatcaggccatcagaagcatttgttttaactaaattaaaaaatgtatttatctcctacaagtgagtaccaagctgcctttaggggaattttgcatgctgtattgg

SEQ ID NO: 28795 - DNA, 601 bp, Human
atactaaaacctgaccccacttcaaagtacattattattttatacatacatagatatatgtgtgcatatgtgcgtgtgtagtttttaaaatattggataggaaataattcttttcataactaagttgcgactatatagaacatttgaagtgcttaatattactgataatcataatttcctttttgcttaacaaggctatttaatatacatttatgtagatgcctgattcaaagacgcaattaaaacataatagctaacttacagggttaagtgaaacactgaatcctcatttcaatatacwatgtactggtgtcctgggctgctctttgcagtggggctattttggtttctctagttctgaatgaactatgaacagacatagttcaattctgcaaacatttattaagcaaacttgtgagccactgggcttaagagaaaggctgtgctattttatttttcttctcttttcaagctccaaggagcaatttcctggatagtcactcattttttaaaatccaggctagtctttttcttttttctctgctatgacaaattcaccacattatttacagtgagctgtgtttagtaagaaaaagccaga

SEQ ID NO: 28796 - DNA, 601 bp, Human
attgttgaatgcagagtttgtgctcatttcaggagcagttggccttgtcttttatgtacttagtaaaattaattttttgctctcttacatgtaatctttgtgtcattaaattcaagggagatattgaagcaatactctaaactgatgtcccctttagataaatttcactcatcatgaaaaagtagaaaacagttttacctaaattgcttttaattctaatcactgaaattttgatgacttgtatattataagatgcctgtcattttaatatgatacacaataatagaagataataagttgycagtagacctttcccttaggatgatgttacagtggctgttaattagcaacaatatgcaaatactaaaacctgaccccacttcaaagtacattattattttatacatacatagatatatgtgtgcatatgtgcgtgtgtagtttttaaaatattggataggaaataattcttttcataactaagttgcgactatatagaacatttgaagtgcttaatattactgataatcataatttcctttttgcttaacaaggctatttaatatacatttatgtagatgcctgattcaaagacgcaatt

SEQ ID NO: 28797 - DNA, 601 bp, Human
aaacaacattcagatctccaacttccttacattttattacaaacataattatattttcattgttgaatgcagagtttgtgctcatttcaggagcagttggccttgtcttttatgtacttagtaaaattaattttttgctctcttacatgtaatctttgtgtcattaaattcaagggagatattgaagcaatactctaaactgatgtcccctttagataaatttcactcatcatgaaaaagtagaaaacagttttacctaaattgcttttaattctaatcactgaaattttgatgacttgtrtattataagatgcctgtcattttaatatgatacacaataatagaagataataagttgtcagtagacctttcccttaggatgatgttacagtggctgttaattagcaacaatatgcaaatactaaaacctgaccccacttcaaagtacattattattttatacatacatagatatatgtgtgcatatgtgcgtgtgtagtttttaaaatattggataggaaataattcttttcataactaagttgcgactatatagaacatttgaagtgcttaatattactgataatcataatttcctttt

SEQ ID NO: 28798 - DNA, 601 bp, Human
atgtagtacactataacggaaaggaatctgtttcataggattatatatttagtgagagacctttagtgagatggacctcaaaaaatcaattggtttaccaacaaatttataactatacatttatttacatgctaatttgaaagctcaaacatgcttattaaatgggggcttagaaaacatttctttcaaggatatttatcaaattgcacagctctaaagaaggataggtgatttattcttgaaacaacattcagatctccaacttccttacattttattacaaacataattatattttcaytgttgaatgcagagtttgtgctcatttcaggagcagttggccttgtcttttatgtacttagtaaaattaattttttgctctcttacatgtaatctttgtgtcattaaattcaagggagatattgaagcaatactctaaactgatgtcccctttagataaatttcactcatcatgaaaaagtagaaaacagttttacctaaattgcttttaattctaatcactgaaattttgatgacttgtatattataagatgcctgtcattttaatatgatacacaataatagaagataataagttgtc

SEQ ID NO: 28799 - DNA, 601 bp, Human
ccaaaggtgtcaatcagtttatatagagtcaactatgcatgaaaaagccacagttaatgtgtgttagaggaaagctcttgcatcatgtacagcactgtctacctgctttagccaggtgctggcatctacgcactaaatttaaacatcaagtgttgtaagaactcctgtggtttctgtttcagaatatgtgaaagaagggtcagtacctgggcaacctgaaccctgagctggaaggaggcaggacacactgttgaactctgtggggcacattgggattatttgcagagcacacaaagtgacrtctcaactatcattttgccagttctcttacaggggaactttctacttcaaggaaagtccttactttaaaaaggtgcctatgctataaattctttaaaaactgcacatagtcaactacttcagataataataatacaaattttactgagactaatgggatagatgagtgaatgagagcaggaaggcctgatggtacaacagtggtggcaaaagccagagactaggtaagagacccgagccaatgctgcctcttacaaacgaagagccttggacaagtacgtataaatctccatcccttggt

SEQ ID NO: 28800 - DNA, 601 bp, Human
ttttttattgtgtaaatatgatgagttgaattttcagctttaactagagaatactgggtgtacagaaacctttttcaagagtgagaaaaattatgagtcagtggaaagatgacccccaaaggtgtcaatcagtttatatagagtcaactatgcatgaaaaagccacagttaatgtgtgttagaggaaagctcttgcatcatgtacagcactgtctacctgctttagccaggtgctggcatctacgcactaaatttaaacatcaagtgttgtaagaactcctgtggtttctgtttcagaatrtgtgaaagaagggtcagtacctgggcaacctgaaccctgagctggaaggaggcaggacacactgttgaactctgtggggcacattgggattatttgcagagcacacaaagtgacgtctcaactatcattttgccagttctcttacaggggaactttctacttcaaggaaagtccttactttaaaaaggtgcctatgctataaattctttaaaaactgcacatagtcaactacttcagataataataatacaaattttactgagactaatgggatagatgagtgaatgagagcaggaaggc

SEQ ID NO: 28801 - DNA, 601 bp, Human
ctcaggcaaccagatactcttttaggttcatttaatatttgcagcagcagcaaatttgtctgggaggcaagtcctcatctgccactcacccagagcagactgtattaaatttttatatttattgacatttcattaccataattgactgcacttgcttctctaggagaaggcacagggctgcctcctaagcaggagaactagtcccttgagtagaatttgcaattaaaaacaaggcagaatggattttttttattgtgtaaatatgatgagttgaattttcagctttaactagagaatactrggtgtacagaaacctttttcaagagtgagaaaaattatgagtcagtggaaagatgacccccaaaggtgtcaatcagtttatatagagtcaactatgcatgaaaaagccacagttaatgtgtgttagaggaaagctcttgcatcatgtacagcactgtctacctgctttagccaggtgctggcatctacgcactaaatttaaacatcaagtgttgtaagaactcctgtggtttctgtttcagaatatgtgaaagaagggtcagtacctgggcaacctgaaccctgagctggaaggaggcag

SEQ ID NO: 28802 - DNA, 601 bp, Human
tctcaggcaaccagatactcttttaggttcatttaatatttgcagcagcagcaaatttgtctgggaggcaagtcctcatctgccactcacccagagcagactgtattaaatttttatatttattgacatttcattaccataattgactgcacttgcttctctaggagaaggcacagggctgcctcctaagcaggagaactagtcccttgagtagaatttgcaattaaaaacaaggcagaatggattttttttattgtgtaaatatgatgagttgaattttcagctttaactagagaatacygggtgtacagaaacctttttcaagagtgagaaaaattatgagtcagtggaaagatgacccccaaaggtgtcaatcagtttatatagagtcaactatgcatgaaaaagccacagttaatgtgtgttagaggaaagctcttgcatcatgtacagcactgtctacctgctttagccaggtgctggcatctacgcactaaatttaaacatcaagtgttgtaagaactcctgtggtttctgtttcagaatatgtgaaagaagggtcagtacctgggcaacctgaaccctgagctggaaggaggca

SEQ ID NO: 28803 - DNA, 601 bp, Human
ttgcttgaacctgggaggcggaggttgcagtgagccaagatcgtgccattgcactccagcctgggggaagaagccagactccgtctcaaaaaaaaaagtgttgctaggcaccaatcttagattattcatggggacataagaagttcaatttataacaagttaagatgttgggatggctgtcagtgatagcactggctttgctgctgcgattacagcataatgggaaagcccagttggtacctgacgctcccatcctttttttactggagagctctcaggcaaccagatactcttttaggtkcatttaatatttgcagcagcagcaaatttgtctgggaggcaagtcctcatctgccactcacccagagcagactgtattaaatttttatatttattgacatttcattaccataattgactgcacttgcttctctaggagaaggcacagggctgcctcctaagcaggagaactagtcccttgagtagaatttgcaattaaaaacaaggcagaatggattttttttattgtgtaaatatgatgagttgaattttcagctttaactagagaatactgggtgtacagaaacctttttcaagagtg

SEQ ID NO: 28804 - DNA, 601 bp, Human
aatttaaaaatttaaaataaatacaaataaattattctttagttttctgtttcctaaaaagcatgacataaaactgctattctcagatgattacattagattacatcagattaatgtgtttctctctaaagacagcaataactttatttaggagaataattccgttgtctggaagcaaaaaaagaaaaggcttatttcccttttcattaaaaaaaaaaaagtgctggccgggcacggtggctcatgcctgtaatcccagcactttgggaggccgaggtgggcggatcgcttgaggccaggrgttcaaggccaaaccccatctctactaaaaatacaaaaattggctgggcgtggtggcatgtgcctgtaatcccagctactggggaggctgaggcaggagaattgcttgaacctgggaggcggaggttgcagtgagccaagatcgtgccattgcactccagcctgggggaagaagccagactccgtctcaaaaaaaaaagtgttgctaggcaccaatcttagattattcatggggacataagaagttcaatttataacaagttaagatgttgggatggctgtcagtgatagcactggcttt

SEQ ID NO: 28805 - DNA, 601 bp, Human
gaatcctctggggctgtgaagcctttgattcacagtttgcaatacaaataccctgatacatcatttatttgctattaagtatttgattattatgcctttttaaattcaatatctttaaagcaagtttttaattagcgttgcttggagcagttcagagtactttttttcttcctgttcttcttccccctccccactcccccaatctctttttgttttgaaagcagagctcctaggggttgtaacttatgctcttttggcatgcaacatttcaatgagaaggttattatagggcacatccccrttcaggtgcttgtagtagaggtattcttcagcctgcatactgatggcccggatttcgggtagtcgaagaagtagctgtccaaatttctctgtctgctgcgggtagttacacattgtgtagtccagcagggcggcattgacttgttcctggacaccttctaccagctggaagttttcaaggtttttgacatctgcattaaaaaaaaaaaaaaagcaacatttcaatagcatttcaattcctgtttactaaagcaatgtgttcaattaatggatgtattttccttttgacataaacatactt

SEQ ID NO: 28806 - DNA, 601 bp, Human
aatcccccgctgtataagcctaattaataagattagttcctaaatttcttcatagtggagatcagtttaaatatacaagaaccgttctgtccgtttttcttctgaccgtgttggtatccatctgtgagttcaatccactccattacaatgtcttttatatggaatcctctggggctgtgaagcctttgattcacagtttgcaatacaaataccctgatacatcatttatttgctattaagtatttgattattatgcctttttaaattcaatatctttaaagcaagtttttaattagcgttrcttggagcagttcagagtactttttttcttcctgttcttcttccccctccccactcccccaatctctttttgttttgaaagcagagctcctaggggttgtaacttatgctcttttggcatgcaacatttcaatgagaaggttattatagggcacatccccgttcaggtgcttgtagtagaggtattcttcagcctgcatactgatggcccggatttcgggtagtcgaagaagtagctgtccaaatttctctgtctgctgcgggtagttacacattgtgtagtccagcagggcggcattga

SEQ ID NO: 28807 - DNA, 601 bp, Human
cagcttgcagtgcatgctggcctcaagcctttccattatgtgctttatttttggtaacattggtttagttttcaacttatattattggtcaaattgttatgactacttggggaatgcatctcaccattgcttcagagctctcccctgtaacaaaagaaaccaacacccaagctctgtgctagtttttctatctcttctctctttctctctctcttttttcttttttgagacaaggtcttgctctgttacccaggctagaatgcagtggcatgatcatagcttactgcagtctcaatctccygggatcaggcaaccctctcacctcagcctcccaagtagctgggactacaggtgcacgctaccatgcctggctaatttttttgtacttttagtaaagacggggttttgtcatgttgctcgggctagcctcaaactcctgggctcaagcgatcctccctcctcggcctcccaaagtgctgggattacaggcttgagccaccgcacctggccttccccatttttctcttaatccatatctcagacaggaatctgtatctctcactctacagatcattctgtaggcactatgctaaactgacac

SEQ ID NO: 28808 - DNA, 601 bp, Human
tggtaacattggtttagttttcaacttatattattggtcaaattgttatgactacttggggaatgcatctcaccattgcttcagagctctcccctgtaacaaaagaaaccaacacccaagctctgtgctagtttttctatctcttctctctttctctctctcttttttcttttttgagacaaggtcttgctctgttacccaggctagaatgcagtggcatgatcatagcttactgcagtctcaatctcctgggatcaggcaaccctctcacctcagcctcccaagtagctgggactacagktgcacgctaccatgcctggctaatttttttgtacttttagtaaagacggggttttgtcatgttgctcgggctagcctcaaactcctgggctcaagcgatcctccctcctcggcctcccaaagtgctgggattacaggcttgagccaccgcacctggccttccccatttttctcttaatccatatctcagacaggaatctgtatctctcactctacagatcattctgtaggcactatgctaaactgacaccagtttcaaatttagtccttaattgatcttggcctttaggtgagcaaagtt

SEQ ID NO: 28809 - DNA, 601 bp, Human
cattggtttagttttcaacttatattattggtcaaattgttatgactacttggggaatgcatctcaccattgcttcagagctctcccctgtaacaaaagaaaccaacacccaagctctgtgctagtttttctatctcttctctctttctctctctcttttttcttttttgagacaaggtcttgctctgttacccaggctagaatgcagtggcatgatcatagcttactgcagtctcaatctcctgggatcaggcaaccctctcacctcagcctcccaagtagctgggactacaggtgcacrctaccatgcctggctaatttttttgtacttttagtaaagacggggttttgtcatgttgctcgggctagcctcaaactcctgggctcaagcgatcctccctcctcggcctcccaaagtgctgggattacaggcttgagccaccgcacctggccttccccatttttctcttaatccatatctcagacaggaatctgtatctctcactctacagatcattctgtaggcactatgctaaactgacaccagtttcaaatttagtccttaattgatcttggcctttaggtgagcaaagttacagtg

SEQ ID NO: 28810 - DNA, 601 bp, Human
atctcctgggatcaggcaaccctctcacctcagcctcccaagtagctgggactacaggtgcacgctaccatgcctggctaatttttttgtacttttagtaaagacggggttttgtcatgttgctcgggctagcctcaaactcctgggctcaagcgatcctccctcctcggcctcccaaagtgctgggattacaggcttgagccaccgcacctggccttccccatttttctcttaatccatatctcagacaggaatctgtatctctcactctacagatcattctgtaggcactatgctaaaytgacaccagtttcaaatttagtccttaattgatcttggcctttaggtgagcaaagttacagtggtaaattacgctccttcgcttacaaaatctcttgcttggtatttattccccaggggttacatagaatagagtggaggcagtagacatggagaaatcctatcttttaagaaagaaaaaaatgggcatttttctcatggggaaggatttttatttttcaaatgggtgtttgaactgtaatgatttcatgacatctgcctaacggttttgtttctttgtcttacagaaacaaacagtcgt

SEQ ID NO: 28811 - DNA, 601 bp, Human
caggcaaccctctcacctcagcctcccaagtagctgggactacaggtgcacgctaccatgcctggctaatttttttgtacttttagtaaagacggggttttgtcatgttgctcgggctagcctcaaactcctgggctcaagcgatcctccctcctcggcctcccaaagtgctgggattacaggcttgagccaccgcacctggccttccccatttttctcttaatccatatctcagacaggaatctgtatctctcactctacagatcattctgtaggcactatgctaaactgacaccagttycaaatttagtccttaattgatcttggcctttaggtgagcaaagttacagtggtaaattacgctccttcgcttacaaaatctcttgcttggtatttattccccaggggttacatagaatagagtggaggcagtagacatggagaaatcctatcttttaagaaagaaaaaaatgggcatttttctcatggggaaggatttttatttttcaaatgggtgtttgaactgtaatgatttcatgacatctgcctaacggttttgtttctttgtcttacagaaacaaacagtcgttgctgtcaaaaa

SEQ ID NO: 28812 - DNA, 601 bp, Human
ggaaccaatgctgcaggctgcagagactctacatccccaacgtggcccctgcacctatcattacagggccagaatctacccaaggtggcaactgcctattttggcaaatcttatgtctggggcccaagacagagtcctgggaaccatggggcattgagctggggtgtacggttagctatctgaacgtggaggaaggtggttgaggaggggataacttgctttggccaatgctgcagaatcaggaagtttaaggatgtcacctgtggtggggaccactctctgcttctgtctgccagagacwtgtgagggaaaagccaagcgtttgtccccgtgtctcagttgaatgctccttagaacttttttttttttctgctgatgctttttcccagactaatacataatggctgaaggaggccactgatttgaagtctgtggtcatctgtccactgtgggcctgacccactggtactgagggggctggctctgggcatggaacgggatgtggctctgggtaaatggcttctgggtttggaggctgtgtgtagtgacactgaagggtgggagggggttgaataccttctaacaactgtgtctcttccag

SEQ ID NO: 28813 - DNA, 601 bp, Human
ggaattagctttttttagaaaagttttttaaattgacacataattgtacatgtttagggggtacatagtgatgtttcaatacatacaatgtgtattgataggatcagggtaattagcatatccatcatctcaaacatttatcatttgtttgtgttgggaacattcaatatcttcttttctggctatttgaaagtatataaagtaaaacagaggttactacagactgggaagggaagggggaaggggagatagggaagtatttgttaaaggataaaaaattaggccgggagcggtggctcaygcctataatcccagcactttgggaagtttcaggcaggaggattgcttgagtctaggagttgaagaccagcctgggcaacatagtgagaccacatctctacaaagaataaaaaaaattagccaggtggtggcacatgcccgtggtcccatctcatcatgacactgacgtgggaggacggcttgagctggggaggtcaaggctgcagtgagccatgattgcatcactgcactccagccttagtgacagagcaagacaatgtctcaaaaaaaaaaaaaaagttacgaaattacagctagatag

SEQ ID NO: 28814 - DNA, 601 bp, Human
ccgggagcggtggctcacgcctataatcccagcactttgggaagtttcaggcaggaggattgcttgagtctaggagttgaagaccagcctgggcaacatagtgagaccacatctctacaaagaataaaaaaaattagccaggtggtggcacatgcccgtggtcccatctcatcatgacactgacgtgggaggacggcttgagctggggaggtcaaggctgcagtgagccatgattgcatcactgcactccagccttagtgacagagcaagacaatgtctcaaaaaaaaaaaaaaagttacraaattacagctagatagtgttctgtagcactgaaggatgactgtagttaataataatacagtatgtatttccataatagctagaagagaaggaattagctcttcctccaaatagtgtgtttggaccaattaagccccaggtttaaataatgggcctaagtttccaaacccaggcattatcctgagaaagggtagaacccaacatggcaagagtcttggagtctgtggcaactttgggcttctaagatgggtgcagagacacaagtttgaacactccaagttggtttgaatctaaaaacct

SEQ ID NO: 28815 - DNA, 601 bp, Human
aggcattatcctgagaaagggtagaacccaacatggcaagagtcttggagtctgtggcaactttgggcttctaagatgggtgcagagacacaagtttgaacactccaagttggtttgaatctaaaaacctattgataaaatataaacaggccatattttaatgaaatagatacagaaaggccgggcatggtggctcacacctgtaatcccagcacttcgggagactgaggtggatcgcttgaccccaggagtttgagaccagcctgggcaacttggcaaaaccctatctctaccaaaaatmcaaaaaaaaaaaaaaattagcctggcctggtggtgcgcgtctgtgatcccagctactcaggaggctgaggtgggaggattgcttgagcctgggaggcggaggctgcagtgagccaagattgtgccactgcactccagcttggctgtctcaaaaaaaaaaaaaaaagaaaaaaaagaaaaagaaataggtatagaggaatgacagagggactggatggaagacaatgtttcatttcacaagtagaattgggactgattttgtcaaatacctgccaatcccaagggttatttgatttgagga

SEQ ID NO: 28816 - DNA, 601 bp, Human
ttgaggaaatttctaggaaaacagtaataagtatgtcaccaaatcgatacaggaaaagaggacagcctggtcagttgacctgtgtattgatgtcatatcttgggtgtcgagcttctaggaaatcattttctgtttccttttcaggattgtgaaatacagtgagcagttctcatccaacgatgccatcatgtcaggctgcctccccagcaacccctggatcaccgatgacacccagttctgggacttaaatgccaaattgtatgtattttatatattggtgttttttaaaaaaccgtttttragttacaattcacatgccataaaattcaccccttcaaagcatacagttcaatggtttttattatattcatagagctacaatcaattttaaaacatgttcattacacaaaaaagaaaccctggacgccctccagccttaggcaactatgaatctactttctgtgtttacggatttgtctgtctggacatttcctatcaatggcatcacttggaatctgaggaatgacagagggactggctggcagacaatgtttcatttcacaagtagaagaggaactgattttgtcaaatacttgccaat

SEQ ID NO: 28817 - DNA, 601 bp, Human
atcagtgggaaaaatggtgtgagggacttgaaaccttagtttcaaaggtctgtgttaggtttaggagaattccataagggataggagagaacactgagtctttttctgattctctggaatgttagatctctgctagctgggctcgaatatcctacctgggatcagggaaatctttccaaacaaggaggtgcagtgggacctgcatcttagaggaagccctgaaagggagtgcagagatggcaaatgggtctactccgaggcacatggcctgaggcaggtacaggaggagccaccggctccyaccagaagccagggtgtgccatggtaggggggcagctgtcgtgggtgataggcacccagcaggtggcagtgattgtagcacccatcaccaatgctgctccagaattctctcctagtccaggtggcagcctgaccctctgctggccaggctccaggctgttaccatgccttggaggaggcatttgaattcgtttgtccttaaggttaagtgagcaggacctgagtgtgggctccccacggtgggcatcctcctcacctctgggatggtcatgtctttgatgtgagccccgggggacttgtc

SEQ ID NO: 28818 - DNA, 601 bp, Human
ccaccggctcccaccagaagccagggtgtgccatggtaggggggcagctgtcgtgggtgataggcacccagcaggtggcagtgattgtagcacccatcaccaatgctgctccagaattctctcctagtccaggtggcagcctgaccctctgctggccaggctccaggctgttaccatgccttggaggaggcatttgaattcgtttgtccttaaggttaagtgagcaggacctgagtgtgggctccccacggtgggcatcctcctcacctctgggatggtcatgtctttgatgtgagccccrggggacttgtctgtggctgcatcttcctagcaagtgattacttggcttgtgtgttatgcagggattgggaggaggaggattgaattgagccctgggccatgagactaaaggccctcaccccaacccaggccaccacctgtcacaaccgctacctctctggtgcatttacaaatcatccttgcagggtggaaatcccaaccaagatgcgagtggaacgatgggccttcaacttcagcgaattgatccgagaccccaaaggtcgacagagcttccagtacttcctcaagaaagaattcagtg

SEQ ID NO: 28819 - DNA, 601 bp, Human
tacgcgttggttgtttttgtttttgctttggtattctcttgcctttacacccaaaacacagggcagaaagggatgtcaatggcttagaagtgggctccatactcctggctgctcatcttccttggaagaaagtcttggagaggagaggtcagatgtgctcttgtctcatgctggcttcactgaaccactccaaggtggatcttcatgtgtagggttacagactgtaattctcaaacttaaaggtgcagcagaattacctggagactgttcaggtagttgttaattgttaattgtttaggtrtcctcatgtgaacaaatgatgacaggcaatgtctccatacatgaccagctgtctcacctgtttggcatgtagcatgcagcatatgagaataagtgaaacaaattaagcagttctgggtctagtgtacttttaactgtagcagcttttatgcaactggctacatttacaacataggctgaatcacagacaatgttgataggatctgaagctgtgagctgtaaaacctgagactgttcaggctcagggtgaatcactcccagagtttctcatcaggacggctggggcaggcctgagaagttc

SEQ ID NO: 28820 - DNA, 601 bp, Human
ggttgtttttgtttttgctttggtattctcttgcctttacacccaaaacacagggcagaaagggatgtcaatggcttagaagtgggctccatactcctggctgctcatcttccttggaagaaagtcttggagaggagaggtcagatgtgctcttgtctcatgctggcttcactgaaccactccaaggtggatcttcatgtgtagggttacagactgtaattctcaaacttaaaggtgcagcagaattacctggagactgttcaggtagttgttaattgttaattgtttaggtgtcctcatrtgaacaaatgatgacaggcaatgtctccatacatgaccagctgtctcacctgtttggcatgtagcatgcagcatatgagaataagtgaaacaaattaagcagttctgggtctagtgtacttttaactgtagcagcttttatgcaactggctacatttacaacataggctgaatcacagacaatgttgataggatctgaagctgtgagctgtaaaacctgagactgttcaggctcagggtgaatcactcccagagtttctcatcaggacggctggggcaggcctgagaagttcccaggtga

SEQ ID NO: 28821 - DNA, 601 bp, Human
tttgaggtgttttagtttcagtctattgcagttattgttgctgttgtttgtttgtttgtttttgagtcttgctctgtcgcccaagctggagtgcagtggcacaattttggctcactgcaaccttggcctcccgggttcaaacgattctcctgccttggcctcccaagtagctgggattacaggcacgtgccaccatgccctgctaacttttatatttttagtagagagggcgtttcaccgtgtgtccaggctggtcctgaactcctgacctcaagggatccccccgcctcggcctcccaargcgctgggattacagcatgagccatggtcccttgcctgcaataactggttgtaatggtgctcagattgtcacatttctatgaggtggcccaaggtgttttgatacagcccaggcatctattgcttccatgcttagcttgcacaatccttgtcttaaactacaatcagacatttctctaaggtttcatgattgtttttagaggaacattttatttagtgacctcagtctggactctagagaagactcactactggattgatccttgtgtatagaagttttttccccaatggacagaattag

SEQ ID NO: 28822 - DNA, 601 bp, Human
atccttgtgtatagaagttttttccccaatggacagaattagagaataagtgtttcttttaacaccataatttttctaatgtgctggagacagctggcagattttggctagggaaggtaacatggaaactccactgagcagaagcatctgatcaagccttttttatttcccactgcttagtaatgaccttgactcattgctgtctcttggaaataaagattcattctgtctactgccaaagttgattaaagccaaaaatctggtacattacatacaatattttaaattatgtcaaaattaktcatcaccacccaggcttacattcggatgggatcctaggagtagttggaattttccagagaagtggcatgtgtctgtggacgttcccatgtgttgtggacatgtttttgcattttggccttgatgttgcagagctgactggggccttggaagagtgggcactgcaggaaatggggacttctccagggtcaccaagcttgggtctataaagattggaaataggaaatgtcccctccctactggctgtaacttgagaccataagagacagcgggtttctggtttgttggcttgtttttccct

SEQ ID NO: 28823 - DNA, 601 bp, Human
ttcctatccattccaccttccccatagaattttatcctgatatattttttatgcttggagggtttttactaatcaccttttcacattcgaatatgcacatattgaaaaatatgcacctatttgaaatctttatttattttatttattttttttttgagatggagttttgctcttgttgcccaggctggagtgcaatggcacaatctcggctcaccgcaacctctgcctcccaggttcaagcgattctcctgcctcagcctcttgaataactgggattacagggatgcaccaccacgcctgrctaattttgtatttttagtagagatggggtttctctatgttggtcaggctggtctcgaactcccgacttcaggtgatctgcccacctcggcctcccaaagtgctgggctgggattataggcatgagccaccacacctggtcaaaatcttaatttttaaatatttactttgactgagggttaaaaacatttcttctggaccaagttgtcactgcatttattattacacaattggtcacaaatgaatatatcctattttgctatattataatcataaaagtaaaaacttctgacctccataa

SEQ ID NO: 28824 - DNA, 601 bp, Human
ttatgtggccaagctcacctactgatgtgatatcagaagttatttttaacgctctatcagttgagaattcaattgtgtccttcaattttgttgaaagtaaagaaatagaattccttttgagttgaaaaagtatttcttagagtaatttgctttcctgacttctaggaagtataacaaaagcgtttttttccacgacttaacaaatgattatttatgcctattactcattcccttagaggcacctggttttaacccaaaatacttggacagggttgggagaattaaaatattatccatttcmattcatatcaaggaaaatgtccatcacagagtctaactgacacattcggtctttattatcaaatgcattgactaaaccagatgtgctttctcttacaaaaagtctgacttgattttttaatggttaaaatggatctccctatcacagccaactccctctgaattctgattctaaaatagaagaggcccagagcctttcctttaggttttcaccagcatgtcacatcagggattctattagactttctctctgccttgtacctttggaaatgggttcatttttggacaaaataggttgagg

SEQ ID NO: 28825 - DNA, 601 bp, Human
aaaatgtccatcacagagtctaactgacacattcggtctttattatcaaatgcattgactaaaccagatgtgctttctcttacaaaaagtctgacttgattttttaatggttaaaatggatctccctatcacagccaactccctctgaattctgattctaaaatagaagaggcccagagcctttcctttaggttttcaccagcatgtcacatcagggattctattagactttctctctgccttgtacctttggaaatgggttcatttttggacaaaataggttgaggatagaggggaaacrgtagatgaatggaaatttcactcctgtcccaccctgcataatttcaattcagaacaagtcagcctgatcgcagctgccccatttctatcatcctgcttttgcccttaatagagcgggaaaggtgggaactgtgctgggaggcgcaggaactctgccatccccaatgtccacttgtcacctcgttcagcatctcagaggtttggcagcatagcagcaaactatggggtgggtaaaaagtatatcttttgtgaaatgggaaaagtgtgattaagaaagggagcaaggaaaggagcctgcagg

SEQ ID NO: 28826 - DNA, 601 bp, Human
gtcaagctatggaaattaacacccttaaccctttgtatgcctgttagcccccgtctcttcgattttgagggcttctcacaactctagattgtgcttctcttttaaaaagctgttcaaattaatgtgagttattagatgtcaactgggctcttcttaataaagattcaaggcaaatcaaattgctaggtgaaggagcgggtaccctacctagccagccaaattgcagaaatcaacagtatacttcatacttgactctggacaaagaaaatttatttcctttttttagtgttttattcacgaragtaaatcacagaagtgctactaatttcaggagtaatttgtggtttgggcaccagccagttgcctgattatgatatcacatagtagccaatgttcttcttgggacttaccgaagaatcatcatgtgtggattgcagtagagggaataggcataggaaacctgagacatttattttgacagtgtagtttttgaagaatatgagagtcaagtcagttcactaaccaggatcagctcctactttcaacactgtccattaaggaaggggtctaagatccattgtgccactgtgtttatcagtaa

SEQ ID NO: 28827 - DNA, 601 bp, Human
tgctcctttgctgaccgcaatctcagagtagctgtcagagaacacaggcagcgtttgcttttgtatatttgtttgtcccaccttgtgctgttctcctccctgtggaaggcacaggggattcaaatgtccaagaaggcgtgggttcctctcctgaaggagctggcaatctgggagagttttgcatttgttcactttttaaaaaacaagcatataaaaccaaagcactgaactaccttttcccccacagctgtaccttccttggaaagagagtagaacatcatgggacagagaaatccgatgyggtttgcagttcttctctgccagctagaaaaccaccaaatggtatgtttaaaaagagcctgttggttgatagatgtgccccagggtggtcagctggtttagatccctcccagatggcacatggatttgcgggcgtcctctccccctttatttcatcccgtgcatggtcagctgaatatttcattctcatcagtattttaattccaggtatgttgtttccttgataattttctacactggattgggggtaactaataatgttttgatatacataaaaagaaaatagagctgcaaacataaa

SEQ ID NO: 28828 - DNA, 601 bp, Human
atcagtattttaattccaggtatgttgtttccttgataattttctacactggattgggggtaactaataatgttttgatatacataaaaagaaaatagagctgcaaacataaattaaaatgctcagacatggtgggatgatggtggtcacaagtgagggtgtctatgaggagattttagtcatcttcccaaattgttaggatctagctatcattatctatggaacatgttgtagattagattaaattaatcttttttttttttctttttgagacagagtgtcactctgccacccaggctgsagtgcagtggcgtgatatcagctcactgcaacctccaactcccgggttcaagcgattctcctgcctcagcctcctgagtagctgggattacaggcgcacagcaccatgcccagctagtttttgtgtttttagtagagacagggtttcaccgtgttggccaggctggtctcaaactcctggccccaggtgatctgcccgccttggtctcccaaagtgctaggattacaggagtgagccactgtgcccagccacattaaattaatcttaagtagagtttcagattgccagaaagttgatggt

SEQ ID NO: 28829 - DNA, 601 bp, Human
gtcactctgccacccaggctggagtgcagtggcgtgatatcagctcactgcaacctccaactcccgggttcaagcgattctcctgcctcagcctcctgagtagctgggattacaggcgcacagcaccatgcccagctagtttttgtgtttttagtagagacagggtttcaccgtgttggccaggctggtctcaaactcctggccccaggtgatctgcccgccttggtctcccaaagtgctaggattacaggagtgagccactgtgcccagccacattaaattaatcttaagtagagtttcrgattgccagaaagttgatggtggaggctggttacttggtgagcaggacagtgtggaggtgtgggtccagatatcggaagagattgcttcagtggcaaggagacctttcagatgaggaaagagaacaataggccacagaataaccgggttaacaagctttgaccaagaaatcaggggtttggccttgatgttttgggaaacaggaagacattaaagcattctggatgtggagttacacaatcagagcaaacttttttaaagaccatttggcagataacattaaatataactgaaggaataa

SEQ ID NO: 28830 - DNA, 601 bp, Human
cagcaccatgcccagctagtttttgtgtttttagtagagacagggtttcaccgtgttggccaggctggtctcaaactcctggccccaggtgatctgcccgccttggtctcccaaagtgctaggattacaggagtgagccactgtgcccagccacattaaattaatcttaagtagagtttcagattgccagaaagttgatggtggaggctggttacttggtgagcaggacagtgtggaggtgtgggtccagatatcggaagagattgcttcagtggcaaggagacctttcagatgaggaaaragaacaataggccacagaataaccgggttaacaagctttgaccaagaaatcaggggtttggccttgatgttttgggaaacaggaagacattaaagcattctggatgtggagttacacaatcagagcaaacttttttaaagaccatttggcagataacattaaatataactgaaggaataaaaagttattttaaaaaagaggagaggaaaagtaggagtccaggaaaccaggtcatgtaaatcaagagttttgaacaaggattctagcaatgaagtgatcagggagggatgaagagaacag

SEQ ID NO: 28831 - DNA, 601 bp, Human
gagacagggtttcaccgtgttggccaggctggtctcaaactcctggccccaggtgatctgcccgccttggtctcccaaagtgctaggattacaggagtgagccactgtgcccagccacattaaattaatcttaagtagagtttcagattgccagaaagttgatggtggaggctggttacttggtgagcaggacagtgtggaggtgtgggtccagatatcggaagagattgcttcagtggcaaggagacctttcagatgaggaaagagaacaataggccacagaataaccgggttaacaagstttgaccaagaaatcaggggtttggccttgatgttttgggaaacaggaagacattaaagcattctggatgtggagttacacaatcagagcaaacttttttaaagaccatttggcagataacattaaatataactgaaggaataaaaagttattttaaaaaagaggagaggaaaagtaggagtccaggaaaccaggtcatgtaaatcaagagttttgaacaaggattctagcaatgaagtgatcagggagggatgaagagaacagttgggtccacgtggtgtcggggatgaaaactacaga

SEQ ID NO: 28832 - DNA, 601 bp, Human
cggaagagattgcttcagtggcaaggagacctttcagatgaggaaagagaacaataggccacagaataaccgggttaacaagctttgaccaagaaatcaggggtttggccttgatgttttgggaaacaggaagacattaaagcattctggatgtggagttacacaatcagagcaaacttttttaaagaccatttggcagataacattaaatataactgaaggaataaaaagttattttaaaaaagaggagaggaaaagtaggagtccaggaaaccaggtcatgtaaatcaagagttttgarcaaggattctagcaatgaagtgatcagggagggatgaagagaacagttgggtccacgtggtgtcggggatgaaaactacagaaatatttcacaggatggctgtggttctgttctcatgaccagcaaacccctggtgccctgttgctattaggaaagagatagaagaagctccttttgtctgcaggggtcatttttctggggatactgaagggttctggaggttagccaaaatgagactgggtgatgtggtgagcatgatgagagctgttctaaggtagaaacaccgtaatggccctggct

SEQ ID NO: 28833 - DNA, 601 bp, Human
ccaggtcatgtaaatcaagagttttgaacaaggattctagcaatgaagtgatcagggagggatgaagagaacagttgggtccacgtggtgtcggggatgaaaactacagaaatatttcacaggatggctgtggttctgttctcatgaccagcaaacccctggtgccctgttgctattaggaaagagatagaagaagctccttttgtctgcaggggtcatttttctggggatactgaagggttctggaggttagccaaaatgagactgggtgatgtggtgagcatgatgagagctgttctamggtagaaacaccgtaatggccctggctgctctcccgtagagtgaaaccggactgagcagggctggctgagattgtggatctcaccctttggaatgtgagtgctcgcggacaaagggcagccaagggtggggactgtcacttctgctatcccagaccaacatttttgattctgaggtttgatttaccgggatttgtttttcaactgcgtaaaattaaagaatctttactaccatatttctcattttcttccaatacagaaccccatgtttacttgcccggtttaataattctgcttctctt

SEQ ID NO: 28834 - DNA, 601 bp, Human
atgaaaactacagaaatatttcacaggatggctgtggttctgttctcatgaccagcaaacccctggtgccctgttgctattaggaaagagatagaagaagctccttttgtctgcaggggtcatttttctggggatactgaagggttctggaggttagccaaaatgagactgggtgatgtggtgagcatgatgagagctgttctaaggtagaaacaccgtaatggccctggctgctctcccgtagagtgaaaccggactgagcagggctggctgagattgtggatctcaccctttggaatgwgagtgctcgcggacaaagggcagccaagggtggggactgtcacttctgctatcccagaccaacatttttgattctgaggtttgatttaccgggatttgtttttcaactgcgtaaaattaaagaatctttactaccatatttctcattttcttccaatacagaaccccatgtttacttgcccggtttaataattctgcttctcttcgcgtctgtggccctggtggctgccatcatctttggcgtttgctataggaaaaaagggaaagcactcacaggtattgtgtctatggtggtttttgc

SEQ ID NO: 28835 - DNA, 601 bp, Human
agaaatatttcacaggatggctgtggttctgttctcatgaccagcaaacccctggtgccctgttgctattaggaaagagatagaagaagctccttttgtctgcaggggtcatttttctggggatactgaagggttctggaggttagccaaaatgagactgggtgatgtggtgagcatgatgagagctgttctaaggtagaaacaccgtaatggccctggctgctctcccgtagagtgaaaccggactgagcagggctggctgagattgtggatctcaccctttggaatgtgagtgctcgcrgacaaagggcagccaagggtggggactgtcacttctgctatcccagaccaacatttttgattctgaggtttgatttaccgggatttgtttttcaactgcgtaaaattaaagaatctttactaccatatttctcattttcttccaatacagaaccccatgtttacttgcccggtttaataattctgcttctcttcgcgtctgtggccctggtggctgccatcatctttggcgtttgctataggaaaaaagggaaagcactcacaggtattgtgtctatggtggtttttgcaaaccaatctt

SEQ ID NO: 28836 - DNA, 601 bp, Human
cgcctaagtggagataaggtagagtgaacagttgttggtgcctctgttaagtacattcaacagttaggctggtagagccatcctagtcacatattgagcacccccccccacccccactttttttgagacggagtctcgctctgtgcctcaggctggagtgcaggggtgcaatctcagctcactgcaacctccacctcccagggtcaagtgattctcctgcctcagcctcctgagcagctgggattacaggagcccactaccaagcctggctaattttttgtgtttttaatagagacagggyttcaccgtgttggccacgctagtctcgaactcctggcctcaagtgatccacctgcctcagcctcccaaagtgctgggattataggcaggagccaccgcgcccggcctcagctcctttgcttacagggcatttccaggttcagtgatcaaacctcaaattccaggatggatccctgcagagcagctcaaagcccaagtccaggctcattctagatgcctgttttctttgtctttgtttccacttctgtcatctctgtgttcatgtcattttttttagtaccaatcttgattgtctggtaca

SEQ ID NO: 28837 - DNA, 601 bp, Human
accatagtacatgtatcggaatcaagaaatttaacaatggtacaatactattattcaacccacatttgatattaaattttcattaattatttcattatgtcctttagatctttctttcttttcttcttcttacttttttttttttttttttttttttgagacagaatctcactctctcatccaggcttgagtgcaatggcgcaatctcggctcactgcaacctctgcctcccaggttcaagcgattcttctgcctcagccttcctgagtatctgggattacaggtgcccgccaccacaccmaactaatttttgtatttttagtagagacagggtttcaccgtgttgcccaggctggtcttgaactcctgaactcaggtgatccacccaccttggtctcccaaaatcctgggattgcaggcatgagccaccacgcctggttagatctactttctttgatataaaatgtatacatttgaaagcataagctcaaactgatttctctaattgccaggccaactcaacatgattcattctggtctttccctttcccatatttgaatctttctttccccagctgtatgaaacctggctcctattatt

SEQ ID NO: 28838 - DNA, 601 bp, Human
ataaattcagaggcgctgcgctccgattctggcagtgcagctgtgggaacctctccacgcgcacgaactcagccaacgatttctgatagatttttgggagtttgaccagagatgcaaggggtgaaggagcgcttcctaccgttagggaactctggggacagagcgccccggccgcctgatggccgaggcagggtgcgacccaggacccaggacggcgtcgggaaccataccatggcccggatccccaagaccctaaagttcgtcgtcgtcatcgtcgcggtcctgctgccagtgagtcccsgccgcggtccctggctggggaagagcgcacctggcgccgggagggggcagggagacggggacacggcagggatgcctggccctggtcacctgcggccgggcatgtccgggcaggacgaactcgccgtcggagtcaggggaagaactgggtccccgggctgggcaggagggacccggccgcgagggagcagagaggcggtccccctggctgccccgagcccgcgaagggagggaagttccagaatcgagagagggagggagtcaaggtggaacccatagagtgagcctcctgaagacacag

SEQ ID NO: 28839 - DNA, 601 bp, Human
ggccgcctgatggccgaggcagggtgcgacccaggacccaggacggcgtcgggaaccataccatggcccggatccccaagaccctaaagttcgtcgtcgtcatcgtcgcggtcctgctgccagtgagtcccggccgcggtccctggctggggaagagcgcacctggcgccgggagggggcagggagacggggacacggcagggatgcctggccctggtcacctgcggccgggcatgtccgggcaggacgaactcgccgtcggagtcaggggaagaactgggtccccgggctgggcaggagsgacccggccgcgagggagcagagaggcggtccccctggctgccccgagcccgcgaagggagggaagttccagaatcgagagagggagggagtcaaggtggaacccatagagtgagcctcctgaagacacagagcggttgcctctctcattaattaattaattagttaataaaattaaccccatgtttacattcttaaacgtgttccttggagatcggtttaaccaacagccagtgaaaaaacttttcagcgctgtctttagcaactttcacctcctctgtcctgaaagtggcaggaagcc

SEQ ID NO: 28840 - DNA, 601 bp, Human
tagctttcattctttactagtctaagatgtaaaacataacacatcacattgctatgtatttttgtttcctcatggtattaggaattttcaaggatataggagttttttggtactgggagtagaccagggtatccagatgagacagcagggaagactgaattctgagctgtgcacttggaaaaccctggtcagttggggccagtccctgccacccaccatgcctgtgaatggagataaggtctccatcctcagcctgtcagggtgacttcagatgagcctggagctgagttcagttcctgaycccaggtcctggctctgtcaatgctgggctggtccaatctgtgcgccaggtccttccacaccattcctctctctatcaaagtaggaattgagaagttccaacggctcagaatctcggactctcaggctgtcaaggactcctgagattgaaggttgtgaatggctgggccctgccgtgctccccctctggctctgtgactctggtgtggccccagctcctgcctgtaaagtgaagaggaggtaaaaatcttcagcagccctgtgtaaacctcagagggctgtgttaccaggtgtgggagga

SEQ ID NO: 28841 - DNA, 601 bp, Human
cataacacatcacattgctatgtatttttgtttcctcatggtattaggaattttcaaggatataggagttttttggtactgggagtagaccagggtatccagatgagacagcagggaagactgaattctgagctgtgcacttggaaaaccctggtcagttggggccagtccctgccacccaccatgcctgtgaatggagataaggtctccatcctcagcctgtcagggtgacttcagatgagcctggagctgagttcagttcctgaccccaggtcctggctctgtcaatgctgggctggtycaatctgtgcgccaggtccttccacaccattcctctctctatcaaagtaggaattgagaagttccaacggctcagaatctcggactctcaggctgtcaaggactcctgagattgaaggttgtgaatggctgggccctgccgtgctccccctctggctctgtgactctggtgtggccccagctcctgcctgtaaagtgaagaggaggtaaaaatcttcagcagccctgtgtaaacctcagagggctgtgttaccaggtgtgggaggacaaatcacatcctcagggctggtgtcactcactc

SEQ ID NO: 28842 - DNA, 601 bp, Human
ctccatcctcagcctgtcagggtgacttcagatgagcctggagctgagttcagttcctgaccccaggtcctggctctgtcaatgctgggctggtccaatctgtgcgccaggtccttccacaccattcctctctctatcaaagtaggaattgagaagttccaacggctcagaatctcggactctcaggctgtcaaggactcctgagattgaaggttgtgaatggctgggccctgccgtgctccccctctggctctgtgactctggtgtggccccagctcctgcctgtaaagtgaagaggagrtaaaaatcttcagcagccctgtgtaaacctcagagggctgtgttaccaggtgtgggaggacaaatcacatcctcagggctggtgtcactcactctggactggatccccaggcacctgtcctccatccagcagaggctgcccctgttcctacctgcaccctggtacttgctccctgagcttggggcagaagcttctgaagactagggtggagcaccacggggaggggccatggaggaacagaggagccagacgtcaagtgaggacagcgatggcactgcagggccacagcctggtttacct

SEQ ID NO: 28843 - DNA, 601 bp, Human
ggcagctggtatcctgcttccagccagagaatgcacatcttcatgtagtggatttcctaacaacccggggagatgaaggtaggttgtttttcctgttttacaagtggtaaaatgagattcagggctagagttctctgagcagctgcttctctgatctctgtcctgcccttggcctctgggagctcttatggttcctcagcagagttcacagggctcttggagcctgtccttcggccttgagctgaggccacaactgcgcgcacttcataggcttgaggggaaagtgattcatccaggaagkaaacagtgagccctttactctgagaacacctgtgcctggagtccgccggagtttgggaggacaaatgaaccccatgtgaatcctgttccctggagcccgcagtgtggtgggagaggtgacaccagggattatataactaataggaggtagcatgaaggaggcctgagatctcactacccttgcctccccctcctccagagaggctgtgctggagagaggccatgctgttgcagggccataggatgtggtactgttggcctggaagatgtggtttgattacagtcaccattgagggtcagg

SEQ ID NO: 28844 - DNA, 601 bp, Human
tttagatgcccccccacccgatttttttttttttttttttagctgggcctgagaatttgattcacctaagagaggtccacaggagacaagcacacacatttatttaattcaagttttacctggcatggaagaacctgtgagagtcagttacttatttactgaattagaccaagtaactcatgaagaagcaagtaactatgtgaggagctaaaaagatgagagtggatccattctaacatggtctgcacagtaccctcttggcctcgacttctcatccttaaaaataaggaaattgtcagcygggtgcggtggctcacgcctgtaatcccagcactttgggaggtcaaggcaggtggatcacgaggtcaggagatcgagaccatcctggctaacacagtgaaaccccgtctctactgaaaatacaaaacaattagcggagtgtggtggcgggtgcctgtagtcccagctactggagaggctgaggcaggagaatggtgagaacctgggaagcagagctttcagaaaaaaaaaaaaaggagattgtcctatgtttccctggggactttcatctcctgcttttaggaaacacaaaagaggtcaa

SEQ ID NO: 28845 - DNA, 601 bp, Human
ttttagctgggcctgagaatttgattcacctaagagaggtccacaggagacaagcacacacatttatttaattcaagttttacctggcatggaagaacctgtgagagtcagttacttatttactgaattagaccaagtaactcatgaagaagcaagtaactatgtgaggagctaaaaagatgagagtggatccattctaacatggtctgcacagtaccctcttggcctcgacttctcatccttaaaaataaggaaattgtcagctgggtgcggtggctcacgcctgtaatcccagcacttygggaggtcaaggcaggtggatcacgaggtcaggagatcgagaccatcctggctaacacagtgaaaccccgtctctactgaaaatacaaaacaattagcggagtgtggtggcgggtgcctgtagtcccagctactggagaggctgaggcaggagaatggtgagaacctgggaagcagagctttcagaaaaaaaaaaaaaggagattgtcctatgtttccctggggactttcatctcctgcttttaggaaacacaaaagaggtcaaaggatcttcttgcacctgttgtttttcaatagcctt

SEQ ID NO: 28846 - DNA, 601 bp, Human
acatttatttaattcaagttttacctggcatggaagaacctgtgagagtcagttacttatttactgaattagaccaagtaactcatgaagaagcaagtaactatgtgaggagctaaaaagatgagagtggatccattctaacatggtctgcacagtaccctcttggcctcgacttctcatccttaaaaataaggaaattgtcagctgggtgcggtggctcacgcctgtaatcccagcactttgggaggtcaaggcaggtggatcacgaggtcaggagatcgagaccatcctggctaacacrgtgaaaccccgtctctactgaaaatacaaaacaattagcggagtgtggtggcgggtgcctgtagtcccagctactggagaggctgaggcaggagaatggtgagaacctgggaagcagagctttcagaaaaaaaaaaaaaggagattgtcctatgtttccctggggactttcatctcctgcttttaggaaacacaaaagaggtcaaaggatcttcttgcacctgttgtttttcaatagcctttaattcataatagtcaattgaccagggtgggcagggtgcgatggctcacacctgtagtc

SEQ ID NO: 28847 - DNA, 601 bp, Human
taaaaagatgagagtggatccattctaacatggtctgcacagtaccctcttggcctcgacttctcatccttaaaaataaggaaattgtcagctgggtgcggtggctcacgcctgtaatcccagcactttgggaggtcaaggcaggtggatcacgaggtcaggagatcgagaccatcctggctaacacagtgaaaccccgtctctactgaaaatacaaaacaattagcggagtgtggtggcgggtgcctgtagtcccagctactggagaggctgaggcaggagaatggtgagaacctgggargcagagctttcagaaaaaaaaaaaaaggagattgtcctatgtttccctggggactttcatctcctgcttttaggaaacacaaaagaggtcaaaggatcttcttgcacctgttgtttttcaatagcctttaattcataatagtcaattgaccagggtgggcagggtgcgatggctcacacctgtagtcctgccaagacaggcagatcacttgagcccaggagttcaagaccagccagggcaacatagcaaaacccggtcacaacaacaacaacaaaaaaccaaacaaacagaaaaacagaa

SEQ ID NO: 28848 - DNA, 601 bp, Human
tggatccattctaacatggtctgcacagtaccctcttggcctcgacttctcatccttaaaaataaggaaattgtcagctgggtgcggtggctcacgcctgtaatcccagcactttgggaggtcaaggcaggtggatcacgaggtcaggagatcgagaccatcctggctaacacagtgaaaccccgtctctactgaaaatacaaaacaattagcggagtgtggtggcgggtgcctgtagtcccagctactggagaggctgaggcaggagaatggtgagaacctgggaagcagagctttcagaaaaaaaaaaaaaggagattgtcctatgtttccctggggactttcatctcctgcttttaggaaacacaaaagaggtcaaaggatcttcttgcacctgttgtttttcaatagcctttaattcataatagtcaattgaccagggtgggcagggtgcgatggctcacacctgtagtcctgccaagacaggcagatcacttgagcccaggagttcaagaccagccagggcaacatagcaaaacccggtcacaacaacaacaacaaaaaaccaaacaaacagaaaaacagaaaaacacagaaaatt

SEQ ID NO: 28849 - DNA, 601 bp, Human
gaacctgggaagcagagctttcagaaaaaaaaaaaaaggagattgtcctatgtttccctggggactttcatctcctgcttttaggaaacacaaaagaggtcaaaggatcttcttgcacctgttgtttttcaatagcctttaattcataatagtcaattgaccagggtgggcagggtgcgatggctcacacctgtagtcctgccaagacaggcagatcacttgagcccaggagttcaagaccagccagggcaacatagcaaaacccggtcacaacaacaacaacaaaaaaccaaacaaacaraaaaacagaaaaacacagaaaattatgtcgtgtgaaggaatccacacagaatgcttaccatctgattccatttctcattaaaattcgaccaatctattctgacaaaaagcagaattattgctggggacataggagcaaagcggaagagaggattacattgaagaatgaagaaattctggggtgtggtggacatgtcattttcttatcgtggtggtagttccacaatgtatacacacgtctcaatctaccaaactacatgcttcaaaaatgtacactttgtttcatgcccattatacctca

SEQ ID NO: 28850 - DNA, 601 bp, Human
tctggggtgtggtggacatgtcattttcttatcgtggtggtagttccacaatgtatacacacgtctcaatctaccaaactacatgcttcaaaaatgtacactttgtttcatgcccattatacctcaatgaatccatttttaaaaaaccttcaatagaatgtaaacacttgagtgtatactgtattccctatagcacttgcacatagatcatggaaataggtatgcataaaaagtcagtttatccaattaaaatggaattctaaaaggtaattaacattaaaatgtgcagggggaaaaggaktaaaaaaattagactagacaatcatagcttaaatggtaaacttacaggtctatttcaactatatcaattattgcactccctgtaaatccactgagcactacagttcaatggtagaaatgtttggaagggctgagaaagcaagactcaactatatcttgtctatatgagatgggccttaaaaggaagacacagatgttgtctgttgaaagtaaatagatggaaaaagatacaccatgcagagtgtaaggccaagaaaactgccatggctatctcagtatcagatgaagttgattttgttag

SEQ ID NO: 28851 - DNA, 601 bp, Human
ccacaatgtatacacacgtctcaatctaccaaactacatgcttcaaaaatgtacactttgtttcatgcccattatacctcaatgaatccatttttaaaaaaccttcaatagaatgtaaacacttgagtgtatactgtattccctatagcacttgcacatagatcatggaaataggtatgcataaaaagtcagtttatccaattaaaatggaattctaaaaggtaattaacattaaaatgtgcagggggaaaaggagtaaaaaaattagactagacaatcatagcttaaatggtaaacttayaggtctatttcaactatatcaattattgcactccctgtaaatccactgagcactacagttcaatggtagaaatgtttggaagggctgagaaagcaagactcaactatatcttgtctatatgagatgggccttaaaaggaagacacagatgttgtctgttgaaagtaaatagatggaaaaagatacaccatgcagagtgtaaggccaagaaaactgccatggctatctcagtatcagatgaagttgattttgttagcggtggatgagatccgagttaccctacgttgaaggcggcgaatcc

SEQ ID NO: 28852 - DNA, 601 bp, Human
aggagtaaaaaaattagactagacaatcatagcttaaatggtaaacttacaggtctatttcaactatatcaattattgcactccctgtaaatccactgagcactacagttcaatggtagaaatgtttggaagggctgagaaagcaagactcaactatatcttgtctatatgagatgggccttaaaaggaagacacagatgttgtctgttgaaagtaaatagatggaaaaagatacaccatgcagagtgtaaggccaagaaaactgccatggctatctcagtatcagatgaagttgattttrttagcggtggatgagatccgagttaccctacgttgaaggcggcgaatccgtatgcgtccacagcaccttcagctcttcgcctcctgagaagaaagaactggtttgaggggcataaggcagaagcagagatggaggcaagtttcagagcaggagtgaaagtttattaaaaagctttagaacaggaaggaaaggaaggaacaggaaggaaaggaaggaacagaaagaaaagaaggaaagtacacttggaagatggccaagcaggtgacttgagaaacagtacgcagccggaccgcctgagtt

SEQ ID NO: 28853 - DNA, 601 bp, Human
ttagcggtggatgagatccgagttaccctacgttgaaggcggcgaatccgtatgcgtccacagcaccttcagctcttcgcctcctgagaagaaagaactggtttgaggggcataaggcagaagcagagatggaggcaagtttcagagcaggagtgaaagtttattaaaaagctttagaacaggaaggaaaggaaggaacaggaaggaaaggaaggaacagaaagaaaagaaggaaagtacacttggaagatggccaagcaggtgacttgagaaacagtacgcagccggaccgcctgagttggggttttataggttggcctacttccaggatcttgccttacttctccccactcctgaaatcttattgggaagctgctgatcagtttcaagtgttttctatgtattaggaaactgcttttttctggcatcggctgtaaccagttattactttagagacacagttatcaactacctgatggtcgcccaacactgctggtgtcagaagcggggacccctctcctgtcctgctcatacctaactagctgcctactgtgacaattttaggacattgaatattatgggagatgaaaagggacctttg

SEQ ID NO: 28854 - DNA, 601 bp, Human
cgagttaccctacgttgaaggcggcgaatccgtatgcgtccacagcaccttcagctcttcgcctcctgagaagaaagaactggtttgaggggcataaggcagaagcagagatggaggcaagtttcagagcaggagtgaaagtttattaaaaagctttagaacaggaaggaaaggaaggaacaggaaggaaaggaaggaacagaaagaaaagaaggaaagtacacttggaagatggccaagcaggtgacttgagaaacagtacgcagccggaccgcctgagttggggttttataggttggcmtacttccaggatcttgccttacttctccccactcctgaaatcttattgggaagctgctgatcagtttcaagtgttttctatgtattaggaaactgcttttttctggcatcggctgtaaccagttattactttagagacacagttatcaactacctgatggtcgcccaacactgctggtgtcagaagcggggacccctctcctgtcctgctcatacctaactagctgcctactgtgacaattttaggacattgaatattatgggagatgaaaagggacctttgtagttaaaagggttaatt

SEQ ID NO: 28855 - DNA, 601 bp, Human
aactgcttttttctggcatcggctgtaaccagttattactttagagacacagttatcaactacctgatggtcgcccaacactgctggtgtcagaagcggggacccctctcctgtcctgctcatacctaactagctgcctactgtgacaattttaggacattgaatattatgggagatgaaaagggacctttgtagttaaaagggttaattcttcaaggagtataataacaacaaattgtatatgcctagtaatacatcttcaaaacacatgacacaaaaatagaattaaaaagagattaamtcagctgtttctctgcacttgctagcatgattagatgaaaatgccagtaaagtggcaagcgatctgcacactatcaaccaccttgatttaactgacatttaaagagcaggagtggaacattcactgaacactcattcctttctatgctcatgatactttcaccaagatagaccaggttctgggctataaaacacacaatatgatctctaaacttaatgaaactaaactggaaatcagtaacaatatccacagagaattctaaaattttgatattgaacaacacacttctaaaaatctgtg

SEQ ID NO: 28856 - DNA, 601 bp, Human
tagtaatacatcttcaaaacacatgacacaaaaatagaattaaaaagagattaactcagctgtttctctgcacttgctagcatgattagatgaaaatgccagtaaagtggcaagcgatctgcacactatcaaccaccttgatttaactgacatttaaagagcaggagtggaacattcactgaacactcattcctttctatgctcatgatactttcaccaagatagaccaggttctgggctataaaacacacaatatgatctctaaacttaatgaaactaaactggaaatcagtaacaatakccacagagaattctaaaattttgatattgaacaacacacttctaaaaatctgtggttcagacaggaaatcaaaagggaaggtaagatatttcaaagtaagtaataatgacaatataacacatcaaaagtggtgcgaaatagctaacagtgctcagggtgaaatatacagctttcaatgtttgtattaaaaaactgggggttagggagatggggagttactgctgaagggtatgtagttcctttctggagtgataaaaatattctaaaattgattatagtgatgattgcatagctatgagt

SEQ ID NO: 28857 - DNA, 601 bp, Human
aaaatagaattaaaaagagattaactcagctgtttctctgcacttgctagcatgattagatgaaaatgccagtaaagtggcaagcgatctgcacactatcaaccaccttgatttaactgacatttaaagagcaggagtggaacattcactgaacactcattcctttctatgctcatgatactttcaccaagatagaccaggttctgggctataaaacacacaatatgatctctaaacttaatgaaactaaactggaaatcagtaacaatatccacagagaattctaaaattttgatattgaacaacacacttctaaaaatctgtggttcagacaggaaatcaaaagggaaggtaagatatttcaaagtaagtaataatgacaatataacacatcaaaagtggtgcgaaatagctaacagtgctcagggtgaaatatacagctttcaatgtttgtattaaaaaactgggggttagggagatggggagttactgctgaagggtatgtagttcctttctggagtgataaaaatattctaaaattgattatagtgatgattgcatagctatgagtatattaaaaactgctgaagtgtagacttta

SEQ ID NO: 28858 - DNA, 601 bp, Human
atttaactgacatttaaagagcaggagtggaacattcactgaacactcattcctttctatgctcatgatactttcaccaagatagaccaggttctgggctataaaacacacaatatgatctctaaacttaatgaaactaaactggaaatcagtaacaatatccacagagaattctaaaattttgatattgaacaacacacttctaaaaatctgtggttcagacaggaaatcaaaagggaaggtaagatatttcaaagtaagtaataatgacaatataacacatcaaaagtggtgcgaaatrgctaacagtgctcagggtgaaatatacagctttcaatgtttgtattaaaaaactgggggttagggagatggggagttactgctgaagggtatgtagttcctttctggagtgataaaaatattctaaaattgattatagtgatgattgcatagctatgagtatattaaaaactgctgaagtgtagactttaaatgggtgaattatatgaataatcataattattaattatgtgaattgtgtctcactaaagctgtcaaaaaaagaaaaaacgtgaaaattatgggccgggcacggtggctc

SEQ ID NO: 28859 - DNA, 601 bp, Human
tttctatgctcatgatactttcaccaagatagaccaggttctgggctataaaacacacaatatgatctctaaacttaatgaaactaaactggaaatcagtaacaatatccacagagaattctaaaattttgatattgaacaacacacttctaaaaatctgtggttcagacaggaaatcaaaagggaaggtaagatatttcaaagtaagtaataatgacaatataacacatcaaaagtggtgcgaaatagctaacagtgctcagggtgaaatatacagctttcaatgtttgtattaaaaaaytgggggttagggagatggggagttactgctgaagggtatgtagttcctttctggagtgataaaaatattctaaaattgattatagtgatgattgcatagctatgagtatattaaaaactgctgaagtgtagactttaaatgggtgaattatatgaataatcataattattaattatgtgaattgtgtctcactaaagctgtcaaaaaaagaaaaaacgtgaaaattatgggccgggcacggtggctcacatctgtaattccagcactttgggaggccgaggagggtggatcacgaggtca

SEQ ID NO: 28860 - DNA, 601 bp, Human
tcatgatactttcaccaagatagaccaggttctgggctataaaacacacaatatgatctctaaacttaatgaaactaaactggaaatcagtaacaatatccacagagaattctaaaattttgatattgaacaacacacttctaaaaatctgtggttcagacaggaaatcaaaagggaaggtaagatatttcaaagtaagtaataatgacaatataacacatcaaaagtggtgcgaaatagctaacagtgctcagggtgaaatatacagctttcaatgtttgtattaaaaaactgggggttrgggagatggggagttactgctgaagggtatgtagttcctttctggagtgataaaaatattctaaaattgattatagtgatgattgcatagctatgagtatattaaaaactgctgaagtgtagactttaaatgggtgaattatatgaataatcataattattaattatgtgaattgtgtctcactaaagctgtcaaaaaaagaaaaaacgtgaaaattatgggccgggcacggtggctcacatctgtaattccagcactttgggaggccgaggagggtggatcacgaggtcagaaaatcga

SEQ ID NO: 28861 - DNA, 601 bp, Human
atagaccaggttctgggctataaaacacacaatatgatctctaaacttaatgaaactaaactggaaatcagtaacaatatccacagagaattctaaaattttgatattgaacaacacacttctaaaaatctgtggttcagacaggaaatcaaaagggaaggtaagatatttcaaagtaagtaataatgacaatataacacatcaaaagtggtgcgaaatagctaacagtgctcagggtgaaatatacagctttcaatgtttgtattaaaaaactgggggttagggagatggggagttactrctgaagggtatgtagttcctttctggagtgataaaaatattctaaaattgattatagtgatgattgcatagctatgagtatattaaaaactgctgaagtgtagactttaaatgggtgaattatatgaataatcataattattaattatgtgaattgtgtctcactaaagctgtcaaaaaaagaaaaaacgtgaaaattatgggccgggcacggtggctcacatctgtaattccagcactttgggaggccgaggagggtggatcacgaggtcagaaaatcgagaccatcctggctaacacg

SEQ ID NO: 28862 - DNA, 601 bp, Human
ggtggctcacatctgtaattccagcactttgggaggccgaggagggtggatcacgaggtcagaaaatcgagaccatcctggctaacacggtgaaaccctgtctctactaaaaatacaaaaaattagccaggcgtggtggcgggcacctgtagtcccagttacttgggaggctgaggcaggagaatagcatgaacctgggaggtggagcttgcagtgagccgagattgtgccactgcactccggcctgggagacagcgagactccatctcaaaaaaaaaaagaaaaagaaaaagaaaattayggcctgaggagctacattaatcaatcataaaatataagtgtaaatttaaaccaaacaaagtaacaggaaggagcataaatcaaagaatacaaaccacagaaagaactgacaaaaccaactgtgtgcggtggcttacgcctgtaatcccagtactttgggaggcccaggcaggcagatcacttgagctcaggagttaaaccactctgggcaacatggcgaaaccccagctctacaaaatatgtgaaaattagatgggcgttgtggcacacacctgtctttggggactgaggtggcaggacc

SEQ ID NO: 28863 - DNA, 601 bp, Human
gactccatctcaaaaaaaaaaagaaaaagaaaaagaaaattatggcctgaggagctacattaatcaatcataaaatataagtgtaaatttaaaccaaacaaagtaacaggaaggagcataaatcaaagaatacaaaccacagaaagaactgacaaaaccaactgtgtgcggtggcttacgcctgtaatcccagtactttgggaggcccaggcaggcagatcacttgagctcaggagttaaaccactctgggcaacatggcgaaaccccagctctacaaaatatgtgaaaattagatgggcrttgtggcacacacctgtctttggggactgaggtggcaggaccacttgagcctgggaggcagaggaggcaaaggttgtagtgaaccgagattacaccactgcactctgcgctccaacatggaggacagagggagacactgtctccaaaaaaaaaaaaaaaaaaaaaaaaggccaaaatgaaaagttggtcttctgaaaggattttaaaaaacactaataaacccctcattaaatgagagggagtaagagtgtgagagcagagaaaggagacgcagacatcgcctgaacctagagggactcc

SEQ ID NO: 28864 - DNA, 601 bp, Human
cctgaggagctacattaatcaatcataaaatataagtgtaaatttaaaccaaacaaagtaacaggaaggagcataaatcaaagaatacaaaccacagaaagaactgacaaaaccaactgtgtgcggtggcttacgcctgtaatcccagtactttgggaggcccaggcaggcagatcacttgagctcaggagttaaaccactctgggcaacatggcgaaaccccagctctacaaaatatgtgaaaattagatgggcgttgtggcacacacctgtctttggggactgaggtggcaggaccacktgagcctgggaggcagaggaggcaaaggttgtagtgaaccgagattacaccactgcactctgcgctccaacatggaggacagagggagacactgtctccaaaaaaaaaaaaaaaaaaaaaaaaggccaaaatgaaaagttggtcttctgaaaggattttaaaaaacactaataaacccctcattaaatgagagggagtaagagtgtgagagcagagaaaggagacgcagacatcgcctgaacctagagggactccaacccgggaaagaatgatttgggaaaagtgggttagcttcactgt

SEQ ID NO: 28865 - DNA, 601 bp, Human
gaaggagcataaatcaaagaatacaaaccacagaaagaactgacaaaaccaactgtgtgcggtggcttacgcctgtaatcccagtactttgggaggcccaggcaggcagatcacttgagctcaggagttaaaccactctgggcaacatggcgaaaccccagctctacaaaatatgtgaaaattagatgggcgttgtggcacacacctgtctttggggactgaggtggcaggaccacttgagcctgggaggcagaggaggcaaaggttgtagtgaaccgagattacaccactgcactctgcrctccaacatggaggacagagggagacactgtctccaaaaaaaaaaaaaaaaaaaaaaaaggccaaaatgaaaagttggtcttctgaaaggattttaaaaaacactaataaacccctcattaaatgagagggagtaagagtgtgagagcagagaaaggagacgcagacatcgcctgaacctagagggactccaacccgggaaagaatgatttgggaaaagtgggttagcttcactgtcaccaactgctagtcaggctttgatgtggaagaaagctacattttgtcttgtttagatccaggc

SEQ ID NO: 28866 - DNA, 601 bp, Human
ccacagaaagaactgacaaaaccaactgtgtgcggtggcttacgcctgtaatcccagtactttgggaggcccaggcaggcagatcacttgagctcaggagttaaaccactctgggcaacatggcgaaaccccagctctacaaaatatgtgaaaattagatgggcgttgtggcacacacctgtctttggggactgaggtggcaggaccacttgagcctgggaggcagaggaggcaaaggttgtagtgaaccgagattacaccactgcactctgcgctccaacatggaggacagagggagacmctgtctccaaaaaaaaaaaaaaaaaaaaaaaaggccaaaatgaaaagttggtcttctgaaaggattttaaaaaacactaataaacccctcattaaatgagagggagtaagagtgtgagagcagagaaaggagacgcagacatcgcctgaacctagagggactccaacccgggaaagaatgatttgggaaaagtgggttagcttcactgtcaccaactgctagtcaggctttgatgtggaagaaagctacattttgtcttgtttagatccaggcagttgaactgagcccaacataagcagc

SEQ ID NO: 28867 - DNA, 601 bp, Human
ataaacccctcattaaatgagagggagtaagagtgtgagagcagagaaaggagacgcagacatcgcctgaacctagagggactccaacccgggaaagaatgatttgggaaaagtgggttagcttcactgtcaccaactgctagtcaggctttgatgtggaagaaagctacattttgtcttgtttagatccaggcagttgaactgagcccaacataagcagctttcattgtaaccattttggttttgcttaaattaatttcctactttaaaacactcccaacttaaagaaaagttacaaaarctatacaataaaaacatttgaaaaaatggctgttggcatgatgaaagctattattgaattctttagtgtgtactttctacaaacaaggaaattaacatcaacacattaccactatctatccgcactctattccgatttctccagttgtcttctagttgtcatttataacatagagatcatggccagaatccctgaattgctgtttcatcttttttgtcactctttgatatttagtgggagcagcttgacaaggtcctttgtaaagcagtaattaattacttaatgtttgatgctatatcc

SEQ ID NO: 28868 - DNA, 601 bp, Human
tttaaaacactcccaacttaaagaaaagttacaaaaactatacaataaaaacatttgaaaaaatggctgttggcatgatgaaagctattattgaattctttagtgtgtactttctacaaacaaggaaattaacatcaacacattaccactatctatccgcactctattccgatttctccagttgtcttctagttgtcatttataacatagagatcatggccagaatccctgaattgctgtttcatcttttttgtcactctttgatatttagtgggagcagcttgacaaggtcctttgtaamgcagtaattaattacttaatgtttgatgctatatcctgactttctgtaaggttatatatattataaccttcatttgtaaagctgagtatgtttaagtgtgtgtctgtgtgtatttgtgtgtgtgtgagtgagagacagaattcacctattggtcaattaaacacttggtgaaactaaatatattaaatgctatttctgcatgaagggctcatatgtgtgtggttttttaaaattcttataaaatcttttctttccaaccatggtggcatgtgcctcttatccacatttcttgggagactg

SEQ ID NO: 28869 - DNA, 601 bp, Human
ttccgatttctccagttgtcttctagttgtcatttataacatagagatcatggccagaatccctgaattgctgtttcatcttttttgtcactctttgatatttagtgggagcagcttgacaaggtcctttgtaaagcagtaattaattacttaatgtttgatgctatatcctgactttctgtaaggttatatatattataaccttcatttgtaaagctgagtatgtttaagtgtgtgtctgtgtgtatttgtgtgtgtgtgagtgagagacagaattcacctattggtcaattaaacactyggtgaaactaaatatattaaatgctatttctgcatgaagggctcatatgtgtgtggttttttaaaattcttataaaatcttttctttccaaccatggtggcatgtgcctcttatccacatttcttgggagactgaagcaggaggatcacttcaggccaggagttcaagcctatagtaagatatgatcacacctgtgaatagccactgcattccagcctgggcaacatagcaagactctgtatcaaaaaaacaaaatagctcttcttgctcccattatctggggtaaatttatgttataat

SEQ ID NO: 28870 - DNA, 601 bp, Human
tcttttttttttttatttgagatggagtctcgcactgtcaccacattggagtgcaatggcgcgatcttggctcactgcaacctctgcctctcaggttcaagctattctcctgcctcagcctcctgagtagctgggattacaggtgtgtgccaccacacccagctaatttttgtatttttagtagagacagggtttcaccgtgttggccaggatggtctcgatctcttgaccttgtgatccacctgcctcagacttccacattgctgggattacaagcttgagccatcgcgcttgcctgtattttttttttttttatagaaaatagctggccctaacaggccaagggacaaacacaggtacgaaagaatgaaagtttggagctggaaaaaatgtccaagctctgatgggttttgtcacttggggtgaagggaatgtgagatggagcctgggaggggtgaggtctggaagtcactcacacccatcactcctttgtccccacaggtcctagcttactctgccaccactgcccggcaggaggaagttccccagcagacagtggccccacagcaacagaggcacagcttcaagggggaggagtgtc

SEQ ID NO: 28871 - DNA, 601 bp, Human
cgcgatcttggctcactgcaacctctgcctctcaggttcaagctattctcctgcctcagcctcctgagtagctgggattacaggtgtgtgccaccacacccagctaatttttgtatttttagtagagacagggtttcaccgtgttggccaggatggtctcgatctcttgaccttgtgatccacctgcctcagacttccacattgctgggattacaagcttgagccatcgcgcttgcctgtattttttttttttttatagaaaatagctggccctaacaggccaagggacaaacacaggtaygaaagaatgaaagtttggagctggaaaaaatgtccaagctctgatgggttttgtcacttggggtgaagggaatgtgagatggagcctgggaggggtgaggtctggaagtcactcacacccatcactcctttgtccccacaggtcctagcttactctgccaccactgcccggcaggaggaagttccccagcagacagtggccccacagcaacagaggcacagcttcaagggggaggagtgtccagcaggtgcactcttatttttaaaaatcagtttatttttaattgacagataaacattg

SEQ ID NO: 28872 - DNA, 601 bp, Human
tccagacaggagcctgtccttcccctgacaccttctcagggacattggagagggagggtggctccccttttatcccacctggctagctttccctcaggagtcctcacctccctctctgtgtgtacccaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccrgggactcctgccccagctgctgaagagacaatgaccaccagcccggggactcctgccccagctgctgaagagacaatgaccaccagcccggggactcctgccccagctgctgaagagacaatgatcaccagcccggggactcctgcctcttctcattacctctcatgcaccatcgtagggatcatagttctaattgtgcttctgattgtgtttgtttgaaagacttcactgtggaagaaattccttccttacctgaaaggttcaggtaggcgctggctgagggcggggggcgctggacac

SEQ ID NO: 28873 - DNA, 601 bp, Human
ccctcaggagtcctcacctccctctctgtgtgtacccaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccggggactcctgccccagctgctgaagagacaatgaccaccagcccggggactcctgccccagctgctgaagagacaatgaccaccagcccrgggactcctgccccagctgctgaagagacaatgatcaccagcccggggactcctgcctcttctcattacctctcatgcaccatcgtagggatcatagttctaattgtgcttctgattgtgtttgtttgaaagacttcactgtggaagaaattccttccttacctgaaaggttcaggtaggcgctggctgagggcggggggcgctggacactctctgccctgcctccctctgctgtgttcccacagacagaaacgcctgcccctgccccaagtcctggtgtctccagcctggctctatctt

SEQ ID NO: 28874 - DNA, 601 bp, Human
ccaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccggggactcctgccccagctgctgaagagacaatgaccaccagcccggggactcctgccccagctgctgaagagacaatgaccaccagcccggggactcctgccccagctgctgaagagacaatgaycaccagcccggggactcctgcctcttctcattacctctcatgcaccatcgtagggatcatagttctaattgtgcttctgattgtgtttgtttgaaagacttcactgtggaagaaattccttccttacctgaaaggttcaggtaggcgctggctgagggcggggggcgctggacactctctgccctgcctccctctgctgtgttcccacagacagaaacgcctgcccctgccccaagtcctggtgtctccagcctggctctatcttcctccttgtgatcgtcccatccccacatcccgtgc

SEQ ID NO: 28875 - DNA, 601 bp, Human
aggccatttaatgggaaaaatcatcatttcaacgaatggcaactggatagccacatgcaaaagaatgcagttggacgcttatctgatgccatttacaaaaattaactgaaaatgcatcaagagttaaagtacaaaactcttaggagaaaacatggggataaagcttcataaccttggatttggcaaaggatcaataagtatctgttgaatagaagaaccagaaactgtaggaaacagaaaacttgaagaacatggaaaaggaatgttattgatgaattttgagataatttttgtatatagyatagggtaaggaaaagagaggtgtaaaggattagagatcagtcttagaatgtacctggtggacacaactctcccaaagggctatgttcccattgctgtgtgccaattgattgatcatgaagtttgatggttgcagctgagctaggtacgacctgtggggacaaagcagggactggcatgagtggcttccagatctcacccattacaagatcaatctcacattccattcccccaagcctccaaaattagacagaacttgcatctttctcccagttctaaaactcaaccatttgtttgtgct

SEQ ID NO: 28876 - DNA, 601 bp, Human
agatctagaccatcctggttaacacggtgaaaccccgtctctactaaaaaatacaaaaaattagctgggcgtggtggcaggcgcctgtagtccctgctacttggaaggctgaggcaggagaatggtgtgaacccgggaggcagagcttgcagtgagccgagatcgcgccactgcactccagcctgggcaacagagtgagactccatctcaaaaacaaaaaacaaaacaaaacaaaaaagaattatataccaggaccaaataagttttatcctaggaatgaaaggttggttcaacatcccaraataaattgatgtaacaaattatatcaatagaatgaaaaccaaaagtcacatgattatctcaaaaacacagagaaagcattttactaactccaacaccctttcatgataaaaatcacaaaataatctaggaataaaagtgaacttcctcaacctgataaagaatatctacaaaaacccacagctaacattatatttaatggtgaacaactgaaagatgttctccaaaaaagatatctgttttcactacttttattcaatatggtactggaggctctagccaggacaattaggtaagaaaa

SEQ ID NO: 28877 - DNA, 601 bp, Human
ggttcaagcgattatcctgcctcagcctcagcctcccgagtagctgggactacaggtgcctgccaccatgcccagctaattttttgtatttttagtagagacagggtttcactgtgttagccaggatggtctcgatctcctgacctcgtgatccgcctgccttggcctcccaaagtgctgggattacaggtgtgagccactgcgcccggccaatgtctgtgtttctatcttagtttttaagaaaaaaatttttaagtaaaaaaaagtttaagttaaaaatacaaaaatgtttatagaatamgaatataaagaaagaacattttttgtacagctgtacagtttttgttttttaagctaagtgttaaaacgagtgaaaaagttttaaaaattaaaaagtttataaagtaaaatagttacacgaagttaatattgaaggaaggaaaaaaaaatttacagatttggtgtagcctaaatgtacagtgtttataaagtccatagtagtgtacaggaatgtcccaggccttcacattcactcaccactcactgactcacccagacaagatccagtcctgcaagctccattcatggtaagtgccctaga

SEQ ID NO: 28878 - DNA, 601 bp, Human
ctgtcacccaggctggagtgcagtggcgcaatctcagctcactacaacctctgcctctcaggttcaagcgattatcctgcctcagcctcagcctcccgagtagctgggactacaggtgcctgccaccatgcccagctaattttttgtatttttagtagagacagggtttcactgtgttagccaggatggtctcgatctcctgacctcgtgatccgcctgccttggcctcccaaagtgctgggattacaggtgtgagccactgcgcccggccaatgtctgtgtttctatcttagtttttaasaaaaaaatttttaagtaaaaaaaagtttaagttaaaaatacaaaaatgtttatagaataagaatataaagaaagaacattttttgtacagctgtacagtttttgttttttaagctaagtgttaaaacgagtgaaaaagttttaaaaattaaaaagtttataaagtaaaatagttacacgaagttaatattgaaggaaggaaaaaaaaatttacagatttggtgtagcctaaatgtacagtgtttataaagtccatagtagtgtacaggaatgtcccaggccttcacattcactcaccact

SEQ ID NO: 28879 - DNA, 601 bp, Human
gctgggagccccttggctgttgtctcaccctgtgctgcacttccggcacatctcagcagaattgtcattccggaaagttcctggtttgcactgacatgctgtgttcctggtcgtggtgcagggacttctctcttcttcatctgatgacagagtacaaggttttgggaatgtgtttccctgacgtgtcccttgacctttcctcaccaccccaactccctccccctcagctcagctcaactcagtttgccaaggagttctgagggccagattctgcaccagcacactcgggctcacacaggayacccacccttcagctgtcaccaacacttggagtcatacaaaaggaccatgattcattatttattacatcagattagggaaaaagcaccatttagatcgcatggtcagtagcaaaggaggcacatggtatgtgagagagtctgcaagaagaggagcccttgggtgacttcccaaaaacccagcctgctgaggaagagggaggcgcctgagaaactgaaggctgagtgagcctgagaacctgccaggagcacacagcccagggggagcgtggccccagagcagacccgtaccaccgctgaaa

SEQ ID NO: 28880 - DNA, 601 bp, Human
gccctaagtcatggcctcctgtgcctagtgaacaagtcagcctggccaaggggactagtgctggggaggggtgagaaggggccactgcaggggacaggggtggggacaggcagatggaccaggaggggcaggttgcaggctcaggagacgccacaggctcagggacacctatgggggtggaggcaccatggggtcagggctgatagatacgggtacaaggagactcgggtctttttagggttccttgcttctgtgggttctttgaggctgctgggagccccttggctgttgtctcaccctstgctgcacttccggcacatctcagcagaattgtcattccggaaagttcctggtttgcactgacatgctgtgttcctggtcgtggtgcagggacttctctcttcttcatctgatgacagagtacaaggttttgggaatgtgtttccctgacgtgtcccttgacctttcctcaccaccccaactccctccccctcagctcagctcaactcagtttgccaaggagttctgagggccagattctgcaccagcacactcgggctcacacaggacacccacccttcagctgtcaccaacacttgga

SEQ ID NO: 28881 - DNA, 601 bp, Human
tcttatgatttcaagataaaatatttcatgtacctctgttgtgggccctaagtcatggcctcctgtgcctagtgaacaagtcagcctggccaaggggactagtgctggggaggggtgagaaggggccactgcaggggacaggggtggggacaggcagatggaccaggaggggcaggttgcaggctcaggagacgccacaggctcagggacacctatgggggtggaggcaccatggggtcagggctgatagatacgggtacaaggagactcgggtctttttagggttccttgcttctgtggkttctttgaggctgctgggagccccttggctgttgtctcaccctgtgctgcacttccggcacatctcagcagaattgtcattccggaaagttcctggtttgcactgacatgctgtgttcctggtcgtggtgcagggacttctctcttcttcatctgatgacagagtacaaggttttgggaatgtgtttccctgacgtgtcccttgacctttcctcaccaccccaactccctccccctcagctcagctcaactcagtttgccaaggagttctgagggccagattctgcaccagcacactcgg

SEQ ID NO: 28882 - DNA, 601 bp, Human
aaagatccccgggcctggggatccacatgaggccctgctaactcgggagatccttcaggagcggggagcataaagggaagtaggctaaaaacaaacaagtggaacatcactgttttctgctctgtgttttgctctgaacaaagctacataaatcccacaaccacttctcgtctcgactcttgtcatccagttgaggagctgactgccccctgcctggatgggcctgaccagtggaggaactggccctgccttcccagacttggctgggagatgaggggacccccagccttgggagagggayggatgacaccagggccctagggttgcacaggatgggaggatggggggtgatcacaaggaggaagatagagcccggccagagacactaggacttggggcaggggtgagcgtttctgtctgtgggaacagaagaaggcagggcagagagtgcccagagcccttgccctcagccagcacctacctgagccgatgcaacaacagacaatcagcacagccaccaacagcaacggaacaaccaaagtcacaaccaaaatcacccatatattatgtccattgcctgagaaaagacaggaaaagacag

SEQ ID NO: 28883 - DNA, 601 bp, Human
gaggggcccatgcagcactccttcttagagggcagtgttgggcaggggtgggctgggggctgggacactggacaaagatccccgggcctggggatccacatgaggccctgctaactcgggagatccttcaggagcggggagcataaagggaagtaggctaaaaacaaacaagtggaacatcactgttttctgctctgtgttttgctctgaacaaagctacataaatcccacaaccacttctcgtctcgactcttgtcatccagttgaggagctgactgccccctgcctggatgggcctgamcagtggaggaactggccctgccttcccagacttggctgggagatgaggggacccccagccttgggagagggacggatgacaccagggccctagggttgcacaggatgggaggatggggggtgatcacaaggaggaagatagagcccggccagagacactaggacttggggcaggggtgagcgtttctgtctgtgggaacagaagaaggcagggcagagagtgcccagagcccttgccctcagccagcacctacctgagccgatgcaacaacagacaatcagcacagccaccaacagcaac

SEQ ID NO: 28884 - DNA, 601 bp, Human
tgagcccctgatgcccccagctcctggagaaatcaactcaccctgtccatgcacttggggtcccctccacaacctagaagagaagacggttcccttagtggccagggaggggcccatgcagcactccttcttagagggcagtgttgggcaggggtgggctgggggctgggacactggacaaagatccccgggcctggggatccacatgaggccctgctaactcgggagatccttcaggagcggggagcataaagggaagtaggctaaaaacaaacaagtggaacatcactgttttctgctytgtgttttgctctgaacaaagctacataaatcccacaaccacttctcgtctcgactcttgtcatccagttgaggagctgactgccccctgcctggatgggcctgaccagtggaggaactggccctgccttcccagacttggctgggagatgaggggacccccagccttgggagagggacggatgacaccagggccctagggttgcacaggatgggaggatggggggtgatcacaaggaggaagatagagcccggccagagacactaggacttggggcaggggtgagcgtttctgtctgtg

SEQ ID NO: 28885 - DNA, 601 bp, Human
tccgtagggcacggctggacctgctgccaccaccccctcccagtgaggtcactccaggaagtccatgctcagcacatccaggacctgctgctggggccaggccctggtgctgggcttgggggctcaccccatccccagggtacaggctgtggggtaagggtctcacctgggctgtaggaagcacagggctacagaatggcccaccagcctgtatgatgctcaaaagggcctgtgtcccccatagtcaatgcacagcatccaggccacttcagagactcagggcagccatgagagcacgggkacccacccacctggactacactgtgggcaagaagcagttcctgagcccctgatgcccccagctcctggagaaatcaactcaccctgtccatgcacttggggtcccctccacaacctagaagagaagacggttcccttagtggccagggaggggcccatgcagcactccttcttagagggcagtgttgggcaggggtgggctgggggctgggacactggacaaagatccccgggcctggggatccacatgaggccctgctaactcgggagatccttcaggagcggggagcataaagggaag

SEQ ID NO: 28886 - DNA, 601 bp, Human
acctgaaaatattagaacaaaaaggggcaagaagaaattaggaatctactgtctgaatgtgagaaaaagcatgagtaggagagcaggccttctcataaagactctgagagacaagacactgatcttacgcaaaaacagtgaaaacaaagaaatgttcgtttaaaacaatgttttcctaaatagcaaaaaaaagaaaaaaaaagaaaagaaaaagcccttcaatgtcaaatcaaaatacatgaactggtacaaaccaacactagggggctgtgtgcatgtgtgtacctgtatgtgtgggtaygtgcatgtgtgtgtgcatgtgtgtacatgcatgtgtgtgcatgtgcgtgtatgtgcgtgtacacagtaagcagcactgttacaggctgacttggaaattgtgcttcttcttggaatcctccatacaaccatatgcagaaatttgggcagagatttagatccaaatatgtttaatgcaataataatttcagagtaaatttaaaatccctgctgttatgagcaagggctccctaacttctgtaggagcacacagtggagaccgtgcagccttattcagtcatcaacaaaccctgtgaccccc

SEQ ID NO: 28887 - DNA, 601 bp, Human
tctacagtagtgagcaatgaaaaggtaaaagtatctacagatttcactggttaaaaattaaagcttctacacctgaaaatattagaacaaaaaggggcaagaagaaattaggaatctactgtctgaatgtgagaaaaagcatgagtaggagagcaggccttctcataaagactctgagagacaagacactgatcttacgcaaaaacagtgaaaacaaagaaatgttcgtttaaaacaatgttttcctaaatagcaaaaaaaagaaaaaaaaagaaaagaaaaagcccttcaatgtcaaatsaaaatacatgaactggtacaaaccaacactagggggctgtgtgcatgtgtgtacctgtatgtgtgggtacgtgcatgtgtgtgtgcatgtgtgtacatgcatgtgtgtgcatgtgcgtgtatgtgcgtgtacacagtaagcagcactgttacaggctgacttggaaattgtgcttcttcttggaatcctccatacaaccatatgcagaaatttgggcagagatttagatccaaatatgtttaatgcaataataatttcagagtaaatttaaaatccctgctgttatgagcaagggctccc

SEQ ID NO: 28888 - DNA, 601 bp, Human
ggaaaaaccagacagtgactagaacaattcagggagtgcctcgctttgcactgaaacacaaaacaagttccatttagattataaagttatatgcaaaaatcacatcattgaaaaaaatatctccataagaagttagaggagttcgtcttgtgttggcaaaaggtctttctacagtagtgagcaatgaaaaggtaaaagtatctacagatttcactggttaaaaattaaagcttctacacctgaaaatattagaacaaaaaggggcaagaagaaattaggaatctactgtctgaatgtgagwaaaagcatgagtaggagagcaggccttctcataaagactctgagagacaagacactgatcttacgcaaaaacagtgaaaacaaagaaatgttcgtttaaaacaatgttttcctaaatagcaaaaaaaagaaaaaaaaagaaaagaaaaagcccttcaatgtcaaatcaaaatacatgaactggtacaaaccaacactagggggctgtgtgcatgtgtgtacctgtatgtgtgggtacgtgcatgtgtgtgtgcatgtgtgtacatgcatgtgtgtgcatgtgcgtgtatgtgcgtgtaca

SEQ ID NO: 28889 - DNA, 601 bp, Human
agcccggaaacctgcagcacatcactttcccccttgggtcaccatggagatggtgaaaaacctctggtcccacatagctcacagccactccccattgctggcattaccacctcagctccacccggtcagatcagtggcaacattagattcttataggagtgcaaaccctattgtgaactgtgcacgtcagggatctgggttgcatactccttatgagaatcttatgcctgattatctgtcaccgtctcccatcaccctcagataggaccatctcgttgcaggaaaacaagctcagggctcycactgactctacattatgataagttgtataattatttcattatatattataatgtgataagaatagaaataaagtacacaataaacgtaatgtgcttgaatcatccccaaaccatcttcacctcccagtccatagaaaaattgtcttccacaaaactggtccctggtgccaaaaggttggggaccattcgttaataatataatgtcttttgtatacacatacactgatgcatagatttggacaaagaatcacaagaaatgatatctcatagttacttgaggaaaaagacccagggcactg

SEQ ID NO: 28890 - DNA, 601 bp, Human
aagagatgggagaagacaatttagggtcttgatggtctatagcataggacccccagtttctggcatggaatgctctggaagagcactctcagcaatggggacaccagttaggacaccgtccctattcccaccatttctgctgcatctccaggagcaaaacacttactctcagtggggtcagcaccatttgctggaaccagcagcctcctcctctgagacccttcagcttctgccggtccctgtaacacacagtggggaatgccttggtctgagtcaggggtcctgcagtctagtactgacyctgaccatcagccagcccggaaacctgcagcacatcactttcccccttgggtcaccatggagatggtgaaaaacctctggtcccacatagctcacagccactccccattgctggcattaccacctcagctccacccggtcagatcagtggcaacattagattcttataggagtgcaaaccctattgtgaactgtgcacgtcagggatctgggttgcatactccttatgagaatcttatgcctgattatctgtcaccgtctcccatcaccctcagataggaccatctcgttgcaggaaaac

SEQ ID NO: 28891 - DNA, 601 bp, Human
tgtgtgggtaatcaggccacgtatatggaactaaacttattttgcaggtacattggtcctgctataatttgtctttggtggaagtggggccgagagagagagattgtgtttcagaagaaacacaatcttttagtattaaattaacctttgattcctgggtggccatgaggtcacccatggtatgtgaagcttcccatgatgcccctcctcaaccatgaagcagccagaaagatccaggaccagactctctgtgactgtgggattgataaatagaaagggagaactgaaatcaacccaatakgtccatcaaaaggtttttttgttgttgttgttgttttgataaacatagaaattgacccttctgttcttaaagctcaaatcttacatttgttttatctgagttcctttttcaggaaatgaccttcaggcctctcaaagtatcaaagaactgaaacttacaaatcactacatccaatgggatgctggacccctcattcatcttgattgcttccttacccctccctagttcctgttttcttacacattgttacttttttgtttttttgagacagagtcttgctctgtcacccaggctggagtg

SEQ ID NO: 28892 - DNA, 601 bp, Human
atgtgtttgcttacatatggttaataacaacgttttcttttacaatggaacacagttggataaaatggttattttctcagggctttgattgcaatggcctcgtgagaggttccagcaaagccaacttaggagagcctatgtggacagtgatttttgctgcactttgtgtgggtaatcaggccacgtatatggaactaaacttattttgcaggtacattggtcctgctataatttgtctttggtggaagtggggccgagagagagagattgtgtttcagaagaaacacaatcttttagtatkaaattaacctttgattcctgggtggccatgaggtcacccatggtatgtgaagcttcccatgatgcccctcctcaaccatgaagcagccagaaagatccaggaccagactctctgtgactgtgggattgataaatagaaagggagaactgaaatcaacccaatatgtccatcaaaaggtttttttgttgttgttgttgttttgataaacatagaaattgacccttctgttcttaaagctcaaatcttacatttgttttatctgagttcctttttcaggaaatgaccttcaggcctctcaaa

SEQ ID NO: 28893 - DNA, 601 bp, Human
gcaggttgatcaaacctaaccaatggagagaggaagcaccctgcctgtttcagtctggacactcttggagcttgtttgttgctgcagcagttgtattatgttttggtgattatttctatgtgtttgctagagtcatgggaaattggaattcagtaaacttggtattcttttgtaatactgtttggctccaatattgcttggaaactgaagtttgctgctgaatgagaaagtaggatggagttcctgtatccaggcttttatgttgctgttctaagcagcattgggcctgattagttggttytaggtggtgttctctgcgatgctgtttggagtctgcagaggtttggcctttaaaaatcaaactgccatggaaactgctttacctaaaatttgggttcacaaccttcactgaattatctattggagctaacaaatttcagccatgtgaacatatttgtagactggtgagtttgtattactgtctcatggagagagttcaaaggtaaaagctattggatctttgtgtgtgcatataggtctagatgtgtttatgtgtatgtacatttattattaagttacatgttgtgtctaccaaattgac

SEQ ID NO: 28894 - DNA, 601 bp, Human
tcagtctggacactcttggaggcttgtttgtaattgtgtgttgtttcagggcaagtgagtgtcttttgtgggtaccaggcagcacgactggctcctctcaatttgagaaatttgaaagcaatttttgttggcaggttgatcaaacctaaccaatggagagaggaagcaccctgcctgtttcagtctggacactcttggagcttgtttgttgctgcagcagttgtattatgttttggtgattatttctatgtgtttgctagagtcatgggaaattggaattcagtaaacttggtattctttygtaatactgtttggctccaatattgcttggaaactgaagtttgctgctgaatgagaaagtaggatggagttcctgtatccaggcttttatgttgctgttctaagcagcattgggcctgattagttggttttaggtggtgttctctgcgatgctgtttggagtctgcagaggtttggcctttaaaaatcaaactgccatggaaactgctttacctaaaatttgggttcacaaccttcactgaattatctattggagctaacaaatttcagccatgtgaacatatttgtagactggtgagtt

SEQ ID NO: 28895 - DNA, 601 bp, Human
gttttgttgacccatttcatcagcattgcatacaaggcatcccctgggcctgctgtaccagctctgaccacatcgatctcatttttcgtgaggtccagctgcctcatgagctggtcccaggagtcaaagggcacgatgtttgcaaacttgtcaaagaacagcatcagagctgggtggagaaagccacagagacagccagatgagttgggactcagttcagaaggggcagaggatcccacatcaggcccagaacccaaggagagaacctggagagccccctgcatgggcaaacctgttgctccattgcccacccacctcccatccacagagagcccacccacactgcctggcctctgtggcccccaaggcgctgacgggcgtcaaggtcaccagagaatctgccctcagagagggctgagaacccacctggggaggatggattgaccctacggaggcagaaagcaaagtgggtgagagcccgagggagggagggagagtggctgcagcgggagctcagaggatgcgggctgcctgggctgcgcttgtcatgggagcatgtcccagggtggccacttctgcatctgtggaaagtgcagggtct

SEQ ID NO: 28896 - DNA, 601 bp, Human
tctttcccaaggtatcacagtatatgaccggcttctaaatttaatcctagaagaaaatattgagagtataagaattatgatcttttcatttgatcatttcaggattgtctttatatcttttatttgcaggtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgmagttgctgattctggtatttatacctgtattgtcagaaggtattatgcagaaggctcccatcttctttcaccctgctcccctttcttcagtggttgattgcctgagctgcccttgctttcattccttccctagtcctttctggaacagttaaatttataaaatgatttgaataaaagtgatttggataaacttctaggaatactatcaggttgaggtctagctcattctgagctatttggatttacagttgcagggattgatttgtagctgacttagagaaaaacctagctttcctagtg

SEQ ID NO: 28897 - DNA, 601 bp, Human
gttaaatgttttgattttgtggctgtatttggcacacacaaaatgtcaaatgaattaaatcaaaaagcaggatgtattagttaagggcctaggtctgagactagacaagtgtcaaattcatgctctgccactagttaactgtgcgatgccagcaagttacttctctgcccttcagtttccttctctgtaaaatgcatataatgtaataatatatttcatctcaaagcattattgtgaaaataaactaaggtaatgtgtgaaaagtgctcatcatcatcactggtacagagtaaactctgartaaatagtaattatctttattacactgggattacagcattacagcagatgtagtgtatgaataaatggtgaagaagtcattgttagggctactatgggggctatgtttttagctcaagtgtaacaaaaaagtatttaaactctagattttaatgtttatttttaaataataaaataaccattatgtatattgatggtttttaagaagaaaagcaatattaagtaaaggctgaatttagattaagttatttcacaatgctaagtgactcttttaattgtctgacttattttaacagtccca

SEQ ID NO: 28898 - DNA, 601 bp, Human
tgaacctagaaggcagaggttacagcgagcccagattgcaccactcactccagcctaggcaacaaacattctgtcaacagataaataaataaaagtgaagaattactgagaaggaaatggaatttcttatttcagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaagggtragctactgacattaatgagatagaatactacgtgaaagaagtcgaagtgggaacagcggtgcccttctggttgggtttcttgcacttctccctcctccctttacttcctcctgctccatcttatcttatacattctgaactatgacgcaaagaggttttctgaacacactatcaagatttaagaaatttcagggggaaattacattactaattcaaagccacatctgttctttattctttttttgtgacttaattttccaaagataaagcaatctgaatgctaacttaacttactttttt

SEQ ID NO: 28899 - DNA, 601 bp, Human
acaatgaaaatggagccaattatagtgtgacggcgaccaggtccttcacggtcaagggtgagctactgacattaatgagatagaatactacgtgaaagaagtcgaagtgggaacagcggtgcccttctggttgggtttcttgcacttctccctcctccctttacttcctcctgctccatcttatcttatacattctgaactatgacgcaaagaggttttctgaacacactatcaagatttaagaaatttcagggggaaattacattactaattcaaagccacatctgttctttattctttytttgtgacttaattttccaaagataaagcaatctgaatgctaacttaacttactttttttgaatggcaatacaactatttggagagcaaaaccagctttttttttttttttctagtttggtgtcagagtttctgcaaattaaaaaagagcttaatctttagtaatactcattggattcaaagtttaatgagaggctttgtgatggtatactatggtgtacataaatgttgtcgagtggtttttaatctttgtttgcaatactttcaacatcatcaatggccttgagtaagtcacttcatt

SEQ ID NO: 28900 - DNA, 601 bp, Human
atcttatacattctgaactatgacgcaaagaggttttctgaacacactatcaagatttaagaaatttcagggggaaattacattactaattcaaagccacatctgttctttattctttttttgtgacttaattttccaaagataaagcaatctgaatgctaacttaacttactttttttgaatggcaatacaactatttggagagcaaaaccagctttttttttttttttctagtttggtgtcagagtttctgcaaattaaaaaagagcttaatctttagtaatactcattggattcaaartttaatgagaggctttgtgatggtatactatggtgtacataaatgttgtcgagtggtttttaatctttgtttgcaatactttcaacatcatcaatggccttgagtaagtcacttcattctaaaaatgtgttttccaagttattttaaattttataaaagcttatttaagggaaagatttcacaatcatagcttatcaatctacaaaggattggggtctccttagcacaagtcgatctacagacgtagatgtaatagcccctttacgtatgacagttttttcagggcaaagcaatattgga

SEQ ID NO: 28901 - DNA, 601 bp, Human
ttagtggtcacaggagtcagaattccgtacggggaagatttcactgaggatgggccaccctagtggagaactgcgagcaaatctgtggactcatccatttattattttcatgggtcttttgaaatcttctctgtagtcttattcttattctgtagaagagtagttttctaacaactactaggtcatgtaattagttttatgggttggatctgcatttgtttaagtgatatcagagaataatgatattaaagagcatcataggtaataaaagaaagttttatttaagtgcctttctgtttcttgtgtgtgtgtgtgtgtgtgtgtgtgtgtgtttgtcattatgggttattgtcagaagaacttgaaaaacattgctatgaaatagaatagaaacatgaaaatacaagctttatattgactagcattcaatgctctcctaatatttatatttctttttgtctttaagatgagcaaggcttttctctgtttccagtaatcggagcccctgcacaaaatgaaataaaggaagtggaaattggtaagaaaatttatcagaatgctgtaaatattgcctggaaaaatccttccatatgacccctgt

SEQ ID NO: 28902 - DNA, 601 bp, Human
aaatattgcctggaaaaatccttccatatgacccctgttctgaattcccttagcaggggtcaggcaattagcataaggaaccttgaggagtaagtgaggtgacatccctgaaagcacctgccccaagcatttgctaatattgggaacagggacacagcaattgcagtgtttacatttgtttattgtactttgtaattcatgatgctttcatgtatgcatctaatttcatcttcatctctatcccagagcttgggatggagacctgcagggtgttcattctgggcaatggtagccagatccrgtaaaacatgtttatcttcaaagtagcttatggagagatgaagagagttctgtagaaagatgtggaagagggcagttggaaagaaactctaatttctagtagagggcaatccttttactagaaatcctttgtaatgtggggttggtgaaggcagaatcattggccttgttagtttcccatgcagatgagaatatagtgggagctgagcttcaaacccagctgggtgaatgaaggtaatggaagcagggaggaggcaagagaggacatagaaagaggaaggtgctagagatgagggaggga

SEQ ID NO: 28903 - DNA, 601 bp, Human
tattgtactttgtaattcatgatgctttcatgtatgcatctaatttcatcttcatctctatcccagagcttgggatggagacctgcagggtgttcattctgggcaatggtagccagatccagtaaaacatgtttatcttcaaagtagcttatggagagatgaagagagttctgtagaaagatgtggaagagggcagttggaaagaaactctaatttctagtagagggcaatccttttactagaaatcctttgtaatgtggggttggtgaaggcagaatcattggccttgttagtttcccaygcagatgagaatatagtgggagctgagcttcaaacccagctgggtgaatgaaggtaatggaagcagggaggaggcaagagaggacatagaaagaggaaggtgctagagatgagggagggaggtcctggtggggtgcatactaagtgttcagtaaggttttttttttacattaaatgggataaaatgccagtcgcagaagttaattttattggtgaatgtccttactcccctctaggaaaaaacgcaaacctaacttgctctgcttgttttggaaaaggcactcagttcttggctgccgtc

SEQ ID NO: 28904 - DNA, 601 bp, Human
acgccaggtccgtcaagcctaagtccttgagttccgggtccgggcagcagagaaaggaagtcctctccctggaggcctatctccctcagaacggcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtakccgcaggagcggccgggtggcgggaggaaccgttacgggaactgaagttgcgggtgagcgccagccgcggagcagggccctgattggaggccagaggggttgcggggagaaggggaggagaggggtcgcaggcgctgtggcgggccctgggggagagcttggccgcgctgcggggagggggcggggtgcagcgcgtgggagccgggccgcgggaaggggcgggccgcagcggcgcgcggtgggggcggagctggggcgcggcgtgaaccccgcgggcggggagcgggtgtgcgcagcgct

SEQ ID NO: 28905 - DNA, 601 bp, Human
ggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctrctgcttcttgtccggggccagggtgaggctccctcggaggggcgacagggaccgggctcagatctgccaaatgctgcggaggcagaacctgacagtgcgggagggcaggcgcctgggaggtaggagctggtggagatgacagcgtggaactcgtgagccccacgcaacgcctccccgccgcccaaggtgggctcctagaagcacagaaagggtcgggctgggggacaccacggcaaggaaccagcggagtacaggggccccaggagcgccgggacatgccaggccgggtaggcagcctgg

SEQ ID NO: 28906 - DNA, 601 bp, Human
ggaatgatgagtttttgagagtttagacttgggatgagagacatcccactgcccttctcatgagaaattaacatccattcactcatgtagcacacatatgtgggctactcccctgtcccaggccttacgggttacaggaatatagtggtgaatgtcaacacatgcagccaatggttctcatagaaacccctaagagtcaaggtttccggcagtgcgaggaatgatacccaaggtcctcagtaacctcgaggcctccctggaagtccaagctgcatcccagcttccccagagcctgtggccygtaacttggtgggaagggatttttgagagggatcatgtgtgagcaggatattgtgggaagggtctgagggtggctgggagcacctctgaacccagggtctggttttggccacagcctggcccctggactgattatttgccctggttaccaggtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgggtg

SEQ ID NO: 28907 - DNA, 601 bp, Human
ccagagtgaccctcatactgccctgctgggatggcatgtctacaggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacrcccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatt

SEQ ID NO: 28908 - DNA, 601 bp, Human
agctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccac

SEQ ID NO: 28909 - DNA, 601 bp, Human
ccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgt

SEQ ID NO: 28910 - DNA, 601 bp, Human
ttgaggcgggcggatcacttgaggtcaggagttcaagacaaacccggccaacttggtgaaaccccatctctactaaaaatataaaaattagccaggcttggtggcgcacacctgtaatcccagccactcaggaggctgaggcaggagaatcacttgaacccaggaggcgggggttacagtgagctgagatagcaccactgcactccagcctgggcaacagagcaagactctgtctcccaaaaaaaaaatggggatgttgacaaggaccaaattttcttgtctacagaggttacctgtgaayccttatttgaaaaatgatgactatgaaagatagtggagaattgcattaccaagaccaaatgtaagggtggtcagctgtaataactgggcccaaactcagaatgagtaaggctacaatgtcaaagagataatttttatgttttatgtttaaattcaagggaaaacaaggaacggtataggtactcagccaaaattaacatcataaacagaaactttccttaaacaaaaagacttatatgttcagtgggttttttttgttgttggttggttggttggtttttgttttgagacagggacttgc

SEQ ID NO: 28911 - DNA, 601 bp, Human
gtgaatccttatttgaaaaatgatgactatgaaagatagtggagaattgcattaccaagaccaaatgtaagggtggtcagctgtaataactgggcccaaactcagaatgagtaaggctacaatgtcaaagagataatttttatgttttatgtttaaattcaagggaaaacaaggaacggtataggtactcagccaaaattaacatcataaacagaaactttccttaaacaaaaagacttatatgttcagtgggttttttttgttgttggttggttggttggtttttgttttgagacagggwcttgctgtgtcacccaggctagagtgcagtaatgccatcatggctcactgcagccctgacctccctaggctcaagcaatcctcccacctcagcctccctagtagttgggactatgggagcatgctactacaccaggctaatttaaacaaattttagtgtagagatgggggtctcactatgttgcccaggttggtctccaactcctgggcttaagttatcctcccaccttggcctctcaaagtgccaggattacaggcatgagccactgtgcccagccctttgctcagttttgaatacaca

SEQ ID NO: 28912 - DNA, 601 bp, Human
taaaaggatatcaacccaagtaaagggcctttgatgtattaagtggggaaaaacggttgaaggttataggagtttgtgttctagctaagatcagatcactatttttgtgtaaaaataaagtgagtgttcttgggaaaaatttgtaaggagataaaatggttttcatttctgtgtgatgggattaagggtggtttttattttccttgtactttcctgtagagttcaaatttttgtaaccaaaggaaaatttattttaaaaaagtgaggtgtagggtatcagaaggtggctaaaaccattttwtattttgtattttgttcaatatagaaatattgtatacattttatattttgtattttgtgcaatatataaatattgtatacaaatatgtatattatatagataaatatatgacttatacaatatattacaatatagaatatattgtaatataattttacaatattatataatatacaatatataattacatattgtaatatataatcatatatacaatatattatatattatatatacacaatatattacaacatgtaattatatattacgtatatagtatattgatatgtatacaatata

SEQ ID NO: 28913 - DNA, 601 bp, Human
gatgggattaagggtggtttttattttccttgtactttcctgtagagttcaaatttttgtaaccaaaggaaaatttattttaaaaaagtgaggtgtagggtatcagaaggtggctaaaaccattttatattttgtattttgttcaatatagaaatattgtatacattttatattttgtattttgtgcaatatataaatattgtatacaaatatgtatattatatagataaatatatgacttatacaatatattacaatatagaatatattgtaatataattttacaatattatataatatmcaatatataattacatattgtaatatataatcatatatacaatatattatatattatatatacacaatatattacaacatgtaattatatattacgtatatagtatattgatatgtatacaatatacaacagatatgcattgttgcatacatacctgtggaattgtgttaaatcagaactgagtctttgcagaagactagcttttctcctctttttttcagagaaagttctgaagttctcttccttgccactggtatgtttgagaattaggccccacaattgttaggaaatgcagtacgt

SEQ ID NO: 28914 - DNA, 601 bp, Human
ctgtagagttcaaatttttgtaaccaaaggaaaatttattttaaaaaagtgaggtgtagggtatcagaaggtggctaaaaccattttatattttgtattttgttcaatatagaaatattgtatacattttatattttgtattttgtgcaatatataaatattgtatacaaatatgtatattatatagataaatatatgacttatacaatatattacaatatagaatatattgtaatataattttacaatattatataatatacaatatataattacatattgtaatatataatcatatatmcaatatattatatattatatatacacaatatattacaacatgtaattatatattacgtatatagtatattgatatgtatacaatatacaacagatatgcattgttgcatacatacctgtggaattgtgttaaatcagaactgagtctttgcagaagactagcttttctcctctttttttcagagaaagttctgaagttctcttccttgccactggtatgtttgagaattaggccccacaattgttaggaaatgcagtacgtcaagttcttacagctacgtggcctgtctgtgcacctgta

SEQ ID NO: 28915 - DNA, 601 bp, Human
gttgagttgtttctccatctaggcatggtagatagtaactaggagcattgtagttctgaaagcctcatactcagatcagtccagtgatttaaactggactagaacttggtcttcatatgcctgtgtctgggtctgaaataagtaaatcaccttctcacacctaatgaaattcagtgggttgtccaaatagagattttccaagtagtactttttattctgtattatagcactttattccttgcaattcttatgatgaaatgtctgttcaccctaatgaagttatttgctgaatgccaccgatgttttctaagaatgccaccgatgttttctaactgtccatagtttgatttggattattgatgattggtgaatgtcagatgaacacagtgaatggatatcttactctgtttcttttatttctccctagattttttacccagaaactacagatatctatgatcgaaagaacatgccaagatgtatctactgtatccatgcactcaggtagtcaaattttcttggcaaaataaggaaattatgaataacatctgaattgagtgtgtagttttttatccttgaggtaagaatgaaaaagtttttt

SEQ ID NO: 28916 - DNA, 601 bp, Human
caaattttcttggcaaaataaggaaattatgaataacatctgaattgagtgtgtagttttttatccttgaggtaagaatgaaaaagttttttgattagtttcaaaagttccaaataggataaaatactattatccgaacaaaatggtgagaaacagctgtgtttttctagggagtttggagaagggatttatttatttaatagcaggtaattttcttctaaaaacatggtatctttcataattgatctagtatttctgtgaactatgcattcacttggggtgcagtctcttgtttagttakgtaggtccttgccattgttaagccatttgttcattcattcaataatttttataagccggatgcggtggctcacgcctgtaatcccagcattttgggaggccaaggcgggtggatcacctgaggtcaggagttcaagaccagcctggccaacatagtgaaaccctgtctctactaaaaatacaaaaaattagctgggcatggtggcgggtgcctgtaatcccagctactcgggaggctgaggcaggagaattgcttgaacccggaaggcagaggttgcagtgagccaagattgcaccattg

SEQ ID NO: 28917 - DNA, 601 bp, Human
ggagagccagcagtaccaattttgaagacctagggctttaaaaatacactggcagtggaggtgaaaaaaatacgaataacttgcttctctaatgtggggtaaagaacactaaacttgaaatttcaagctctgttctctcacttaataatgtgaacatgattagtgagtctcagttttcttatatgtaaattggggataacattaacatatataaaacataataatgttaacacataacactaaatgttcgggtatgttgaaaaaagctttataactatctttccctttccattccagcaarcatctgttgtgggcaaagcaagagggagagtggggagtgagatgacacaaagatgccaatttagtaattttaaaatttaagcttatttgggtgggtgtttctatgtgtatttgctatagccagatgcttgaagagatgaggggttggggagaaaaagggcagtggtaatactgtttaagggtaagatagattcaagtctttcaaagtggtgattattttgtaggcttgaaagtttaaaaattggtaagaaagtttttgtccatgatattttttccttccagggaagttattcaccagacc

SEQ ID NO: 28918 - DNA, 601 bp, Human
gtcccagctacttgggaggctgaggcaggagaattgcttgaacctgggaggcataggttgcagtgagctgagatggtgccactgtactccagactgggcaacagtgagactctgtctcaaaaaaaaaaaattatttttctatttttttaaagtaacattatatttttgtttttcctttaaagaataatgcaagctgtctagaaataaaaaataaaccacaaaaattagactccttcacttagaaataatcatcacttaggaataatcattactggcatttttttgtatgtccttcaaaacggtgtgtgtgtgtgtgtgtgtgtgtgtgtgtgtgtgtatatatatatttttttttttctttaagagacagagttacactttgttgtttaggctgcagttgcgattatggtttactgcagcctcaaactcttgggctcaaaccatccttctgtttcaaattctctagtagctaggactacagtcatgcgctgccacacccagctgatttttaaaatttttttgaagagacagggtctcgctctgttgcccaggttggtgtcaaactcctgatctcaagtgatcctgccaccttggcctccca

SEQ ID NO: 28919 - DNA, 601 bp, Human
ttgaacctgggaggcataggttgcagtgagctgagatggtgccactgtactccagactgggcaacagtgagactctgtctcaaaaaaaaaaaattatttttctatttttttaaagtaacattatatttttgtttttcctttaaagaataatgcaagctgtctagaaataaaaaataaaccacaaaaattagactccttcacttagaaataatcatcacttaggaataatcattactggcatttttttgtatgtccttcaaaactgtgtgtgtgtgtgtgtgtgtgtgtgtgtgtgtgtgtrtatatatatttttttttttctttaagagacagagttacactttgttgtttaggctgcagttgcgattatggtttactgcagcctcaaactcttgggctcaaaccatccttctgtttcaaattctctagtagctaggactacagtcatgcgctgccacacccagctgatttttaaaatttttttgaagagacagggtctcgctctgttgcccaggttggtgtcaaactcctgatctcaagtgatcctgccaccttggcctcccaaattgctgggattacaggcatgagccaccttgcccag

SEQ ID NO: 28920 - DNA, 601 bp, Human
gaacctgggaggcataggttgcagtgagctgagatggtgccactgtactccagactgggcaacagtgagactctgtctcaaaaaaaaaaaattatttttctatttttttaaagtaacattatatttttgtttttcctttaaagaataatgcaagctgtctagaaataaaaaataaaccacaaaaattagactccttcacttagaaataatcatcacttaggaataatcattactggcatttttttgtatgtccttcaaaactgtgtgtgtgtgtgtgtgtgtgtgtgtgtgtgtgtgtatrtatatatttttttttttctttaagagacagagttacactttgttgtttaggctgcagttgcgattatggtttactgcagcctcaaactcttgggctcaaaccatccttctgtttcaaattctctagtagctaggactacagtcatgcgctgccacacccagctgatttttaaaatttttttgaagagacagggtctcgctctgttgcccaggttggtgtcaaactcctgatctcaagtgatcctgccaccttggcctcccaaattgctgggattacaggcatgagccaccttgcccagcc

SEQ ID NO: 28921 - DNA, 601 bp, Human
acctgggaggcataggttgcagtgagctgagatggtgccactgtactccagactgggcaacagtgagactctgtctcaaaaaaaaaaaattatttttctatttttttaaagtaacattatatttttgtttttcctttaaagaataatgcaagctgtctagaaataaaaaataaaccacaaaaattagactccttcacttagaaataatcatcacttaggaataatcattactggcatttttttgtatgtccttcaaaactgtgtgtgtgtgtgtgtgtgtgtgtgtgtgtgtgtgtatatrtatatttttttttttctttaagagacagagttacactttgttgtttaggctgcagttgcgattatggtttactgcagcctcaaactcttgggctcaaaccatccttctgtttcaaattctctagtagctaggactacagtcatgcgctgccacacccagctgatttttaaaatttttttgaagagacagggtctcgctctgttgcccaggttggtgtcaaactcctgatctcaagtgatcctgccaccttggcctcccaaattgctgggattacaggcatgagccaccttgcccagcctc

SEQ ID NO: 28922 - DNA, 601 bp, Human
gggaggcataggttgcagtgagctgagatggtgccactgtactccagactgggcaacagtgagactctgtctcaaaaaaaaaaaattatttttctatttttttaaagtaacattatatttttgtttttcctttaaagaataatgcaagctgtctagaaataaaaaataaaccacaaaaattagactccttcacttagaaataatcatcacttaggaataatcattactggcatttttttgtatgtccttcaaaactgtgtgtgtgtgtgtgtgtgtgtgtgtgtgtgtgtgtatatatatwtttttttttttctttaagagacagagttacactttgttgtttaggctgcagttgcgattatggtttactgcagcctcaaactcttgggctcaaaccatccttctgtttcaaattctctagtagctaggactacagtcatgcgctgccacacccagctgatttttaaaatttttttgaagagacagggtctcgctctgttgcccaggttggtgtcaaactcctgatctcaagtgatcctgccaccttggcctcccaaattgctgggattacaggcatgagccaccttgcccagcctccaaa

SEQ ID NO: 28923 - DNA, 601 bp, Human
ggaggcataggttgcagtgagctgagatggtgccactgtactccagactgggcaacagtgagactctgtctcaaaaaaaaaaaattatttttctatttttttaaagtaacattatatttttgtttttcctttaaagaataatgcaagctgtctagaaataaaaaataaaccacaaaaattagactccttcacttagaaataatcatcacttaggaataatcattactggcatttttttgtatgtccttcaaaactgtgtgtgtgtgtgtgtgtgtgtgtgtgtgtgtgtgtatatatatatttttttttttctttaagagacagagttacactttgttgtttaggctgcagttgcgattatggtttactgcagcctcaaactcttgggctcaaaccatccttctgtttcaaattctctagtagctaggactacagtcatgcgctgccacacccagctgatttttaaaatttttttgaagagacagggtctcgctctgttgcccaggttggtgtcaaactcctgatctcaagtgatcctgccaccttggcctcccaaattgctgggattacaggcatgagccaccttgcccagcctccaaaa

SEQ ID NO: 28924 - DNA, 601 bp, Human
gaggcataggttgcagtgagctgagatggtgccactgtactccagactgggcaacagtgagactctgtctcaaaaaaaaaaaattatttttctatttttttaaagtaacattatatttttgtttttcctttaaagaataatgcaagctgtctagaaataaaaaataaaccacaaaaattagactccttcacttagaaataatcatcacttaggaataatcattactggcatttttttgtatgtccttcaaaactgtgtgtgtgtgtgtgtgtgtgtgtgtgtgtgtgtgtatatatatatwtttttttttctttaagagacagagttacactttgttgtttaggctgcagttgcgattatggtttactgcagcctcaaactcttgggctcaaaccatccttctgtttcaaattctctagtagctaggactacagtcatgcgctgccacacccagctgatttttaaaatttttttgaagagacagggtctcgctctgttgcccaggttggtgtcaaactcctgatctcaagtgatcctgccaccttggcctcccaaattgctgggattacaggcatgagccaccttgcccagcctccaaaac

SEQ ID NO: 28925 - DNA, 601 bp, Human
aggaatctgggccaggcaattccagcattttggaaggccagggcaggtggattgcctgagcttaggtttgagaccagcctgggcaatgtggcgaaaccctgtctctacaaaaaatacaaaaactagctggacgtggtgacatgcgcctgtagtcccagctacttgggggctgaagcaggaggattgcttgagcccaggaggttgaggctacagtgagctgtgttcgcaccactgcactgtagcctgggcaacagagtgagaccctgcctcaaaaaattaattaattaattttttttttttwaaaaagaatctggctctgaagtggtactgacctggtatttgatctcttgttcctctgttaaaagctgtgtaacattgggcacctgcagtagcgttgttagacatataatacgagatagtgtatgtaaattgcctgctatttagtaagtactcaatgaacattaatattatcgctatgtcatgtaatctccctactgtaatgccttcatgcctcatctcttcctaatccaaattgtacccatcattcaagatccagttcaattttcacttcagtgcctgtcacagttcaatatggttgact

SEQ ID NO: 28926 - DNA, 601 bp, Human
gagggatttttctctaccttactgtttggtattttataacctttatagttttaccttgctaattgtataagaatcagttgtgagcacatgtaaggaaataataatatgttcttaaaatgtcctattcatattattattatgtagtcagaggagcaaaataataaaaattccctcaaatacctttcagtatagtggggaagatagacatacaaatgagtacttttagggcagcttgattagagcaagatgccaagagcacatgtggtgcagtcatagaataaagaagggaatgatgacttckgcttagaagtttgagcaggttttcagtgtacatggatcttcacagggatccttaggatagataagagggtgaggataaggcagaattccctataaaaggacagtcttttcctaattgtagagaaagtcttgaggcaaaggaaagttagatgccaggaggatatagggacttcgggttccaggaattaatgtaattatagataagattctttgcctagagcattcgaaacagcaatgaggccattgatgctgccccaggagaaagctgcaggccaagcagttaaaaattagaaaaagtttt

SEQ ID NO: 28927 - DNA, 601 bp, Human
agttatataactaaagttcagtgagagaaagtatttaagtaatgttccacactttattatgtttgcaatataaatgtttatagatattcatttaatatttacatatttaagtagtatgtgtacacttctagaaaaagcaaaatttactagatgcttttgtagatagataatctaagactctatgctatatacctagagaaagtctagtttgttatctacattgattttattttctgtccctagctactatgaaagctccttgaggacaggatatttgtttttttcacaattatatttgcarcatatagcagatcctcagtaaatatcattgaaggaatggatgattagttggctaacagccacatatacctgcagacatgacttgagaagccaccaccttggtatggtgctcagttgaatggcaggtatgaatattaggaagaaataaacagtatcttaggagcctacagtgagacctcacatccataccaatgttttaaccttttcttccgccctttttttaaatagttctagtctcctcattgcccctacttcccattttctagtttgagactttattttcccttgggctgttttgatt

SEQ ID NO: 28928 - DNA, 601 bp, Human
ggtatgaatattaggaagaaataaacagtatcttaggagcctacagtgagacctcacatccataccaatgttttaaccttttcttccgccctttttttaaatagttctagtctcctcattgcccctacttcccattttctagtttgagactttattttcccttgggctgttttgattttctttataacagcttattaattttattttgttttttactaatgaaaacatttgcaattgataagtactattatgccccagatatttttatttttggtattttattgatttctttttgctactktgataaaatcagatgtttatctgtgagtggtggtagggacaggcattttctcttcaaaaaataaggaaacggaaagtaaaaaagtaattatgattccttagtggctatcatttctgaaatcagaaattatcttattctgtctttcaggctaagaatacctttttgttttgttttgttttttttacaatatataaagtgcttttatgtatatgattttatttaatcttaaaaatattcctatgacggaaggtatcttcattatcattttcagatgaaggaacatctgggttttcattgtca

SEQ ID NO: 28929 - DNA, 601 bp, Human
tttctttataacagcttattaattttattttgttttttactaatgaaaacatttgcaattgataagtactattatgccccagatatttttatttttggtattttattgatttctttttgctactgtgataaaatcagatgtttatctgtgagtggtggtagggacaggcattttctcttcaaaaaataaggaaacggaaagtaaaaaagtaattatgattccttagtggctatcatttctgaaatcagaaattatcttattctgtctttcaggctaagaatacctttttgttttgttttgktttttttacaatatataaagtgcttttatgtatatgattttatttaatcttaaaaatattcctatgacggaaggtatcttcattatcattttcagatgaaggaacatctgggttttcattgtcatgtattgtattatagagcttgtgtgacctcaggttctatgattagaagagagaatgtggaaaggggaagatgacccctttcactctgcacaggttggaccacccttgatagcagggcactgactgttgtgggtggagtgtgttcaggaagtatcagggtaatgagaggattcaaaa

SEQ ID NO: 28930 - DNA, 601 bp, Human
tctgaaatcagaaattatcttattctgtctttcaggctaagaatacctttttgttttgttttgttttttttacaatatataaagtgcttttatgtatatgattttatttaatcttaaaaatattcctatgacggaaggtatcttcattatcattttcagatgaaggaacatctgggttttcattgtcatgtattgtattatagagcttgtgtgacctcaggttctatgattagaagagagaatgtggaaaggggaagatgacccctttcactctgcacaggttggaccacccttgatagcwgggcactgactgttgtgggtggagtgtgttcaggaagtatcagggtaatgagaggattcaaaatggtgctatgtaagacatggttaaaggaaataaggctgctagtaaggcatttgctgtcatagggaggggcagtggaatgtattcagtgtgaactttagggttggagctttaaaaatatttttgaaacaaaattgtccaaagatgtagtaagtggccacgggagatactttctcctgtttggtagtctgtaagtataatctggacaactacttggcattttaagggaatttaagcgtc

SEQ ID NO: 28931 - DNA, 601 bp, Human
ttgaggactctccatcctgttttccgtagcggctatagtaatttatattcccatcaacagtgtatgagccctttctctgcagccttcccagcatttgttattttttgtctttgataaaagccattttaattggggtgagaaagtatctcattgtggttttgatgtgtatttccctgatgattaatgatgttgagcattttttcatatacctgttggccatttgtgtgtcttcttttgataaaaatctattcagcttatttgcccatgtaaaaattggattatttgtggggtttttttttgtttttttttttttggctgttgtttgaatttcttatatattatggttattgttctcttctcagatggatcgtttgcaaatgttttctcctgttctatatgttgtctcttcactttgttgttggtttcctttgctgtgcagaagctttttagcttgacatagtcctgtttgtctatttttgctttcgttgcttatgcttttaaggtcttagctaaatggctttgcttagaccagtgtcctgaagcatttccccaatgttttcttccagtcgcttcatagtttcaggtcttagatttaagtctt

SEQ ID NO: 28932 - DNA, 601 bp, Human
tccaaaccatagcactgtcttttccctgatgtgtgttcttggtgtctttgtcaaaaaatgttctcctcatggctgtaaatgtgtggctttgtttctgagttctctatggtgttctgttggtctgtgtgccctttttttttttttttgagacggagtctcactctgttgccaggctggagtgcagtggcacaatttcagctcactgcaacctctgactccctggttcaagcgattctcctctctcagcctcctgaggagctgggattacaggcacgtgccaccacacctagctcatttttgyatttttagtagagacggggtttcaccgtgttgaccaggatggtctcgatctcctgacctcgtgatccacctgccttggcctcccaaagtgctgggattacaagcgtgagccaccgtgcctggccaagttactccagttttaaaggtagaactggagtcaatatagcctcactttggctcgcacacacttcatgatttgttagggaaatatctggaggaggtgagacttaagggatcgctaagatttggatggtgaaagaggtgagaaaagaacgtcctagtgcaggacaatgagggaaaa

SEQ ID NO: 28933 - DNA, 601 bp, Human
ttcccaccatcccaccattagagatactaagattgatccctggattagggagaccacttatacttccattgcgtatttacgcttttccctcatcactagaacatcatctcttttgcaccgtcaaaatatctagttttccattaagcattcacgtgatatttttaacccaattgataatctttcctaaatcagtaccttcagtaaaagttgctgaatgatgatttgttgctctgtcattcctcctgcatttattagctcatgtgtagcctttttttcttgtctatggaggaattgcttgaastgctgcctttaattctagagttagtcttaacatggaatttagaatatgtaacaggatattgagaataagtgatttctgttgcatttttgcactttgtttaaagtaactgtgcagttccaaaactggtcttgagaatatatcaaatggttgggataccctagcaatctttgttccttgaatatttaaacatgctgtgcttaatgctctttttacttgggggtctggggcaggtatctcgatgagttgatgaaactgaaggctcaggcacatgcagagaataatgaattcattacatggaat

SEQ ID NO: 28934 - DNA, 601 bp, Human
gacctagcttattctccgaaaccccactcctctgacagtcagatataaggctccctttggactttcttagcagcaaaaacaaacattactaccactagcatacatagaatcattgcagcctgacacattagagattctgaatcagtagaattagactttaagcttaggaatctgtattttaaaaatgactttttcattgttctgatgaccagccaagtttgggaaacactaatctaataaaatgaatcaaagacagagacttccatttctagcttccctagagccaactacttcttatccragtaagtaaaatcagttgatctcaatttcctggctatgaaatagcagttgtgattcaaccctctccacagcatcaagtgacattctgcataattatatctcttaaatgaaacctggtagtatctatcagatactacacttacatgattaggacatggtaatgtcaactactgccatgccaatgtaatcaaaggagatcagtcaacatcataatattaccaacatataaaattgcccactcctctacccttcaccaaaacttacagagcccacacgagtgtcagtgtgcaaaaagctccaa

SEQ ID NO: 28935 - DNA, 601 bp, Human
gagtcttctgaaggctatggttctatccagttgttgttacttagtaagcactgaaaaggaggtcaatcacaattagaaaacagatgttaattatgctttaatcaacaattatttgagggcctactacatacaaggcaacttcctagacagcaacagcataaaaagaggcataaaccttgtcaatttcctcagcaaactaggtagcgggtaagacaaacattttaaaagatgagtttatgttacaattactttaacaactttatcttcatagtagcattattcctgatagccacagtggaaraaaacagtatgtctatcaagtcaggaatagataaagtgtaaataattcaaaaggctgtgtgtgcgttttgtttgggtcatcggagtaaaactttttgaggatgtgactatagagtttgaagcatttcctttgctgtggaataacttttcagacttcatcaaaggcggaggaagtcgggggagttaaaggaaaaattgcttaacattgccaggcccagctgggtgaactacacattgggtggaattgttttttgtttgtttgtttttggtttgggttttttgttttgttttgttttgtttt

SEQ ID NO: 28936 - DNA, 601 bp, Human
tacaggtgtggtgtacacccctgtagtcccagctactcaggaggctgaggcaggaggattgcttgaacccgggagtaggaggttgcagtaagctgagatcataccactgcactccagcctgggtgacagcgaagctgcatctcaaaaaggaagaaagaataagaatgacttaaatcggctgggtgcggtggcttacacctgtaatctttgtactttgggaggctgaggcaggtggatcacgaggtcaggagatcaagaccatcttggctaacacagtgaaaccccatctctactaaaaacmcaaaaaaaaaaaaaaaagaaaaaaaaaaaattagcccggcatggtggtaggcgcctgcgcctttagtcccagctactcgggaggctgaggcaggagaatggcatgaacccaggaggtggagcttgcagtgagccaagatcgggccactgcactccagtctgggcgacagagcgagactctgtctcaaaaaaaaagaatgacttaaatctctctctgacctccatgtgtgtatatgcacttatgcacacatgcttatatacatgtagctagtaatcagctggttcacaccagcacagctgt

SEQ ID NO: 28937 - DNA, 601 bp, Human
tagacataaatgagctaaattagtcattacaaagccataatttaatgggagcttagcatgcccctttactctcacagatccaaggagcagcttttggagtggtcttcatttagactgtgagactaactaataatcctgcagttctggacgtacagctggggagtgtggctctggatgtcttctatctttcctttattttctgccaggagataataacagcaagtgggtgaagcactgggtaaaaggtggatattattattaccacaatctggagacccaggaaggaggatgggatgaaccyccaaattttgtgcaaaattctatgcagctttctcgggaggagatccaggtaggttacctttcttcacgtaagaagaagctgagagaaagtgttttcaagctataatattaattaagaggaacagggcatgtggtcagaagccctagactaaaattgaggttatgtaatgagctgttttgcggtaatttttttgtagtagttgggggagtgactgaggcctgaatttgtaaaacatctgaattatagaattaagtgatataaaccatatgctaagaaaagttagatgatctataaaagaaa

SEQ ID NO: 28938 - DNA, 601 bp, Human
gagtgtgttttttgagtgctggactcttagtcttctctttcctttgacaggtacctcctctttactaccatttaactgtagtgtgcctacaggtgtttaatgctggcacagtggcagttcttgggtacctcttcctctcttcttctaagactgtacctttctgtaagatttgaaccttgagggaaacaactgtggtctggcttcaatgataaggtagcacaatgtcctggaaagaattctgagttaggaatgatggctgcactactgccagacagtggtgaatctccaagtctttgtcccyatctgtaaaaggggaatgccccattgtatcttatcttcctcacctggtttgttgtaagaagccagtaaatgaatctgtatggctgcactgtaaaaggtgtgcagggctgtgctgacgttggggaagtagaatgtagccatcgtgttcttccagtggagggatggcccgtgcccttgttcccctgtcactgctggaagtggtccttcctaaaacttcatcatgaaattgcacttggatcatgtatcaagatgaaagtttttttttaacttccattgatgcttgggaagtaatatgtcttct

SEQ ID NO: 28939 - DNA, 601 bp, Human
gttcttgggtacctcttcctctcttcttctaagactgtacctttctgtaagatttgaaccttgagggaaacaactgtggtctggcttcaatgataaggtagcacaatgtcctggaaagaattctgagttaggaatgatggctgcactactgccagacagtggtgaatctccaagtctttgtccccatctgtaaaaggggaatgccccattgtatcttatcttcctcacctggtttgttgtaagaagccagtaaatgaatctgtatggctgcactgtaaaaggtgtgcagggctgtgctgaygttggggaagtagaatgtagccatcgtgttcttccagtggagggatggcccgtgcccttgttcccctgtcactgctggaagtggtccttcctaaaacttcatcatgaaattgcacttggatcatgtatcaagatgaaagtttttttttaacttccattgatgcttgggaagtaatatgtcttctgtaacatttgactgtttcagtcacagtggagaggatacaagcagaagaaggcatatcaagatcggttagcttacctgcgctcccacaaagatgaagttgtaaaggtatggtagcct

SEQ ID NO: 28940 - DNA, 601 bp, Human
tgctaactccattctttgatgcatactttctgtcagtcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggtatggcccagtgccagcgggggccttggaacggttcatcctgctttgtaacccctgcattcccctttctgactggtggggagggtggaggctgactttctcctcagctactgccataagagctttttttttttcttttgactgagtctcactctgttgcccaggttgtagtgcgatgtgatctcagctcactgcaacctctgcctcccaggttcaagcaattctcctccctcaacctcctaagtatctgggattacaggcacgtgacactatacctggctaatgttttttgatttttggctttttttttttttttttttttgctgacggagtttccctctcgtcgctcaggctgg

SEQ ID NO: 28941 - DNA, 601 bp, Human
cactctgttgcccaggttgtagtgcgatgtgatctcagctcactgcaacctctgcctcccaggttcaagcaattctcctccctcaacctcctaagtatctgggattacaggcacgtgacactatacctggctaatgttttttgatttttggctttttttttttttttttttttgctgacggagtttccctctcgtcgctcaggctggagtgcagtggcgtgatctcggctcactgcaacctctgcctcgcaggttcagcgattctcctgcctcagcctcccaagtagctgggattacaggygcatgccactacaccctggtaatttttgtatttttactggagatggcgtttcgccatgttgaccaggctggtcttgaagtcctgacctcgggtgatccacccgcctcagcctcccaaagtgctgggattacaggcgtgagccacgacacccggcttttttgcatttttagtagagacgggggtttcaccatgttggccaggctggtctggaactcctggcctcaagtgattgatccactcaccttggcttcccaaagtgctgggattacaaacatgagccaccatgcccggccatcataa

SEQ ID NO: 28942 - DNA, 601 bp, Human
aaagtgtggtttgcacaccagtaatggaaaatcatctgtgcacactgtttagtttaactgatactttttttttcatagcaagattttcttaatgaaggaagtaatgtattgatttacattctgactcattgtctttatcttgtctttgatcagtttgtagactggcactggtccacactttgaataacactattcttcattctactttccatgtacccggatgccaggcaaacagggagttttacgctgggtggagaacggaacattctgctgactccttgaaagggcttatctcaccagscatggtagctcacgactgtaatcccagctctttgggaggctgaggtgggaggattgcttgagctcaggagtttgagaccagcctgggtaacatagggataccttgtccctacttaaaaaaaaaaaaaaaaaaaattagctgggtgtggttgtgcacacctgtagttccagctattccagaggctgaggcaggaggataggttgagcatgggaggttgaggctgcagtgtgccttgatggcgccactgcactccatcctggttgacaaaaaaagaaagaaggggcgtttccttattaggaa

SEQ ID NO: 28943 - DNA, 601 bp, Human
acattctgactcattgtctttatcttgtctttgatcagtttgtagactggcactggtccacactttgaataacactattcttcattctactttccatgtacccggatgccaggcaaacagggagttttacgctgggtggagaacggaacattctgctgactccttgaaagggcttatctcaccagccatggtagctcacgactgtaatcccagctctttgggaggctgaggtgggaggattgcttgagctcaggagtttgagaccagcctgggtaacatagggataccttgtccctacttaaaaaaaaaaaaaaaaaaaattagctgggtgtggttgtgcacacctgtagttccagctattccagaggctgaggcaggaggataggttgagcatgggaggttgaggctgcagtgtgccttgatggcgccactgcactccatcctggttgacaaaaaaagaaagaaggggcgtttccttattaggaatcatttggcatctgattggttctcagtaccatgtaggtctgttatcaggactcagatcattgcaaaagtctttttaatttttttgcctgcatacctgaggcccacatccaggaat

SEQ ID NO: 28944 - DNA, 601 bp, Human
ctgctgtgcctggcatagcactcctatccttgaagacctccttctggtttctaacaaagtccagatttgtcagtatcatatacggggtctgtcatggcctgctccctgtctgcttttccactgtcatttctcctgtctccccttccttcctagaagactcttcctctccttttttcctgagttcaagcatcccttcgttttggaagctttccttgctttttccattctgagttgaagccctttccctatggtcctgtggcacttttggtgaactgatttacagcacaataggtttataatmatctgtttgtgtgtcgctcccaccagactgtaaaagactgaagagaaggtgtcatgtcttgtataacttttattcccaagtgcctgttattgtgcctggcacacaattcaggcacctgattcacagttaaaaacctgcgttcagattctagacttatcacttaccagccccgtgaggatgagcttaagctatctaatatttctgggtcttatagtttatgaaagataagacacttgcttcaggctgttcctggctgttagtctaacatagttgggtataatttctgtcttcccagcaaac

SEQ ID NO: 28945 - DNA, 601 bp, Human
cggcagactcctgccctttgaggacaaagcaataaaaccagggctgaccatagatcattactaactgcctaagtgtaggttctggcagtagcttaccattgattgtgagcttttgaaagcaattgtaattggtaaatggtacctctcttaggatgaaacacttcctatagtttggcacacaaacatcaaacaagtagaaagatggatttttcctgttttcagatgagtttctttgagtcctatcttttcgctgtagtattgttccctctgctggtgacctggcgaatagtagcaggcacarttgtttctgctaaggctgttgctgataactctttcttactcagctatgctcttctcttttctttttttttttaatctgaatgcttttttcttctctctcctagttctgtgctttcctacagtgaggcctcgattctagactttctgttcaggtgaattaattttatttcttctgaatgaaactctaggggaaatgctgtgactgcccctgaattcttctgtggaagagatgtgtgttaagtgaatttaatttcagaggcatgaacttggcctttgaagtctgcagcatgagaatgttggg

SEQ ID NO: 28946 - DNA, 601 bp, Human
aactgcctaagtgtaggttctggcagtagcttaccattgattgtgagcttttgaaagcaattgtaattggtaaatggtacctctcttaggatgaaacacttcctatagtttggcacacaaacatcaaacaagtagaaagatggatttttcctgttttcagatgagtttctttgagtcctatcttttcgctgtagtattgttccctctgctggtgacctggcgaatagtagcaggcacagttgtttctgctaaggctgttgctgataactctttcttactcagctatgctcttctcttttctttttttttttaatctgaatgcttttttcttctctctcctagttctgtgctttcctacagtgaggcctcgattctagactttctgttcaggtgaattaattttatttcttctgaatgaaactctaggggaaatgctgtgactgcccctgaattcttctgtggaagagatgtgtgttaagtgaatttaatttcagaggcatgaacttggcctttgaagtctgcagcatgagaatgttgggaggtggggttactctatgctgattgggtcatgttaaggaatttagctatgtttgttagcttt

SEQ ID NO: 28947 - DNA, 601 bp, Human
catgttaaggaatttagctatgtttgttagctttttataaggaaagcccatctacatgaaagtacaaagtgcatgtgggtgacagcagccttatttgctaccatgatatgtgaacaaaagatgccctgaaatacttaataacagactttaagtgtgtcatttttaccttctgaatctgctctttcattaactactggcagtagttttcagttctgttctcattgttttcctgtattgaacaaagggatatttcatttagttccaggccatgagagagagtgtgtatatgtgcatgcatgcrtgtgtatatgtattttttatttattttttcctcataggactgcattttctgcttttctttgctagcaaagtcatttatagcttccttggtggtatgtcttttaatacccatctttctgtttcgtctgttccagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtt

SEQ ID NO: 28948 - DNA, 601 bp, Human
tatgtttgttagctttttataaggaaagcccatctacatgaaagtacaaagtgcatgtgggtgacagcagccttatttgctaccatgatatgtgaacaaaagatgccctgaaatacttaataacagactttaagtgtgtcatttttaccttctgaatctgctctttcattaactactggcagtagttttcagttctgttctcattgttttcctgtattgaacaaagggatatttcatttagttccaggccatgagagagagtgtgtatatgtgcatgcatgcgtgtgtatatgtatttttyatttattttttcctcataggactgcattttctgcttttctttgctagcaaagtcatttatagcttccttggtggtatgtcttttaatacccatctttctgtttcgtctgttccagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgccca

SEQ ID NO: 28949 - DNA, 601 bp, Human
tgttagacattctagggagggacgggctgaagagttgaatgtataaatggagttgatcattggtgtttgcagctcctgttggatcaccaggatgccattgctccggagcacaatgatccaatccacgaactgctggacgacctcggcgaggtgcccaccatcgagtccctgataggtagagttctaacttttgcctggaagatcaaaagggaatgtgacagaaaagtgttgtaattgtcacctcctctattttttgcactataccaaactctggatatacattgagaaataaaatagatgkgatcctgatagtttcataagagagaaaacaacaacaacaacaaaagcccagatgtgatcaatatctataaggaactggagtcagaggaaaagatcattttaaacgcagatacatactgccagcttgtgtttttttaaaaaaattgcagatacataaattaaaagtcctctaaaggaaagaatttttttgtttgtttgttatgagacagggtctccctctgttgcccaggctgaagtacagtggtgcagtcatagctcactgcagcctcaaattcctaggctcaagtgatcctcctgagtt

SEQ ID NO: 28950 - DNA, 601 bp, Human
acgacctcggcgaggtgcccaccatcgagtccctgataggtagagttctaacttttgcctggaagatcaaaagggaatgtgacagaaaagtgttgtaattgtcacctcctctattttttgcactataccaaactctggatatacattgagaaataaaatagatgtgatcctgatagtttcataagagagaaaacaacaacaacaacaaaagcccagatgtgatcaatatctataaggaactggagtcagaggaaaagatcattttaaacgcagatacatactgccagcttgtgtttttttaaaaaaattgcagatacataaattaaaagtcctctaaaggaaagaatttttttgtttgtttgttatgagacagggtctccctctgttgcccaggctgaagtacagtggtgcagtcatagctcactgcagcctcaaattcctaggctcaagtgatcctcctgagttgtttttttttttttttaatagagatggagtctcactatgttgcccaggctggtctcgaactcctggcctcaagccatcctcctcctttagccttccaaagtgctgggattgcaggactgagccactgcacccagcc

SEQ ID NO: 28951 - DNA, 601 bp, Human
acaacaacaacaacaaaagcccagatgtgatcaatatctataaggaactggagtcagaggaaaagatcattttaaacgcagatacatactgccagcttgtgtttttttaaaaaaattgcagatacataaattaaaagtcctctaaaggaaagaatttttttgtttgtttgttatgagacagggtctccctctgttgcccaggctgaagtacagtggtgcagtcatagctcactgcagcctcaaattcctaggctcaagtgatcctcctgagttgtttttttttttttttaatagagatggrgtctcactatgttgcccaggctggtctcgaactcctggcctcaagccatcctcctcctttagccttccaaagtgctgggattgcaggactgagccactgcacccagccagaaagaatgttttcagagagaattgtgatattgtagtgttgaaatgatttctcaaacatttatggagttattatggatcccttgcctttatcatttggcataacattttatttctcagtaaaagttgttctcgtcacactgtatgtgttaggtgattcaagtattatcttagacttgcatcatcttatatt

SEQ ID NO: 28952 - DNA, 601 bp, Human
aacaaaagcccagatgtgatcaatatctataaggaactggagtcagaggaaaagatcattttaaacgcagatacatactgccagcttgtgtttttttaaaaaaattgcagatacataaattaaaagtcctctaaaggaaagaatttttttgtttgtttgttatgagacagggtctccctctgttgcccaggctgaagtacagtggtgcagtcatagctcactgcagcctcaaattcctaggctcaagtgatcctcctgagttgtttttttttttttttaatagagatggagtctcactatrttgcccaggctggtctcgaactcctggcctcaagccatcctcctcctttagccttccaaagtgctgggattgcaggactgagccactgcacccagccagaaagaatgttttcagagagaattgtgatattgtagtgttgaaatgatttctcaaacatttatggagttattatggatcccttgcctttatcatttggcataacattttatttctcagtaaaagttgttctcgtcacactgtatgtgttaggtgattcaagtattatcttagacttgcatcatcttatatttgtattatttc

SEQ ID NO: 28953 - DNA, 601 bp, Human
gagatggagtctcactatgttgcccaggctggtctcgaactcctggcctcaagccatcctcctcctttagccttccaaagtgctgggattgcaggactgagccactgcacccagccagaaagaatgttttcagagagaattgtgatattgtagtgttgaaatgatttctcaaacatttatggagttattatggatcccttgcctttatcatttggcataacattttatttctcagtaaaagttgttctcgtcacactgtatgtgttaggtgattcaagtattatcttagacttgcatcatyttatatttgtattatttccccccaatatctcctctctttattacgctgactctttccaccctcccaaaacttcaggggaaagctctggcaatttaaatgacccaaataaggaggcactggctaagacggaagtgtctctcaccctgaccaacaagttcgacgtgcctggagatgagaatgcagaaatggatgctcgaaccatcttactgaagtgagtatcaaaagaaggaagaatgaaatgaatgtaatctgaaggtttcttggcctttggagaggaacctgctgggtcctacctgaaat

SEQ ID NO: 28954 - DNA, 601 bp, Human
gaccatcctggctaacacgtgaaaccccgtctctactaaaaatacaaaaaattagccaggctaggtggtagatgcctgtagtcccagctacttgggaggctgaggcaggagaatggcatgtacccaggaggcggagcctgcattgagccaagatcgcaccactgcactccagcctgggcgacagagcgagactccgtctcaaaaaataataataaataaataaataaataaataaataaataaaatgttgtagtatttgcatatacttacgttctcccatatactttaaatcatctctagrctacttataatacctactacaatataaatgctgtgtaaatagttgttactgtatttttaaaatttgtattattttgtattgttgtatttttttttcaaacagtttcagggttggttgaaaccatgaatgtgtagggttcactgcaatttattgaatattatatattttgaattctgttacatgccttggtagatagaagaaaagtacagaatgtggctcctaaactcagtgaacccatggtcttgttggggaaatgtgacatatatacctgaaacagtgatgaactgtttcaaaattaac

SEQ ID NO: 28955 - DNA, 601 bp, Human
agcaaggtgacagaaaaggctttggattttggacaggggaatggtaattggtgataagagcagtaaagaagaaagtgctgaaagaacgaaacagtgagtgtagatcatatgttggacagggacagacaatggacggtgactatgaaggatggcgactatgaaggatggcagtatcaagggaaggtgtttccctgttagattgtggtgtctgcagaatgtttgaaagcagaggcaaggctcgagcatgattccaccttgtgacaaagtgacacaaagaattagcaaggatttactaagcackggtcttgttgtattagtatagttataacatttatacagctatgtttttaataaaattaaatggcttccatgtctcaaaatgtggtagagaaaaatgactttgtagccagtagagtccagtctcggtgattgtacctggagtccaggaaagaagccctaagcacctaagcagttgtgtgatttgtttgtttgcttgttttttgtttttttgagacggagtctcgctctgtcgcccagactggagtgcagtggcgcgatcttggctcactgcaagctccacctcctgggttcacgccattct

SEQ ID NO: 28956 - DNA, 601 bp, Human
gctaagtattccttttgcaaaatatcttcttggggcctgtcaaggtggctcacacctatcatcccagcactttgggaggccgaggcgggtgtgtcacttgatgtcaggagttcaagaccagcctggtcaacatggtgataccccatctctactaaaaatatacaaattagctgggtgtggtggcacgcacctatagtcccagctacttgggaggctgaggcaggagaattacctgaacctgggagatggaggttgcagtgagccacgattgcatcactacactccagcctgggcgacagarcaagactctggaaaaaaaaaaaaatcttcttggccttagaaattaaaatcatgaaaggagatcatctgctggtcccagaatcacttaaggaatattatacaaatttgggtccccttgctcctctctatacttcctggggacaagatcacaggctctgattttttttcctgggtgctgaggaaagtctgatccagccttcttggcactggccacaaactatcagcatgcccatgttacagggagggaattgaaaacccagagaggtgggtgataagagcaggttttacttgcagggtagtt

SEQ ID NO: 28957 - DNA, 601 bp, Human
gttcaagaccagcctggtcaacatggtgataccccatctctactaaaaatatacaaattagctgggtgtggtggcacgcacctatagtcccagctacttgggaggctgaggcaggagaattacctgaacctgggagatggaggttgcagtgagccacgattgcatcactacactccagcctgggcgacagaacaagactctggaaaaaaaaaaaaatcttcttggccttagaaattaaaatcatgaaaggagatcatctgctggtcccagaatcacttaaggaatattatacaaatttggrtccccttgctcctctctatacttcctggggacaagatcacaggctctgattttttttcctgggtgctgaggaaagtctgatccagccttcttggcactggccacaaactatcagcatgcccatgttacagggagggaattgaaaacccagagaggtgggtgataagagcaggttttacttgcagggtagtttattatttattcctaactttttattttaagagttttcaaatctcagatcgaatgaatagaacaataagcacccatgtgcccttcacctagattcacccatttttaatat

SEQ ID NO: 28958 - DNA, 601 bp, Human
ttatacaaatttgggtccccttgctcctctctatacttcctggggacaagatcacaggctctgattttttttcctgggtgctgaggaaagtctgatccagccttcttggcactggccacaaactatcagcatgcccatgttacagggagggaattgaaaacccagagaggtgggtgataagagcaggttttacttgcagggtagtttattatttattcctaactttttattttaagagttttcaaatctcagatcgaatgaatagaacaataagcacccatgtgcccttcacctagattcrcccatttttaatattttgccatatctgcttcccatttccctggctcttgcatgtcctctgtttctctctttccatggaagactctctggggtcaggcatgggtgatggaagggatgaaaaacaggcccacctaaccctgcttgcagatctgactcctgtgagcttttgatgtgttttcattgttccttgtgcacttcctgactttctgacacaagatgtttcatgttcaacctgtagtttcccctccccagggccagaatgaactgtttctccaagcatgcctggtttctttgaatgaag

SEQ ID NO: 28959 - DNA, 601 bp, Human
actatcagcatgcccatgttacagggagggaattgaaaacccagagaggtgggtgataagagcaggttttacttgcagggtagtttattatttattcctaactttttattttaagagttttcaaatctcagatcgaatgaatagaacaataagcacccatgtgcccttcacctagattcacccatttttaatattttgccatatctgcttcccatttccctggctcttgcatgtcctctgtttctctctttccatggaagactctctggggtcaggcatgggtgatggaagggatgaaaarcaggcccacctaaccctgcttgcagatctgactcctgtgagcttttgatgtgttttcattgttccttgtgcacttcctgactttctgacacaagatgtttcatgttcaacctgtagtttcccctccccagggccagaatgaactgtttctccaagcatgcctggtttctttgaatgaagaatggtatttagaaaccaagatctagaactaggtgtgttcactgccagatttgtcatggcctccaggccttctaagcagacagacctagattctcatttttttttaatgctgcatattatt

SEQ ID NO: 28960 - DNA, 601 bp, Human
gttttacttgcagggtagtttattatttattcctaactttttattttaagagttttcaaatctcagatcgaatgaatagaacaataagcacccatgtgcccttcacctagattcacccatttttaatattttgccatatctgcttcccatttccctggctcttgcatgtcctctgtttctctctttccatggaagactctctggggtcaggcatgggtgatggaagggatgaaaaacaggcccacctaaccctgcttgcagatctgactcctgtgagcttttgatgtgttttcattgttcyttgtgcacttcctgactttctgacacaagatgtttcatgttcaacctgtagtttcccctccccagggccagaatgaactgtttctccaagcatgcctggtttctttgaatgaagaatggtatttagaaaccaagatctagaactaggtgtgttcactgccagatttgtcatggcctccaggccttctaagcagacagacctagattctcatttttttttaatgctgcatattattccattatgcagatagatataacagttgacttcagcagttctccattgatggacatttaagttgtt

SEQ ID NO: 28961 - DNA, 601 bp, Human
agatctgactcctgtgagcttttgatgtgttttcattgttccttgtgcacttcctgactttctgacacaagatgtttcatgttcaacctgtagtttcccctccccagggccagaatgaactgtttctccaagcatgcctggtttctttgaatgaagaatggtatttagaaaccaagatctagaactaggtgtgttcactgccagatttgtcatggcctccaggccttctaagcagacagacctagattctcatttttttttaatgctgcatattattccattatgcagatagatataacarttgacttcagcagttctccattgatggacatttaagttgtttccagttgtttgttattattttttaaattctgcagcaaataacctcttgtacatatgtcattttgcaaatgtgggcatatttctgaagttagcacttcttgccttgattatcctaatagcctcctaacctgtttctttttccttattttcattcatctgtaattgctgtgctggcttaaacgcttttaaaaagtatttgatgacattttaattttttccctacacagctgaggggcgtagagtaactccttcactcctg

SEQ ID NO: 28962 - DNA, 601 bp, Human
ttggccaggctaatctcaaactcctgacctcatgtgattcacccacctcagcctcctttgggattacaggcctttattattatgttattattattattattattattatttattattataggtcattatcttccactactgttcaagtgcctacctctatttgcctttctgtcttctttttaatttgctcctatgggcttagaaactaaatagccaactaaatctggtaaaattatttatcacttaagataaatatgtttaaggaataacccgtgaggcgttccagttgaataagatgcaygtgtgtttcagtgcatgggtttttgtgacttctttaactctcagtgacctttttgcatctttcatggttctcagccctgttcgtaataggtaaggcagctccatagttgagttctggaaatctggggtgctatactttgatcatccagagaacagcataatccctttttttttttttttttttttttttttttgagacggagtctcgccctatcaccagactggactgcagtggtgatagggtatggtactcagctcactacaacctctgcctcccgggttcaatcaattctcctgcctc

SEQ ID NO: 28963 - DNA, 601 bp, Human
tcattaaatgtggggtaactgccaggtgtggggtattctgttaggcacaggtcccagcagccctcatggagctgctaggatttttccaacagataattgaacttgtggggtcctttctttttttggaggtgggggcagagtctcgccctgtctcccagactggagtgtagtggcgtgttctccattcactgcaacctccacctcgtgggttcaagtgattctcctgcctcagcctcctgagtggctgggattacaggcgcacaccatcacgcccggctaatttttttttttttttgagacmgtttggctcttattgcccaagctgcagtgcaatggcacaatctcggctcactgcaacctccgcctcctgggttcaagtgattctcctgcctcagcctcctgagtagctgagaatataggcgtgcaccaccacgccccaacgcccagctaatttttgtatttttagtagaaacagggtttcgccatgttggccaggctggtctctaactcgtgacttcgtgatccgcctgcctcggcctcccaaagtgctgggatgacaggcgtgagccaccacacccggccttgtggggtcctttcaaga

SEQ ID NO: 28964 - DNA, 601 bp, Human
aaatgtggggtaactgccaggtgtggggtattctgttaggcacaggtcccagcagccctcatggagctgctaggatttttccaacagataattgaacttgtggggtcctttctttttttggaggtgggggcagagtctcgccctgtctcccagactggagtgtagtggcgtgttctccattcactgcaacctccacctcgtgggttcaagtgattctcctgcctcagcctcctgagtggctgggattacaggcgcacaccatcacgcccggctaatttttttttttttttgagaccgtttsgctcttattgcccaagctgcagtgcaatggcacaatctcggctcactgcaacctccgcctcctgggttcaagtgattctcctgcctcagcctcctgagtagctgagaatataggcgtgcaccaccacgccccaacgcccagctaatttttgtatttttagtagaaacagggtttcgccatgttggccaggctggtctctaactcgtgacttcgtgatccgcctgcctcggcctcccaaagtgctgggatgacaggcgtgagccaccacacccggccttgtggggtcctttcaagactttt

SEQ ID NO: 28965 - DNA, 601 bp, Human
cccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacasaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaatt

SEQ ID NO: 28966 - DNA, 601 bp, Human
ctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccrtcagattgttgctgcacatagttgcctttgtatctctgtatgaaataaaaggtcatttgttcatgtttgtgtttttctcagtttcattgttaacagttcctgctaaacaccttgactagagtgagatgtatcagttaaaatcacaacagcagacaaccccttccttttaaaggagaaaacgtaagtccaccatcagatcattgaatgtctcaaagtgacttttaatgtgtgaacgtgtgactttagcctttttaatgaatatgcttaagttatcttcaccataaaaagaagggtgttgcg

SEQ ID NO: 28967 - DNA, 601 bp, Human
tcagctcaccttggactgcaggatttcatcatagattctggactctgctggctgggtgttccttgaagccatgatatatgtgtatatggttttctttgaggcagcatctgtctcacaaataaatatagacccacagtctgtgaaaggtggtttttttagcaatgatctattccaatgttctctttttaagatgaagaaaggaagcccccagggattaaatggctgccatcctttgaaatggatgcttggatcctcagaatgtctcaggagtcacttggctgaggcctcacccacaggtcartgggaattctcttctactctagagtccagattaggccaaagacaatttccccaacccctccctgtgtggccagtcaaatgtagctcttctacccaggatctcccttcatgtttctgacacttaccactgactgtcttgcatggctagttgactttccatgtcacggtcttagttttttaacttgattgattctttctagttatatactattttacattcttttggtgcagaccttgctgtaaccatctcaatgttaagcccatagtagatgtttcatgaacatttattgcttgtttgatt

SEQ ID NO: 28968 - DNA, 601 bp, Human
tggccattgacctagggagtggggctttgtgcatgggtggaagtacatatagaccaaaaacctaggcagtgggtcctgagaactacaaggagtcccaggggaaccagctagcccctggttggatggaccgggtgcaccagaatggctggaagagttaggaaagcaaggataaaaagccagaaaggggttaccttatcagcaaactgcacttcggaataaactgtgttcactggctcttccttggagggaagcacctgtaaaacacacatcttcccctcagtgagggagcccaggcccatctacaagtcccctttcctaattctgcctctacccaccatccttccctggtcccacatttactgggtggcctcccctttggcctcagttctgcctccatccaactctggagaggcttaggatcaggaagggataaggtgggggtgaatgggtagcagttgggcagggtctcgggggtgaaaaacctcaggggccaagaggagggatcccatggttcaggatgagtcctgctcagtcaggattttagctttccatgggctctatggatccagctgccctatcagtccaagcacagcgctagact

SEQ ID NO: 28969 - DNA, 601 bp, Human
ggatggccattgacctagggagtggggctttgtgcatgggtggaagtacatatagaccaaaaacctaggcagtgggtcctgagaactacaaggagtcccaggggaaccagctagcccctggttggatggaccgggtgcaccagaatggctggaagagttaggaaagcaaggataaaaagccagaaaggggttaccttatcagcaaactgcacttcggaataaactgtgttcactggctcttccttggagggaagcacctgtaaaacacacatcttcccctcagtgagggagcccaggcccatctacaagtcccctttcctaattctgcctctacccaccatccttccctggtcccacatttactgggtggcctcccctttggcctcagttctgcctccatccaactctggagaggcttaggatcaggaagggataaggtgggggtgaatgggtagcagttgggcagggtctcgggggtgaaaaacctcaggggccaagaggagggatcccatggttcaggatgagtcctgctcagtcaggattttagctttccatgggctctatggatccagctgccctatcagtccaagcacagcgctag

SEQ ID NO: 28970 - DNA, 601 bp, Human
taaaaggaagtagcactgccctgcttgtcgagctcatagatgtcctccctattgccttataggatcactctcaattcgtactcagtttagcttcctgcttggtaactcagctattaaacaggaatacttagaaaacatgattctttaagcaaccctaaagctgtcctgattgtagcagcagtgaggaccttcagatagtgacaatccctccttagatccccaaaatttaaagtcctgtcagagggctttgcatatgacagagaaggacataaggcacaggcataaggcacaaggcacttgrcactacaaatggttgtgcaggctgcgtgtggtaaaagagcagctgagggagcaaatgaactgaaattcagcttctgctccattgcacccatctgggcatctggcatgggcctgtgtttgctcagagggaagcacctgttttctcattttcacactgtgagctagcagtgaccccaggtattatacgggatggagttcccataccgtagttcagaggcatagggacttctgcatttgaagggtgggatcagcatcccaagtaagataactcgtggatggccattgacctagggagtggggc

SEQ ID NO: 28971 - DNA, 601 bp, Human
tctgtttgtggggcatgccagggtggcggcactctgcctcagcttaaactctagttctctgagtctttggaactgggatgaacccagtttcatcatctgcaccatcatctcccaagttccttctggagaatgactctgcttcttgcaaggtcttctattttgatggttggattatacccagttccccagaagtgtgagaaatataagctggtcagttccttttggagagtgggaatactgggcatggctgcttcttctgctgaggctgcttggagtgatacagaaggaaatcttggccagraagaaaatcctataaggcttctgaagtagcactccaagaaaagtgtcccagcagtctctagaccctgcagaaagaacattttccaacactccatttggagagtgtgtctacatggctgagagccacaactctgacagagacccacacagcactgtcatctgtgtttggacttactaagcctgttatgccctgcacaaagattcccagacaaagggatgagtgtgcttatatgcagcccacattctgctctccaagccatgcactcgggggaagggctgcatctgcctcaagcgaagggta

SEQ ID NO: 28972 - DNA, 601 bp, Human
gtagtgtctgtgctggaattgtctcctgagctacacaagagcagacattatgcacatcttctactttggggccttgcagctcctaacatagtgctaatggtagttggtgctagatgagtctatggattcatttactgggactgatgtctttatctgcctaattgcagcccattgctgtccagcctaggactattcattgggatttaggagttagccgattatacttgctaacacataagggaaacacttccttaaatgatcatatgaatgtcttgctcagttgtgaatgattcttcctcaytgaggagagttaatgcctgtgtaagctggctggtgatctgtttgtggggcatgccagggtggcggcactctgcctcagcttaaactctagttctctgagtctttggaactgggatgaacccagtttcatcatctgcaccatcatctcccaagttccttctggagaatgactctgcttcttgcaaggtcttctattttgatggttggattatacccagttccccagaagtgtgagaaatataagctggtcagttccttttggagagtgggaatactgggcatggctgcttcttctgctgag

SEQ ID NO: 28973 - DNA, 601 bp, Human
agcatgcatggtgcatctggagaggtgctctgaatacaccccactgatccaggcccctgctcatttttcatgcttctctcacttggaggccctctgtcttcctcattctctatccaaatttcatccatccttcaaggcccagcttcagccctgccccctcataaggtatttttctgactgttcatgctattacttgcagctgcagttcagcgttaactgtagtgtctgtgctggaattgtctcctgagctacacaagagcagacattatgcacatcttctactttggggccttgcagctcstaacatagtgctaatggtagttggtgctagatgagtctatggattcatttactgggactgatgtctttatctgcctaattgcagcccattgctgtccagcctaggactattcattgggatttaggagttagccgattatacttgctaacacataagggaaacacttccttaaatgatcatatgaatgtcttgctcagttgtgaatgattcttcctcattgaggagagttaatgcctgtgtaagctggctggtgatctgtttgtggggcatgccagggtggcggcactctgcctcagctta

SEQ ID NO: 28974 - DNA, 601 bp, Human
acataggcaagggactgtgagcatgcatggtgcatctggagaggtgctctgaatacaccccactgatccaggcccctgctcatttttcatgcttctctcacttggaggccctctgtcttcctcattctctatccaaatttcatccatccttcaaggcccagcttcagccctgccccctcataaggtatttttctgactgttcatgctattacttgcagctgcagttcagcgttaactgtagtgtctgtgctggaattgtctcctgagctacacaagagcagacattatgcacatcttctastttggggccttgcagctcctaacatagtgctaatggtagttggtgctagatgagtctatggattcatttactgggactgatgtctttatctgcctaattgcagcccattgctgtccagcctaggactattcattgggatttaggagttagccgattatacttgctaacacataagggaaacacttccttaaatgatcatatgaatgtcttgctcagttgtgaatgattcttcctcattgaggagagttaatgcctgtgtaagctggctggtgatctgtttgtggggcatgccagggtggc

SEQ ID NO: 28975 - DNA, 601 bp, Human
gaaagctttacagaagaggtaccttttgaggtgggcattgaaggacatgtaaatggacatggggtgggggcacacatctggctgggacactctgccacacataggcaagggactgtgagcatgcatggtgcatctggagaggtgctctgaatacaccccactgatccaggcccctgctcatttttcatgcttctctcacttggaggccctctgtcttcctcattctctatccaaatttcatccatccttcaaggcccagcttcagccctgccccctcataaggtatttttctgactgttcwtgctattacttgcagctgcagttcagcgttaactgtagtgtctgtgctggaattgtctcctgagctacacaagagcagacattatgcacatcttctactttggggccttgcagctcctaacatagtgctaatggtagttggtgctagatgagtctatggattcatttactgggactgatgtctttatctgcctaattgcagcccattgctgtccagcctaggactattcattgggatttaggagttagccgattatacttgctaacacataagggaaacacttccttaaatgatcatatg

SEQ ID NO: 28976 - DNA, 601 bp, Human
gagatggggtttcaccatgttggccagactaatctcgaactcctgacctcaggtgatccgcctgccttggcctcccaaagtgttgggattacaggcgtgagccaccaccccagccggcttccgtttatctgtaattcccacatgtacaatgtagtgaggaaaacaaataattagttatgctgtaaggctgaatgagatgagttttagtgatagaaggaccaaagaggaaaaaacagcagtgtgaaaagatccctgattaattttgattcctgataccagggaaagctttacagaagaggtrccttttgaggtgggcattgaaggacatgtaaatggacatggggtgggggcacacatctggctgggacactctgccacacataggcaagggactgtgagcatgcatggtgcatctggagaggtgctctgaatacaccccactgatccaggcccctgctcatttttcatgcttctctcacttggaggccctctgtcttcctcattctctatccaaatttcatccatccttcaaggcccagcttcagccctgccccctcataaggtatttttctgactgttcatgctattacttgcagctgca

SEQ ID NO: 28977 - DNA, 601 bp, Human
gcacaggagatatgaggtcattaattccatcattataaactgcaagcctccattcctctagatgaaaccctcatcccctaaggatcctactaaactcaaacttggccccccaaagatggggccactggaagcatcttgaattatacttccttcttggtccccaccttcaaatgggcagacagggagctcacggcacctgctgtatgctttggttgtttctctgatgtgggtggcgagggtcaggcaggccacatgggctgataccctgatcctgtctctggggagtgggtccctggcttayggacacagtctacccccatcccgtgtccctgagtcctcacttgggaagcaggaccggggacgctcccagccctgaatcgaacacactgacgtgtgctaagttcctgtccctctctggagctcagtttccccatccgtacctggcagggggaggaggttagactggggcagaggtgctgaaaacctagctgagcttcagaagccactggacagcttattaaaaataaagattccaggtccctgactctgggacttctgattttgtaagccccagagtgggttgggggtctgtattttccca

SEQ ID NO: 28978 - DNA, 601 bp, Human
agctcccagagggctggggctgagccctctgccaccattaacaacaaggatcatcaaagctaagtgcagtgagcgcctactgcatgccaggccctgtgctgagggtttgctgtgcagcatttcatgtactcctcagagcaatcctctgagttagatactttgaggaaactgaggctcagaatgcttaagtaacttcctcaaggtcactcagctaataaggggcagaattagaactggaagtctagccaggtgcagtggctcatgcctataatcccagcactttgggaggccgaggcgggcrgattgcctgagctcaggatttcaagaccagcctgggtaacatggtgaaaccccatctctattaaaaatacaaaaattgccaggcatggtggtgggcgcctgtagtcccagctactcgggaggctgaggcacgagagtcgcttgaacccaggaggtggaggttgaagtgaggctgggatcgcgccactgcactccagcctgggcaacagagccagactctgactccaaaaataaaaataaaaaataaagaactggaactctagtccagagtccttgcccataactacatgccatactgcct

SEQ ID NO: 28979 - DNA, 601 bp, Human
actacatgccatactgcctcttagggcatgttgtgggactactggcctttgaggccaggtctgcatggctctgaggctaaggtgtggacaccacactacccagcctggcagagaagtggctggttgtgagggtctcactgcccacctcgaaagcccgtggctgagtgaggtctctgtctcttcaggtgcgtacccagctgtgcccgacaccatgtacctgcccctggccacctccccgatgcccgctgggagtacccctggtgctggatggctgtggctgctgccgggtatgtgcacggcrgctgggggagccctgcgaccaactccacgtctgcgacgccagccagggcctggtctgccagcccggggcaggacccggtggccggggggccctgtgcctctgtaagcaggtttgcaggactgagtgggggcgggtgtgagcgggaggtcaaggccgtggtgtcctggatcaaagtgcagccctcctctctctacctccttgggtgctcacttcaggtatcccatccattccagctgaacttggtgtcccaaagcccactccccactccctcctctcccttcttggcctctgcttaaacca

SEQ ID NO: 28980 - DNA, 601 bp, Human
tgtggacaccacactacccagcctggcagagaagtggctggttgtgagggtctcactgcccacctcgaaagcccgtggctgagtgaggtctctgtctcttcaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggmcggggggccctgtgcctctgtaagcaggtttgcaggactgagtgggggcgggtgtgagcgggaggtcaaggccgtggtgtcctggatcaaagtgcagccctcctctctctacctccttgggtgctcacttcaggtatcccatccattccagctgaacttggtgtcccaaagcccactccccactccctcctctcccttcttggcctctgcttaaaccatctcactaccccaataacctttccccatccctacctgtccaaatcattgccaactttcaaagccaagttcaaacagcttctc

SEQ ID NO: 28981 - DNA, 601 bp, Human
actccctcctctcccttcttggcctctgcttaaaccatctcactaccccaataacctttccccatccctacctgtccaaatcattgccaactttcaaagccaagttcaaacagcttctcccctgagaagcccccccagattcttcaaaccagatgccaccactcccttctcaggatccttacaacactttggggaaaataaaagtgcaaccttttagggcataatatgtgtccagaactgtgctaagcacttactacacaagtcacatcatcctcacaataaccctatgatgggaagtacyttcagacctattttatgaatgaggaaacaggttcaccagcattaagggacatgcttcatgtcacacggcacgggaccagatccaacgggctctaaggaacagtttattctgtcttctcccatagtgggggccctcggagcactgctgggatcctgggtttgccatgtattcagcagtcacccgagcatgtgacattcctcaccactcttctaggccttggtattctctgatgcttcggggcagggctttgcaagctggctccagtgactgggtgccagagaattagttgttgtgggaggg

SEQ ID NO: 28982 - DNA, 601 bp, Human
ctgcaggccaaaggcgtacttgggtccctggtccttcctgcaacttcccaccttggtctgtcaacatgatgggtgctcaacagtgtttaatgatttaaactgaatttagaggccgggaactggtgaaccccaaagagtccagctaagacatcacaaaggctcagtctagggctttgcagggaacatactgccaaaaacctctcccatcacttactcgttgaacgctcttctctaagggccaactctgagctgtgagatgtgctgcagattcaccatcgtgataacagcgcatccaatgccrggatcctgatcttccgccccccagaacggcctccccagtctgttgagagcacctccatccttctcatggctcagactcaagacctgggagtcgttctagaggtctctctatctctctctcttttttttttttttttttttgagatggagtctcactctttcacccaggctggtgtgcagtggcaggatctcagctcactgtaaccccatctcttgcgttcaagcgattctcacgcctcagcctcccaagtagctgggattacagacacataccaccatgcctcgctaatttttgtatttt

SEQ ID NO: 28983 - DNA, 601 bp, Human
gtgaaccccaaagagtccagctaagacatcacaaaggctcagtctagggctttgcagggaacatactgccaaaaacctctcccatcacttactcgttgaacgctcttctctaagggccaactctgagctgtgagatgtgctgcagattcaccatcgtgataacagcgcatccaatgccgggatcctgatcttccgccccccagaacggcctccccagtctgttgagagcacctccatccttctcatggctcagactcaagacctgggagtcgttctagaggtctctctatctctctctctyttttttttttttttttttgagatggagtctcactctttcacccaggctggtgtgcagtggcaggatctcagctcactgtaaccccatctcttgcgttcaagcgattctcacgcctcagcctcccaagtagctgggattacagacacataccaccatgcctcgctaatttttgtattttagtatttcagtagagacggggtttcaccatgttggccaggctggtctggaactcctgacctcaagtgatccacccgcctcggcctccctaagtgctgggattataggtatgagccaccacag

SEQ ID NO: 28984 - DNA, 601 bp, Human
tgaaccccaaagagtccagctaagacatcacaaaggctcagtctagggctttgcagggaacatactgccaaaaacctctcccatcacttactcgttgaacgctcttctctaagggccaactctgagctgtgagatgtgctgcagattcaccatcgtgataacagcgcatccaatgccgggatcctgatcttccgccccccagaacggcctccccagtctgttgagagcacctccatccttctcatggctcagactcaagacctgggagtcgttctagaggtctctctatctctctctcttytttttttttttttttttgagatggagtctcactctttcacccaggctggtgtgcagtggcaggatctcagctcactgtaaccccatctcttgcgttcaagcgattctcacgcctcagcctcccaagtagctgggattacagacacataccaccatgcctcgctaatttttgtattttagtatttcagtagagacggggtttcaccatgttggccaggctggtctggaactcctgacctcaagtgatccacccgcctcggcctccctaagtgctgggattataggtatgagccaccacagc

SEQ ID NO: 28985 - DNA, 601 bp, Human
cgctaatttttgtattttagtatttcagtagagacggggtttcaccatgttggccaggctggtctggaactcctgacctcaagtgatccacccgcctcggcctccctaagtgctgggattataggtatgagccaccacagccggtctagacatctctcttttctcacctcccacataccacccaccagcaaattcatcgtgtatttccagcatccgacactcccatcccttctggtctgagccccgtcatcattggcctggattttgcagtagccccataatcatctccctccttctgtcsttgcccctggtctattcacaacacagcagtcagagagctcctgggaagtcataagccagatcacctccctcctctgccccaagccttctggtggcttcccatctcagaggaaaagccaaagtccccacagtggcctacaaggccccaacaggatcctgttcatgcttcctctctgacctcctctcctcctgctctctgctccagccacattggccccttgctgttccttaaataccccaggcacactcgtgcctcagggcctttgcactggctgttccctctaccagcattatttctcag

SEQ ID NO: 28986 - DNA, 601 bp, Human
aaaatgctgtaagtcccctagctcatctaatcccccagcagccctgtgagccgggtaccaaggctcagagaggcaaaataacttgccccaggccccacaagtgggagccagagttggaacctaagtatgtgtggttttggttctgaaacccctgtgtgtgtacagacctactggaaggttttctcagaagatctgggagaacttgtttgctaatgagtcctttccccagacgtagctcagtggccacccaggtctcacacacacgctgtttcccgtctgcacttcctgagcagctcacacrcttcaccagcgctcttacttcattctgtcttggagatgatgccctcacacccgtccccctttcccaagcccatgagtccctcgaggcaggaactgtcctctttctgtctgggagcacagtggttggcacacaggcgggaaacagtaaatatctctggaatgataaggagtagggctattttatcagggtctctcatgtgccaaggcttatgccagctattcactgaaggggcattcctacagtactgtgtgtcgcacctaggctctgagcccaccggagggtgcagagacgcacactggc

SEQ ID NO: 28987 - DNA, 601 bp, Human
tgccccaggccccacaagtgggagccagagttggaacctaagtatgtgtggttttggttctgaaacccctgtgtgtgtacagacctactggaaggttttctcagaagatctgggagaacttgtttgctaatgagtcctttccccagacgtagctcagtggccacccaggtctcacacacacgctgtttcccgtctgcacttcctgagcagctcacacgcttcaccagcgctcttacttcattctgtcttggagatgatgccctcacacccgtccccctttcccaagcccatgagtccctcraggcaggaactgtcctctttctgtctgggagcacagtggttggcacacaggcgggaaacagtaaatatctctggaatgataaggagtagggctattttatcagggtctctcatgtgccaaggcttatgccagctattcactgaaggggcattcctacagtactgtgtgtcgcacctaggctctgagcccaccggagggtgcagagacgcacactggccgccccagccctcaaggagttcatgtccagtggaggaagtggcaataacacccatatcttgagggcttcattgaaagagtgtt

SEQ ID NO: 28988 - DNA, 601 bp, Human
gtgtcgcacctaggctctgagcccaccggagggtgcagagacgcacactggccgccccagccctcaaggagttcatgtccagtggaggaagtggcaataacacccatatcttgagggcttcattgaaagagtgttccctgagcacctaggccatgcctagcactgtgtgctagagggtacggacatgtcatcccatggaacctgaagttacgattactgagctcatcattgctgtagttcaggccactcagagaagttaagtaacttactcaaagacacacagccagcaagttaagccctsacctgacagtgatgacagcacaagtggacaacgactttgttgcatgaaatctcagcgtgtatagaatacttaaactttattaatatatagtaactatactaatgataataacagagtagctaggacctatggaaggtctcttttatgttgtgatcattacgcctatcattccgagtagtctctaccaccctggaaaataagtaccattatatcccagcttgcaaatgtggaaactgaggcaagaagaagtgaaatcacttggcccaggttcacagctaagaaagggcagagtttgggggg

SEQ ID NO: 28989 - DNA, 601 bp, Human
ggggacccagccccttccagcccaaggtgagcgcagcggtggtccaggtcagggcaggactgcctgggggcgccaagggccacctagggggtggggtggggcgcggcttcctgggtaccaggacccagggacacatcagaagctgggaggggcggaggctgaggagggagataagaaagaggagtggagggccgggcgctgtggttcacccttgtaatcccagtacgttgggaggccaagacgggcggatcacctgaggttaggaattcgaaaccagcctggctgacataggaaaaccccrtctctactaaaaattcaaaaattagcctagcatggtggcgggcatctgtagtcccagctacttgggaggctgaggcaggagaatcgcttgaacccgggaggcagaggttgcagtgagcccagatcacaccactgcactccagcctggccgacaagcacgaaacttcatctcaaaaagaggaaaaaagaaagaggagtggagggtcaccaggcctccctctttaaaaccaataaacaaaaagccactgcctttgagatgtgtaatttaaaaccataaataattaaaaataaaaactgggtg

SEQ ID NO: 28990 - DNA, 601 bp, Human
ttatttgggcttactaaaaaaggaactcaaaactgaacgaggcaaagtggctgctctggaatgtgggccgggggtgggctagagatggagaaaagacagttacctcccaccgtcccactataaatcttcaattttagagatttttgttgttgctgtgttgctttttgaaaattatcacatgaatgtgactttctaaaaaaggcaactgaaaagaggaggattgatttcataaatgctgctgccacccacaagaggtagtcacgtgttatgggtcaggtgcacggcatctgcaacagccccrccatcccctttttgctgtgtgactctgagaaagttgcttaacttctctgtgtctcagtttctccagctgtaaaatggggacaataagagcatccacttcatagcgttgtgagaactacttgagtttgttcaagtcaagcagctgtagcagtgcctggcacatggtactatatcagaggtagccgttattatccctgtgatggaatatgatatatccatttaaatacataggaaaacaccagtgagttcaccttatggataaaagcaggataagaaggtgtatttccaactcgatctcaac

SEQ ID NO: 28991 - DNA, 601 bp, Human
tgattgagctgctgagccctggctgctcagtgctaactcttgttctttcccccctaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacayggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctcc

SEQ ID NO: 28992 - DNA, 601 bp, Human
ccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacaygctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgct

SEQ ID NO: 28993 - DNA, 601 bp, Human
tctgtgacccccaccggggcctctactgtgactacagcggggaccgcccgaggtacgcaataggagtgtgtgcacgtaagtgagtccctccataccttctgaccagcccctgagcacccccagctctggccccaaacccctctcccttggcacccccacagcctttcacctggccaggcttccgttcagcaggagatacaccccatgatcagaggccagaggctgggtccttcctgggaaggggaggcaaggatgcctgcactcttctcgcctccagaactttgcttcttgctttattctyagtcctggaggcacattcatggctgtccccagggaagagggagacgccatgaaatacctaagcctggttttgttctcttagtggtaggatcttttaacaaatgtccatggcctactaggacacaccagcatactgcagaactccagatattttggtaatattgtaaattaaaaaatatggttttaaaaatccagtagccttgaaagaatgaaaatcagcagcctgcagtcatcccttcccaccagctacctacatttctcagttactacagtcacttaaattttctagttatttcttctg

SEQ ID NO: 28994 - DNA, 601 bp, Human
cgcctccagaactttgcttcttgctttattctcagtcctggaggcacattcatggctgtccccagggaagagggagacgccatgaaatacctaagcctggttttgttctcttagtggtaggatcttttaacaaatgtccatggcctactaggacacaccagcatactgcagaactccagatattttggtaatattgtaaattaaaaaatatggttttaaaaatccagtagccttgaaagaatgaaaatcagcagcctgcagtcatcccttcccaccagctacctacatttctcagttactwcagtcacttaaattttctagttatttcttctgaaatataatatagtatattatagaaatatactatatattctatatagtatagaaatataatataaagataatatatacactataaatattatctttctaatgaacttgaagaacagttttcacagggggaaatatactacatatacactatatatagtagttaaatatactatatatacactatatatagtagttaaatatactatacactatatatagtagttaaatatactatacactatatatagtagttatatatactatatat

SEQ ID NO: 28995 - DNA, 601 bp, Human
taggacacaccagcatactgcagaactccagatattttggtaatattgtaaattaaaaaatatggttttaaaaatccagtagccttgaaagaatgaaaatcagcagcctgcagtcatcccttcccaccagctacctacatttctcagttactacagtcacttaaattttctagttatttcttctgaaatataatatagtatattatagaaatatactatatattctatatagtatagaaatataatataaagataatatatacactataaatattatctttctaatgaacttgaagaacarttttcacagggggaaatatactacatatacactatatatagtagttaaatatactatatatacactatatatagtagttaaatatactatacactatatatagtagttaaatatactatacactatatatagtagttatatatactatatatacactatatatagtagttatatatactatatatacactatatatagtgttatatatactatatatacactatatatagttatatatactatatataactatatatagtagttatatatagtatatataactatatatagtatatatac

SEQ ID NO: 28996 - DNA, 601 bp, Human
tattatagaaatatactatatattctatatagtatagaaatataatataaagataatatatacactataaatattatctttctaatgaacttgaagaacagttttcacagggggaaatatactacatatacactatatatagtagttaaatatactatatatacactatatatagtagttaaatatactatacactatatatagtagttaaatatactatacactatatatagtagttatatatactatatatacactatatatagtagttatatatactatatatacactatatatagtattatatatactatatatacactatatatagttatatatactatatataactatatatagtagttatatatagtatatataactatatatagtatatatacactatatatagtagttatacatactatatatacactatatatagtagttatacatactatatatacactatatatagtagttatacatactatatatacactatatatagtagttatacatactatatatacactatatatagtagttatacatacactatatagtagttatatatactacatatacactatatatagta

SEQ ID NO: 28997 - DNA, 601 bp, Human
attatagaaatatactatatattctatatagtatagaaatataatataaagataatatatacactataaatattatctttctaatgaacttgaagaacagttttcacagggggaaatatactacatatacactatatatagtagttaaatatactatatatacactatatatagtagttaaatatactatacactatatatagtagttaaatatactatacactatatatagtagttatatatactatatatacactatatatagtagttatatatactatatatacactatatatagtgttatatatactatatatacactatatatagttatatatactatatataactatatatagtagttatatatagtatatataactatatatagtatatatacactatatatagtagttatacatactatatatacactatatatagtagttatacatactatatatacactatatatagtagttatacatactatatatacactatatatagtagttatacatactatatatacactatatatagtagttatacatacactatatagtagttatatatactacatatacactatatatagtag

SEQ ID NO: 28998 - DNA, 601 bp, Human
tatattctatatagtatagaaatataatataaagataatatatacactataaatattatctttctaatgaacttgaagaacagttttcacagggggaaatatactacatatacactatatatagtagttaaatatactatatatacactatatatagtagttaaatatactatacactatatatagtagttaaatatactatacactatatatagtagttatatatactatatatacactatatatagtagttatatatactatatatacactatatatagtgttatatatactatatatacactatatatagttatatatactatatataactatatatagtagttatatatagtatatataactatatatagtatatatacactatatatagtagttatacatactatatatacactatatatagtagttatacatactatatatacactatatatagtagttatacatactatatatacactatatatagtagttatacatactatatatacactatatatagtagttatacatacactatatagtagttatatatactacatatacactatatatagtagttatatatactatatat

SEQ ID NO: 28999 - DNA, 601 bp, Human
tattctatatagtatagaaatataatataaagataatatatacactataaatattatctttctaatgaacttgaagaacagttttcacagggggaaatatactacatatacactatatatagtagttaaatatactatatatacactatatatagtagttaaatatactatacactatatatagtagttaaatatactatacactatatatagtagttatatatactatatatacactatatatagtagttatatatactatatatacactatatatagtgttatatatactatatatacwctatatatagttatatatactatatataactatatatagtagttatatatagtatatataactatatatagtatatatacactatatatagtagttatacatactatatatacactatatatagtagttatacatactatatatacactatatatagtagttatacatactatatatacactatatatagtagttatacatactatatatacactatatatagtagttatacatacactatatagtagttatatatactacatatacactatatatagtagttatatatactatatatac

SEQ ID NO: 29000 - DNA, 601 bp, Human
attctatatagtatagaaatataatataaagataatatatacactataaatattatctttctaatgaacttgaagaacagttttcacagggggaaatatactacatatacactatatatagtagttaaatatactatatatacactatatatagtagttaaatatactatacactatatatagtagttaaatatactatacactatatatagtagttatatatactatatatacactatatatagtagttatatatactatatatacactatatatagtgttatatatactatatatacamtatatatagttatatatactatatataactatatatagtagttatatatagtatatataactatatatagtatatatacactatatatagtagttatacatactatatatacactatatatagtagttatacatactatatatacactatatatagtagttatacatactatatatacactatatatagtagttatacatactatatatacactatatatagtagttatacatacactatatagtagttatatatactacatatacactatatatagtagttatatatactatatataca

SEQ ID NO: 29001 - DNA, 601 bp, Human
atagtatagaaatataatataaagataatatatacactataaatattatctttctaatgaacttgaagaacagttttcacagggggaaatatactacatatacactatatatagtagttaaatatactatatatacactatatatagtagttaaatatactatacactatatatagtagttaaatatactatacactatatatagtagttatatatactatatatacactatatatagtagttatatatactatatatacactatatatagtgttatatatactatatatacactatatagagttatatatactatatataactatatatagtagttatatatagtatatataactatatatagtatatatacactatatatagtagttatacatactatatatacactatatatagtagttatacatactatatatacactatatatagtagttatacatactatatatacactatatatagtagttatacatactatatatacactatatatagtagttatacatacactatatagtagttatatatactacatatacactatatatagtagttatatatactatatatacactatata

SEQ ID NO: 29002 - DNA, 601 bp, Human
aatctctaaagctgtattgagatcttgtcatctgccaggcaccactcatttatagatgttctgtcatggatccaaagattgtgtgaacccagaaactgcctgtcctgcctgccttccccaccggtggcctggaaaacccccttccctgtcctcctcaccccctatctctgcatcttaggtcctgccttgacccagtacagccacttaacttcccaacaccatgggcttctgtgtacttcctttccttttatttgaaaaaaacaaaaactgtaggctaaaggagattgtaatagattttacrcctaccagtggttccctggtcatgaagttttacaagcattgagataaataaagctaaccaggagctatagaaattctcagaggcttcaaattttcatgtccattgccaaattccaaaagagaggtatcataagcttcataataaattttttagatgtatttaatactaaattttttcagtcagatagttccttacccacccattacactacacacacacacacacacacacacaaacacacagttatacatatacacatcacacacatatgtgcccacacatgcacaaacacaactcact

SEQ ID NO: 29003 - DNA, 601 bp, Human
gtcctgccttgacccagtacagccacttaacttcccaacaccatgggcttctgtgtacttcctttccttttatttgaaaaaaacaaaaactgtaggctaaaggagattgtaatagattttacgcctaccagtggttccctggtcatgaagttttacaagcattgagataaataaagctaaccaggagctatagaaattctcagaggcttcaaattttcatgtccattgccaaattccaaaagagaggtatcataagcttcataataaattttttagatgtatttaatactaaattttttcrgtcagatagttccttacccacccattacactacacacacacacacacacacacacaaacacacagttatacatatacacatcacacacatatgtgcccacacatgcacaaacacaactcactagtgctctattgaacatgttcccggaagtgctaccatagtgtctgaattcatgagaccctaatgcaggaaagaagagagtgtggggtctgcaaaagaatacacctctgggccagagggtaaacagaacaaacggttcctctaagaaacaatctttccacaaatggtcagctaagcaaa

SEQ ID NO: 29004 - DNA, 601 bp, Human
cccagtacagccacttaacttcccaacaccatgggcttctgtgtacttcctttccttttatttgaaaaaaacaaaaactgtaggctaaaggagattgtaatagattttacgcctaccagtggttccctggtcatgaagttttacaagcattgagataaataaagctaaccaggagctatagaaattctcagaggcttcaaattttcatgtccattgccaaattccaaaagagaggtatcataagcttcataataaattttttagatgtatttaatactaaattttttcagtcagatagttycttacccacccattacactacacacacacacacacacacacacaaacacacagttatacatatacacatcacacacatatgtgcccacacatgcacaaacacaactcactagtgctctattgaacatgttcccggaagtgctaccatagtgtctgaattcatgagaccctaatgcaggaaagaagagagtgtggggtctgcaaaagaatacacctctgggccagagggtaaacagaacaaacggttcctctaagaaacaatctttccacaaatggtcagctaagcaaatggacagttcct

SEQ ID NO: 29005 - DNA, 601 bp, Human
aaaaaagctaggtcttgttcagcatgcttagttttcaagagaatccaggtacatagatttgtgtatgatttgtaaacattggcaatacattcaaaaatatttttaaaaccactctgtgggccaaactaaatacatctgtgggcagagggtgacctctgagttacatcatttggctatttcagttgcacaaacactactctacgtttaaatgaagctgggtcaggcctgagggcagtgtggtttggtggaaggattatgatatttacaagctgacagacttgagttttagatcctggctctrccacttgctagctacgtgaccatgtgcacatcacttaaggagtgtcataaaaccaacctcacatgcttgttgcaaaataaataaggaaatgtcaaaaaataaaaataaaagtaattggctgctcttggcttgccttgcaaggaaagttacctcagtcttattcacggccacctttagaggagggagcaggtctagctcctggcctagatcccccatactgaagagtgagggagtagtaaattcatgcatgctctttggacctagacaacccagctggaatcccagcatcatcactcacta

SEQ ID NO: 29006 - DNA, 601 bp, Human
tcccccatactgaagagtgagggagtagtaaattcatgcatgctctttggacctagacaacccagctggaatcccagcatcatcactcactattactatgactttaggcgaactacttagccttttaagtctcagtttcttcttcaaggaaaatgtgacaaagaaagtttatatctctgggtggttagaatgtcaagtgcctgctacatggcaggagctgaataaagagtacagctcaccccagttcccatccatccatccctccattgattcttcacacaataaacataagtgaggcagmaaaaacaaacagagctacaacaaggcatggcccactgtccctgctgacagcgtgagctgacagtccatgggaggtgtgaagggagggaaggccccgatggcagagcaagttgacttgaattcctgaaagtgcttcagtaagaggaaagctaactcgatcacacctgcacttgcagatctgagattagataggaggtagtgaaggaaacccaactgtcttcaccatctcgcctttgattagttagaaacttaatgagtcagctgaagggaccatctgcagccgtcatgcatcccactagcc

SEQ ID NO: 29007 - DNA, 601 bp, Human
gtaaattcatgcatgctctttggacctagacaacccagctggaatcccagcatcatcactcactattactatgactttaggcgaactacttagccttttaagtctcagtttcttcttcaaggaaaatgtgacaaagaaagtttatatctctgggtggttagaatgtcaagtgcctgctacatggcaggagctgaataaagagtacagctcaccccagttcccatccatccatccctccattgattcttcacacaataaacataagtgaggcagcaaaaacaaacagagctacaacaaggcrtggcccactgtccctgctgacagcgtgagctgacagtccatgggaggtgtgaagggagggaaggccccgatggcagagcaagttgacttgaattcctgaaagtgcttcagtaagaggaaagctaactcgatcacacctgcacttgcagatctgagattagataggaggtagtgaaggaaacccaactgtcttcaccatctcgcctttgattagttagaaacttaatgagtcagctgaagggaccatctgcagccgtcatgcatcccactagcctgtggtgggcaggctggtcagagccag

SEQ ID NO: 29008 - DNA, 601 bp, Human
tgtgaagggagggaaggccccgatggcagagcaagttgacttgaattcctgaaagtgcttcagtaagaggaaagctaactcgatcacacctgcacttgcagatctgagattagataggaggtagtgaaggaaacccaactgtcttcaccatctcgcctttgattagttagaaacttaatgagtcagctgaagggaccatctgcagccgtcatgcatcccactagcctgtggtgggcaggctggtcagagccagtagcagcatctcacttccccacccaaagccccaaggagagagactggmgcgccttctagttgcactggttttcaaccttagctgcaaacaggattcacctggggaacttttaaaatacggagatcaacaaaagaagaatactgacacccaggttcacccccatattctgaggcctggcatgagcatcacaatttttaaaagctccccaggttcccctggggttcccctgtgcagctggtagggaaagccactgtgctggggactccgggcatctagcactgacctctccctccaaagtctccacatgcagggacagagttccgggcttagcccactcccttctccaca

SEQ ID NO: 29009 - DNA, 601 bp, Human
tgggagaactgaatgagataatgtatcagatgatacctggcactagatcagagggtcagttgatgttagcatctttcctttctgcacctcctgcacggataaccgcaccccaaaaaaaacaatagccgcagcaaggttcacacaaaccgggattctgcttcccgctgtggtcaccttggacgctatgtgtcttcaccttgctgagactttgttttgctatatataaagacaaagatgataatgtgatagtgtttctgtacagaataaaataagtaatgcaatgcacaatacagaggagacmcagtatccaataacagagacagtacttcgaaaaccttcatgcctgctagacattaggattactgctattattaacagccaccttcgggcaaaccctgaaggacagaactgttggcccactgcagattccaaactgcttctccttgggtggccactcatgatgtccggggctctttacctgcatttccagaagctgtcctccagagagagcatggtatcaagggtgatatctggtccagaagtccccaactctccctgactccaaactggcttaactaactccacatggccacttggttgt

SEQ ID NO: 29010 - DNA, 601 bp, Human
cctcagacctctcccacagcccaggcttgctcccacctgtggtctttttacttaagtgggcccctccctacctggaaagctcctcccccaacccctgggcgggcttccttcctcacctccttcaggctttgctgagcgtcatcacccagtgaggccttccccatccacctgatttaaccctattcccagttgcgctgagaatactcaccagcagcactagaggctgcagcatttaccccaaaataattttgccacaaaatatctcacttttgttactctattcacatcattctagaatacmaactttgaaaaacaaaagatatcattctatttacagcattgtgtttttttaggagtggtatttccatttacaaaatatagtaattctcgatcactgaaaatgtcaaatcctagaaaacccagcattcctatgcataattgttcttcaacagttggctgggattcacttgatgaatctgatttttctgaaatagattattctgatgattcagacaattctgatgttagttctgtttagaaagaactccaagaaacagtttttatattttatttttacatggaaaatcagtcagatttgctt

SEQ ID NO: 29011 - DNA, 601 bp, Human
tgaatctgatttttctgaaatagattattctgatgattcagacaattctgatgttagttctgtttagaaagaactccaagaaacagtttttatattttatttttacatggaaaatcagtcagatttgctttaacctcaaaaagtgtgtttatgtaaaattaaatgagctctggcagctagctgaacatttttttctaaacagggaaagggttattaataaatttgcaactgtctccccccgcccaactccccctccctgctccacttttctcccagacacttgtaactgccaacattccayatgacctttccacagcataagctctttgagggcatgtcttttgtctgttttgtccactattgagtccccagcacatagaaggctccatgaatgtgtatggaatgaatggaacacgtgtttcgaagtgttctggctttttttttacaagtcggtcaccttcagaaccatgagccctaatggcaggtctttgtcagtaccaggctttgtgcctggtgctggggaccctgcagggagcaaaccagccaagtccctcgggaggctgcgtccttccactccctgggtgctggctgaagctataaa

SEQ ID NO: 29012 - DNA, 601 bp, Human
tcaaaaagtgtgtttatgtaaaattaaatgagctctggcagctagctgaacatttttttctaaacagggaaagggttattaataaatttgcaactgtctccccccgcccaactccccctccctgctccacttttctcccagacacttgtaactgccaacattccatatgacctttccacagcataagctctttgagggcatgtcttttgtctgttttgtccactattgagtccccagcacatagaaggctccatgaatgtgtatggaatgaatggaacacgtgtttcgaagtgttctggctttttttttacaagtcggtcaccttcagaaccatgagccctaatggcaggtctttgtcagtaccaggctttgtgcctggtgctggggaccctgcagggagcaaaccagccaagtccctcgggaggctgcgtccttccactccctgggtgctggctgaagctataaaggaactcctgcactccctttgctgaagttccaccaaacactcagccctgccctgtgcactctcacacctccctgcctttgcctttgtgcctctgttcctcctccatgctgggagccatccccgggattggggcat

SEQ ID NO: 29013 - DNA, 601 bp, Human
cctctcctcatgcacatgtgtgtttggatgggacaggcctcctctccactgcatcttgttccatctttctgtgggcagttctgtcttaacagcttttaacctgctttggtctcgagctcaccaccattttccgtttttcagatagttagagagcacttactatcttctagatgcgggagatacatgcatcaataggaacatccaagagtgggtagttgagttggctgacagtcaaatgaccacacagactcacattaactaagggctttagcttactaaaggccagggacagcctgggtgcttcataggcgtgaagtcatcttttctatcatggcactagaaagagatgctatagccaaccccatgtgcaggtggggatcctgaggcaaggaggtgtgagctagcttattggaagttacatagccagcaagtagcagtgctgccagttgaaccctggtgatttgactctgaagcctgtatgtcctttttttttttttttttttttttttttgagacagaatcctgctttttagaccaggctggagtgcacgggcacgatcttggctcactgcaacctctacctcccagatcaagcaattct

SEQ ID NO: 29014 - DNA, 601 bp, Human
gttgaaccctggtgatttgactctgaagcctgtatgtcctttttttttttttttttttttttttttgagacagaatcctgctttttagaccaggctggagtgcacgggcacgatcttggctcactgcaacctctacctcccagatcaagcaattcttgtgactaaacctcctgagtagctgggattacagcacatgccaccatgcccggttaatttgtgtattttttagtagagatggggtttcaacatgttagctaggctagtctcaaactcctgacctcaagtgatccacctgctttgrcctcccaaagaagcctgtgtgccctcttacccactatgccctcggcatcactgcgacaaaatgttaggtgctggcatgtagctacttgcctttgaacttcccccaaataaactttctctctgcagaggcaggagaatgtcttttaccactcttattcctggtcaggcgtggtggcttacgcctgtaatcccaacactttggaaggctgaggcgggtggatcacctgaggtcacgagtttgaaaccagcctgaccaacatggtgaaacctcatctctactaaaaatacaaaattagccggg

SEQ ID NO: 29015 - DNA, 601 bp, Human
gcaggtgttattgttctaatagggagacaggcccagggtgggttatctaagatcacacagcttgtaggtggtagagcagaatttgaactgggatccacctgtctctaaagatgggtttcctcccatgcttccacactgcctctcttgatcagaaacatacaaggagctgagaacatgtcctccactccctgggtacctttgctggttagaagccaacttgctgtcctgtggggaggtacagccaatttctgtgttcctctgagttctggggaccgcagaccttagtgtggtgaaagtgagsgttgggggctggtgggagctgtagattcatgcagattctgttccccacacacagatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggtgggtccagagcaggtgtggatgtctagacttcacaagcagacaaatatgg

SEQ ID NO: 29016 - DNA, 601 bp, Human
taaaatttgataaacattcctgttgatgggaaaagcccccagttaatactccagagacagggaaaggtcagcccatttcagaaggaccaattgactctcacactgaatcagctgctgactggcagggctttgggcagttggccaggctcttccttgaatcttctcccttgtcctgcttggggttcataggaattggtaaggcctctggactggcctgtctggcccctgagagtggtgccctggaacactcctctactcttacagagccttgagagacccagctgcagaccatgccagaccyactgaaatgaccaagacaggttcaggtaggggtgtgggtcaaaccaagaagtgggtgcccttggtagcagcctggggtgacctctagagctggaggctgtgggactccaggggcccccgtgttcaggacacatctattgcagagactcatttcacagcctttcgttctgctgaccaaatggccagttttctggtaggaagatggaggtttaccggttgtttagaaacagaaatagacttaataaaggtttaaagctgaagaggttgaagctaaaaggaaaaggttgttgttaatgaatat

SEQ ID NO: 29017 - DNA, 601 bp, Human
ctgtctggcccctgagagtggtgccctggaacactcctctactcttacagagccttgagagacccagctgcagaccatgccagacctactgaaatgaccaagacaggttcaggtaggggtgtgggtcaaaccaagaagtgggtgcccttggtagcagcctggggtgacctctagagctggaggctgtgggactccaggggcccccgtgttcaggacacatctattgcagagactcatttcacagcctttcgttctgctgaccaaatggccagttttctggtaggaagatggaggtttaccrgttgtttagaaacagaaatagacttaataaaggtttaaagctgaagaggttgaagctaaaaggaaaaggttgttgttaatgaatatcaggctattatttattgtattaggaaaatataatatttactgttagaattcttttatttagggccttttctgtgccagacattgctctcagtgctttgcatgtattagctcactgaatcttcacgacaatgttgagaagttcccattattatttctgttcttacaaatgtgaaacggaagctcatagaggtgagaaaactcaaccagagtcacc

SEQ ID NO: 29018 - DNA, 601 bp, Human
cccagaagccctgtttcctgctgcgctggtgtgaccagtggctgctgggggtggggttagggaggtggttgtggccaggagggcgggaggtggccaaggccggcccctgggagggtgcagtgctaggacctccctctggagcgctgccagcataccaggccctctcctattcttaaaaaaaaaaaaattgtgatgttattgagctgtaactgaaataagggttcacccatttagtgtacaagtcagtggttttcactattttcataggtttgtggaccatattcagtgtgagagcttttcmtcaccttataaacgccatacataccatttatcaccctcttatccacatgcccccagcaacctcctttctgtatctattcatcttgcaatcctggacatttcatgtaaatagaatcagacaatgtagtcttgcaagtggtttctttcacttagtgtaatgtgttcagtgttgtggcacatatcagaactagttttttttggaggaataatattctgttgtgtggacaggccatgttttgtttacctgttcattagttgacagacatttgggttgtttgcatctttgggtgcctcacctgtg

SEQ ID NO: 29019 - DNA, 601 bp, Human
gattctgattttattaatgttactgtgtcctgtgaatcacctcaccctttgggacaaagatggggatgtttgcttgactttgagtaaataacatatttactcaaggaggtgatcaatattcacagtgtactgagcctgagcctctgtggggttgctgagcaccagggtcacagatgagggggagatggcacgggagagtggagatgctctctgtgcagggccagggggtgcagagtgggaggaaggagagggggatgctgagtgggtcactggacaagatgtccgggttaaaggtcacccrggaacacagggaccttggcaagaaggtgacaggactgtgacaggtatccaaggcattaaagatatctttatcttatctttgtaaaaatcaaagcttctggtccatcggaggatccgagtgtgaatttcctgaagaacgttggggagagtgtggcagctgcccttagccctctgggtgagtgcacctccttgcccagtgcttccctaactcagcctgcactttatgtaactttcacctggaatactgcaaaggaatgggtaattgacatgcccttgacactggtgaggatttgttgcctca

SEQ ID NO: 29020 - DNA, 601 bp, Human
ctccttgcccagtgcttccctaactcagcctgcactttatgtaactttcacctggaatactgcaaaggaatgggtaattgacatgcccttgacactggtgaggatttgttgcctcaaatcaacctttagtagtgctggaccacgggcaactcaaggttgaattccctgacaaaattctcgagctttctacatggagtgaagtcgaatcagctggcatttggttgggataatcccagtgagggagggtgaccagactgtggttgcaggtcttgcctgtcacctctgactgccctcctttggrtgaacaatagtctgcaatttcccctaagccaggccttgggatttggacttttgaggacctgggtagtagttagttgacatgctatttatcttttccttcttttagtttacaacccccaaacctttctggtgcttctgagtgctgggcctgcctcagagcggggagaaggtggaggcaggtgctctgggtgacacccggttctggtgcctcaggttgcacagtgggtctgtggggtgggtgaaggtgccacctgaccccaggcatgagctcaggctctgagacccctccctgctgggcttt

SEQ ID NO: 29021 - DNA, 601 bp, Human
gctctgtcacggaggctggagtgcagtggtgccatctctgctcactgcaacctccccctcctgggttcaagtgattctcctgcttcagcctcctgggtaagtgggattacaggtacccgccaccacgcccagctaagttttgtatttttttagtagagacggggtttcgccacgttggccaggctggtcttgaacttctgacctcaggtgatccacccgtcttggcctcccaaagtgctgggattacaggtgtgaaccactgcgcctggccttgctcattccactttgaggcggcagtgayatcttggcattgcttctgaactaaacagcccaaacacgcatggcttctgtactagagtttagaggtgaagtcagagaataggaaagaagaatcgctagtctgtttttttttttttttctttgagacagactttcacccttgtcgcctaggctggagtgcagtggtgtgatctcggctcactgcaacctctgccttccaggttcaagcgattctcctgcctcagcctcccaagtagctgggattataggtgcccaccacaacgcctagctattttttgtatttttagtagagacggggttt

SEQ ID NO: 29022 - DNA, 601 bp, Human
tcaagtgattctcctgcttcagcctcctgggtaagtgggattacaggtacccgccaccacgcccagctaagttttgtatttttttagtagagacggggtttcgccacgttggccaggctggtcttgaacttctgacctcaggtgatccacccgtcttggcctcccaaagtgctgggattacaggtgtgaaccactgcgcctggccttgctcattccactttgaggcggcagtgacatcttggcattgcttctgaactaaacagcccaaacacgcatggcttctgtactagagtttagaggygaagtcagagaataggaaagaagaatcgctagtctgtttttttttttttttctttgagacagactttcacccttgtcgcctaggctggagtgcagtggtgtgatctcggctcactgcaacctctgccttccaggttcaagcgattctcctgcctcagcctcccaagtagctgggattataggtgcccaccacaacgcctagctattttttgtatttttagtagagacggggtttcactgtgttggccaggctgatctcgacacctgcctcggcctcccaaagtgctgggattacaggtgt

SEQ ID NO: 29023 - DNA, 601 bp, Human
cgccaccacgcccagctaagttttgtatttttttagtagagacggggtttcgccacgttggccaggctggtcttgaacttctgacctcaggtgatccacccgtcttggcctcccaaagtgctgggattacaggtgtgaaccactgcgcctggccttgctcattccactttgaggcggcagtgacatcttggcattgcttctgaactaaacagcccaaacacgcatggcttctgtactagagtttagaggtgaagtcagagaataggaaagaagaatcgctagtctgtttttttttttttttctttgagacagactttcacccttgtcgcctaggctggagtgcagtggtgtgatctcggctcactgcaacctctgccttccaggttcaagcgattctcctgcctcagcctcccaagtagctgggattataggtgcccaccacaacgcctagctattttttgtatttttagtagagacggggtttcactgtgttggccaggctgatctcgacacctgcctcggcctcccaaagtgctgggattacaggtgtgagccaccgagcccggccaagaatcagtattcttaatgctttccaaggagg

SEQ ID NO: 29024 - DNA, 601 bp, Human
tgatccacccgtcttggcctcccaaagtgctgggattacaggtgtgaaccactgcgcctggccttgctcattccactttgaggcggcagtgacatcttggcattgcttctgaactaaacagcccaaacacgcatggcttctgtactagagtttagaggtgaagtcagagaataggaaagaagaatcgctagtctgtttttttttttttttctttgagacagactttcacccttgtcgcctaggctggagtgcagtggtgtgatctcggctcactgcaacctctgccttccaggttcaagcrattctcctgcctcagcctcccaagtagctgggattataggtgcccaccacaacgcctagctattttttgtatttttagtagagacggggtttcactgtgttggccaggctgatctcgacacctgcctcggcctcccaaagtgctgggattacaggtgtgagccaccgagcccggccaagaatcagtattcttaatgctttccaaggagggtaaacagtggagcaccgaggtcatgattgagagatcggctgtgcctaaatcctgccactcactctggacgtagtaaaggtctgagagatt

SEQ ID NO: 29025 - DNA, 601 bp, Human
actgcgcctggccttgctcattccactttgaggcggcagtgacatcttggcattgcttctgaactaaacagcccaaacacgcatggcttctgtactagagtttagaggtgaagtcagagaataggaaagaagaatcgctagtctgtttttttttttttttctttgagacagactttcacccttgtcgcctaggctggagtgcagtggtgtgatctcggctcactgcaacctctgccttccaggttcaagcgattctcctgcctcagcctcccaagtagctgggattataggtgcccaccayaacgcctagctattttttgtatttttagtagagacggggtttcactgtgttggccaggctgatctcgacacctgcctcggcctcccaaagtgctgggattacaggtgtgagccaccgagcccggccaagaatcagtattcttaatgctttccaaggagggtaaacagtggagcaccgaggtcatgattgagagatcggctgtgcctaaatcctgccactcactctggacgtagtaaaggtctgagagattgccggtgaatttggagatatgaacaagagtccttcactcaaagaacaaag

SEQ ID NO: 29026 - DNA, 601 bp, Human
taggaaagaagaatcgctagtctgtttttttttttttttctttgagacagactttcacccttgtcgcctaggctggagtgcagtggtgtgatctcggctcactgcaacctctgccttccaggttcaagcgattctcctgcctcagcctcccaagtagctgggattataggtgcccaccacaacgcctagctattttttgtatttttagtagagacggggtttcactgtgttggccaggctgatctcgacacctgcctcggcctcccaaagtgctgggattacaggtgtgagccaccgagcycggccaagaatcagtattcttaatgctttccaaggagggtaaacagtggagcaccgaggtcatgattgagagatcggctgtgcctaaatcctgccactcactctggacgtagtaaaggtctgagagattgccggtgaatttggagatatgaacaagagtccttcactcaaagaacaaaggagacatcccgggaagtcacaaaaccaagtctaggttcaggtagagacttttaaaacagtgcagatccccagaccttaccttttttgatcctggtgagtgagtgttggtggggcctgggat

SEQ ID NO: 29027 - DNA, 601 bp, Human
agtgctgggattacaggcgtgagccactgcacccggccctcagatgtctttgagcactaaaagctaaaggcttaaagtggatagaattgctttctccgaactagggaggagcctgaagctctacaaacaaggaatatttcagtaaaatagactgagtggtttcagctgaggagagccagtggaggagcggcttagactgttgtggaagttagggctagtttctttctttatgaggaactataagctggatgactcacaggttaactgcctagaagggactgttcccagagcagggcccaarggggaacgaacgagtcaacagctgcctcccggtggcagtgtgtgtagggtaagcggcagctttcatgtgaagtgccaaggccttttggttggggggctgagaacctgctgagggagccacaactgagacccaggctgctcctggctgggaggctacaggccccgaagccacagggcccctcctggtcgtgggatctttgataaaccgacacgcagaggctttgtgaggcagcagggcacggagcatcgtctagtcttttttttaagtgaaagcacatttcttaagaaagtaaaggaatac

SEQ ID NO: 29028 - DNA, 601 bp, Human
gaaagtaaaggaatacaagaatggctactccgtagacaaagtagcctgtccagtcttacgacaaggcctgaaaatctcacgctttcatcaccaagttggagagatcctaattctataatttctctgatctgcttacaggcgagtctcattacccatttacaaagcatatgggtattgattgtactattctttcaacttttcaacttttctgtttgtttcaaccttttttttttcttatctttttttttttttttttttttgagacagacttttgctcttgttgtccaggctggagtgcaayggtgtgatcttggctcactacaacctctgcctcccgggttcaagcgattctcctgcctcagcctttcccagtagctgggattacaggcatgcaccatcacgcctggctaattttgtatttttagtagagacgaggtttctctgtgttggtcaggctggtctcgaactcccgacctcaggtgatctgcccgccttggcctcccaaaatgctgggattacaggcgtgagccactgtacccggcagcttcaaccttttcataatcacaagttgggaagaataaaggagaaaaataatttaaat

SEQ ID NO: 29029 - DNA, 601 bp, Human
ccatcacgcctggctaattttgtatttttagtagagacgaggtttctctgtgttggtcaggctggtctcgaactcccgacctcaggtgatctgcccgccttggcctcccaaaatgctgggattacaggcgtgagccactgtacccggcagcttcaaccttttcataatcacaagttgggaagaataaaggagaaaaataatttaaatattacagatggaggtacttgtagttaagcctgcttttacctctgctccccccttaaactctattgaaataacaggaaagggcttacacaaaaaagaaaacaccatagacaaagaaagtaatagaggaaaagacaaagatgtgatcagattttggaagatggacatggagggagggtggcaacctgctgagggaagcttcagaaatctctgtgccagaacagggcatcctggtgagaaggaagaccatctgttcaggtaccaggaaaggcaagaggtgggagtgatcgggggacaggaacaaggggggagggttgaaaacctctagggagtgtcagctagagacttcagggcccacttggccagatgatggctcttgccaacaattgaaggagac

SEQ ID NO: 29030 - DNA, 601 bp, Human
ggcagcttcaaccttttcataatcacaagttgggaagaataaaggagaaaaataatttaaatattacagatggaggtacttgtagttaagcctgcttttacctctgctccccccttaaactctattgaaataacaggaaagggcttacacaaaaaagaaaacaccatagacaaagaaagtaatagaggaaaagacaaagatgtgatcagattttggaagatggacatggagggagggtggcaacctgctgagggaagcttcagaaatctctgtgccagaacagggcatcctggtgagaagsaagaccatctgttcaggtaccaggaaaggcaagaggtgggagtgatcgggggacaggaacaaggggggagggttgaaaacctctagggagtgtcagctagagacttcagggcccacttggccagatgatggctcttgccaacaattgaaggagacctcatgtttaattccaggagcacctgacccagggaagcttcagcatgggatactagagacaggccagggtgaggcaccagcctgaaactgggcatcccgaatgagcaatgggcccagcagtcagttccctggccaggcaggaggt

SEQ ID NO: 29031 - DNA, 601 bp, Human
aatataaaaattagctgggcatggtggcacgtgcctatagtcccagctactcgggaggctgaggcaggagaatcacttgaacctggtgggcagaggctgcagtgagccgagagattgcggcactgcgctccagcctgggcaacagagcgagactctgtctacaaaacaaaggaaaagagaagccattatcagtggtaggaaaacaaaaagcgatacaaagaaatagtctgctacttgacccagcaaagaacatttagatagaggtcctagctgaaacattgaatgttctttttttttttttgagatggagtcttgctctgtcaccaggctggagtgcagtggcgccaacttggctcactgcaacctccgcctcccaggttcaagcgattcttctgcctcagcctcccgagtaactgagactacaggcgattgccaccacgcccagctgattttttgtatttttagtagagacggggtttcaccatattagccagggtagtctcgatctcctgatctcgtgatccgcccgcctcggcctcccaaagtgctgggattacaggcgtgagccactgcgctcggcctactgaatgttcttttaaca

SEQ ID NO: 29032 - DNA, 601 bp, Human
cagtgagccgagagattgcggcactgcgctccagcctgggcaacagagcgagactctgtctacaaaacaaaggaaaagagaagccattatcagtggtaggaaaacaaaaagcgatacaaagaaatagtctgctacttgacccagcaaagaacatttagatagaggtcctagctgaaacattgaatgttctttttttttttttgagatggagtcttgctctgtcaccaggctggagtgcagtggcgccaacttggctcactgcaacctccgcctcccaggttcaagcgattcttctgcctcrgcctcccgagtaactgagactacaggcgattgccaccacgcccagctgattttttgtatttttagtagagacggggtttcaccatattagccagggtagtctcgatctcctgatctcgtgatccgcccgcctcggcctcccaaagtgctgggattacaggcgtgagccactgcgctcggcctactgaatgttcttttaacaaaaaattgcgtcttggaaagggtagtggaaggagaggcaggtactggtccagagtaggaagtgcgcagatgtgaactccagcagcaggcaagagcagcg

SEQ ID NO: 29033 - DNA, 601 bp, Human
tgctacttgacccagcaaagaacatttagatagaggtcctagctgaaacattgaatgttctttttttttttttgagatggagtcttgctctgtcaccaggctggagtgcagtggcgccaacttggctcactgcaacctccgcctcccaggttcaagcgattcttctgcctcagcctcccgagtaactgagactacaggcgattgccaccacgcccagctgattttttgtatttttagtagagacggggtttcaccatattagccagggtagtctcgatctcctgatctcgtgatccgcccrcctcggcctcccaaagtgctgggattacaggcgtgagccactgcgctcggcctactgaatgttcttttaacaaaaaattgcgtcttggaaagggtagtggaaggagaggcaggtactggtccagagtaggaagtgcgcagatgtgaactccagcagcaggcaagagcagcgtgagctgaaagggcacagggagagtttggggagtgggatgggggcagggagtgtgcaccacagcctttggcaactggtgactctaagctgtgggtgtggagacttttgacacatttaatttcaaaaata

SEQ ID NO: 29034 - DNA, 601 bp, Human
ccctctgtccctggtgagtcacgtgagcctggaggtgtgcaggttccctgtggggccagcgttgggccctacgcagcgcctgcacggcccatccacctcccagagcagagctccggcgttgaggtgtgcgtgtgtgtcgtcgcacaaagcctctgtgtgcaggtgtcaggaggcacatggccttccatcactgtggctggaagcgcctgccacatgtggtattggctctccctgtacttagggcctggccccacctgccgtgtggcccgtgtcctgcatggttaggaaaaaggtctctttygactttctggctcagaagctgactttagatgctagctgaggttaatgttttactgaattggagaaagagaaaggtccagtatcatgggcccaccaagaatgtttccagaagccacagagatttgtagctgggatatggggagaagcctctgactcatgggtttgtatcgtctggtcccatactggctgtgtgattccggggtcgagctgggtagaacctagcacctgcatccacacgctgagtgccaccatccagacacttagctgcttgtggggactgaacgttgagatcttcgtgagt

SEQ ID NO: 29035 - DNA, 601 bp, Human
gaaagagaaaggtccagtatcatgggcccaccaagaatgtttccagaagccacagagatttgtagctgggatatggggagaagcctctgactcatgggtttgtatcgtctggtcccatactggctgtgtgattccggggtcgagctgggtagaacctagcacctgcatccacacgctgagtgccaccatccagacacttagctgcttgtggggactgaacgttgagatcttcgtgagtctgtagtctccacaggccaagctcctgcttgcaggtgcatccttgggggaacttcacggcttrctctttcctcctccgcctctaggcattgaagttgatatcgatgtggagcacggagggaaaagaagccgcctgacccccgtctctccagagagttccagcacagaggagaagagcagctcacagccaagcagctgctgctctgatcccagcaagccgggtgggaatgttgagggcgccacgcagtctctggcggagcagatgagaaagatcgccttggagtccgaggggcgccctgaggcaagcctgtgcccctcccgccacctgggaccacggccagcctagtgatctgtggcctgcacc

SEQ ID NO: 29036 - DNA, 601 bp, Human
ctgggtagaacctagcacctgcatccacacgctgagtgccaccatccagacacttagctgcttgtggggactgaacgttgagatcttcgtgagtctgtagtctccacaggccaagctcctgcttgcaggtgcatccttgggggaacttcacggcttgctctttcctcctccgcctctaggcattgaagttgatatcgatgtggagcacggagggaaaagaagccgcctgacccccgtctctccagagagttccagcacagaggagaagagcagctcacagccaagcagctgctgctctgaycccagcaagccgggtgggaatgttgagggcgccacgcagtctctggcggagcagatgagaaagatcgccttggagtccgaggggcgccctgaggcaagcctgtgcccctcccgccacctgggaccacggccagcctagtgatctgtggcctgcacctccgcctcatcctcagcacctctgcagccccacttacaaacccgagggagctgctgctgctgcagtgatgtctgtgccattaaagtcacgctgggaacctgctagaactttgtagttacttggtctttgtgagtggccactgtt

SEQ ID NO: 29037 - DNA, 601 bp, Human
cttgtggggactgaacgttgagatcttcgtgagtctgtagtctccacaggccaagctcctgcttgcaggtgcatccttgggggaacttcacggcttgctctttcctcctccgcctctaggcattgaagttgatatcgatgtggagcacggagggaaaagaagccgcctgacccccgtctctccagagagttccagcacagaggagaagagcagctcacagccaagcagctgctgctctgatcccagcaagccgggtgggaatgttgagggcgccacgcagtctctggcggagcagatgagraagatcgccttggagtccgaggggcgccctgaggcaagcctgtgcccctcccgccacctgggaccacggccagcctagtgatctgtggcctgcacctccgcctcatcctcagcacctctgcagccccacttacaaacccgagggagctgctgctgctgcagtgatgtctgtgccattaaagtcacgctgggaacctgctagaactttgtagttacttggtctttgtgagtggccactgttccccctagacccctgcagccttaactgcacgtgtgcatgcgtgctccccgactgtctgcc

SEQ ID NO: 29038 - DNA, 601 bp, Human
ctctggcggagcagatgagaaagatcgccttggagtccgaggggcgccctgaggcaagcctgtgcccctcccgccacctgggaccacggccagcctagtgatctgtggcctgcacctccgcctcatcctcagcacctctgcagccccacttacaaacccgagggagctgctgctgctgcagtgatgtctgtgccattaaagtcacgctgggaacctgctagaactttgtagttacttggtctttgtgagtggccactgttccccctagacccctgcagccttaactgcacgtgtgcatgcrtgctccccgactgtctgccaggagccagggccatggtcaggcttggcctgttgcgcgtgtctcctgtgtgctcatggtgagttttgttccaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagtgaacca

SEQ ID NO: 29039 - DNA, 601 bp, Human
gtccgaggggcgccctgaggcaagcctgtgcccctcccgccacctgggaccacggccagcctagtgatctgtggcctgcacctccgcctcatcctcagcacctctgcagccccacttacaaacccgagggagctgctgctgctgcagtgatgtctgtgccattaaagtcacgctgggaacctgctagaactttgtagttacttggtctttgtgagtggccactgttccccctagacccctgcagccttaactgcacgtgtgcatgcgtgctccccgactgtctgccaggagccagggccayggtcaggcttggcctgttgcgcgtgtctcctgtgtgctcatggtgagttttgttccaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagtgaaccaagaggttttgtacatattcctacctttcccttta

SEQ ID NO: 29040 - DNA, 601 bp, Human
ggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagtgaaccaagaggttttgtacatattcctacctttccctttagagcatcctgccctcctctgatttcagcgacacaaacagaaggatgagatgttctccactgcagggmtgtctgtaggtgtgggaggttaggagttggttttgtcctattatgtgtaccctgagcaatagcgagtaagctctgctaatgcagttctgaaaatgtttttctttaagcaaactccagagccaggaatattaattgtaggagtttctaaaacttaacatgcagaccaggaattaaggcaggtgtgacacagagagggggcagcactgggtgtgtccctactactcacactcaagtgccgcctcagggagtgctggtctgagggggggggggggtcatagccaagatccctgtaggagccag

SEQ ID NO: 29041 - DNA, 601 bp, Human
gaagggccaagctctctggacccctcccaggagggacccacagggctgaaggaagctgccttgtacccacatctcccgccaggcaagtgaaccaagaggttttgtacatattcctacctttccctttagagcatcctgccctcctctgatttcagcgacacaaacagaaggatgagatgttctccactgcagggctgtctgtaggtgtgggaggttaggagttggttttgtcctattatgtgtaccctgagcaatagcgagtaagctctgctaatgcagttctgaaaatgtttttctttargcaaactccagagccaggaatattaattgtaggagtttctaaaacttaacatgcagaccaggaattaaggcaggtgtgacacagagagggggcagcactgggtgtgtccctactactcacactcaagtgccgcctcagggagtgctggtctgagggggggggggggtcatagccaagatccctgtaggagccaggcagaagccaccgttgaagtggatggtgtggcaggcagcagtgggggggtggggggtggggacagctgacagaaactcctcattgtcacatggcagccgtgtgtaa

SEQ ID NO: 29042 - DNA, 601 bp, Human
ccaggagggacccacagggctgaaggaagctgccttgtacccacatctcccgccaggcaagtgaaccaagaggttttgtacatattcctacctttccctttagagcatcctgccctcctctgatttcagcgacacaaacagaaggatgagatgttctccactgcagggctgtctgtaggtgtgggaggttaggagttggttttgtcctattatgtgtaccctgagcaatagcgagtaagctctgctaatgcagttctgaaaatgtttttctttaagcaaactccagagccaggaatattarttgtaggagtttctaaaacttaacatgcagaccaggaattaaggcaggtgtgacacagagagggggcagcactgggtgtgtccctactactcacactcaagtgccgcctcagggagtgctggtctgagggggggggggggtcatagccaagatccctgtaggagccaggcagaagccaccgttgaagtggatggtgtggcaggcagcagtgggggggtggggggtggggacagctgacagaaactcctcattgtcacatggcagccgtgtgtaaaccaaggtccgtgtgcacaacctgct

SEQ ID NO: 29043 - DNA, 601 bp, Human
atgtctacttctttccacacagacacggcaaccatccgatttctcaatcttttccccacctttccccgctttctattccacaaagccgccattgtcatcatggcccgttctcaatgagctgttgggtacacctcccagacggggtggtggccgggcagaggggctcctcacttcccagtaggggcggccgggcagaggcgcccctcacatcccggacggggtggctgccgggcggagggtctcctcacttctcagacggggcggccgggcagagacgctcctcacctcccggatggggtcrcggccaggcagaggtgctcctcacatcccagacagggcggcggggcagaggcgctccccacatctcagacgatgggtggccgggcagagacgctcctcactttccagactgggcagccaggcagaggggctcctcacattccagacgatgggcggccaggcagagacgctcctcacttcccagacggggtggcggccgggcagaggctgcaatctcggcactttgggaggctaaggcaggcagctgggaggtggaggttgtagcgagccgagatcacgccactgcactccagcctgggca

SEQ ID NO: 29044 - DNA, 601 bp, Human
cacacagacacggcaaccatccgatttctcaatcttttccccacctttccccgctttctattccacaaagccgccattgtcatcatggcccgttctcaatgagctgttgggtacacctcccagacggggtggtggccgggcagaggggctcctcacttcccagtaggggcggccgggcagaggcgcccctcacatcccggacggggtggctgccgggcggagggtctcctcacttctcagacggggcggccgggcagagacgctcctcacctcccggatggggtcgcggccaggcagaggygctcctcacatcccagacagggcggcggggcagaggcgctccccacatctcagacgatgggtggccgggcagagacgctcctcactttccagactgggcagccaggcagaggggctcctcacattccagacgatgggcggccaggcagagacgctcctcacttcccagacggggtggcggccgggcagaggctgcaatctcggcactttgggaggctaaggcaggcagctgggaggtggaggttgtagcgagccgagatcacgccactgcactccagcctgggcaccattgagcactgag

SEQ ID NO: 29045 - DNA, 601 bp, Human
ggggtggtggccgggcagaggggctcctcacttcccagtaggggcggccgggcagaggcgcccctcacatcccggacggggtggctgccgggcggagggtctcctcacttctcagacggggcggccgggcagagacgctcctcacctcccggatggggtcgcggccaggcagaggtgctcctcacatcccagacagggcggcggggcagaggcgctccccacatctcagacgatgggtggccgggcagagacgctcctcactttccagactgggcagccaggcagaggggctcctcacatyccagacgatgggcggccaggcagagacgctcctcacttcccagacggggtggcggccgggcagaggctgcaatctcggcactttgggaggctaaggcaggcagctgggaggtggaggttgtagcgagccgagatcacgccactgcactccagcctgggcaccattgagcactgagtgaaccagactccgtctgcaatcccggcacctcgggaggccgaggctggcggatcactcgtggttaggagctggagaccagcccggccaacacagcgaaaccccgtctccaccaaaaaaacacga

SEQ ID NO: 29046 - DNA, 601 bp, Human
gtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacrggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttct

SEQ ID NO: 29047 - DNA, 601 bp, Human
atctagcttaaccctcttactgtataaaataggcacaagattgaaaatagtctcaaagtccactagctgttaagtggcagtggagtgctgctggagtgactggtacagaagccttgagggctgtagatgataataagattattgctgaagaagggcaagatccggaatgaccttgcccttgaaaaatgagagttgaagtacaaactaagaacagacttcttttctctctctaaatgtaatgtttttatttttcacttgtatttctagaaggcctttgagccctacttagagattttggaaktatactccacaaaagccaagaattatgtaaatggacattgcaccaagtatgagccctggcagctaattgcatggagtgtcgtgtggaccctgctgatagtctggggatatgagtttgtcttccagccagagagtaagtatgctgtctcctctgtaaaggtatagtggtgtgtcactagcctcaaactaattgctgagagataggactaatttattgccttttggttgtttttttgtttgtttgtttgtttttgagacggagtctccatctgttgctaggctggagtgcactggcctgatc

SEQ ID NO: 29048 - DNA, 601 bp, Human
aaaatgaatgaggatgcactgatctttaagataatactcctaagtggaaaaacaaggtctactacagtgctagagtgtgctactttttgtgcaaaaaaagggagacaaataagaatatagctttactgttgcacgtgtatgcataaggaaactcaggggggtagcatgagggttggggggatacgtttgagagagggaagcttcactgctttactgtgtgtgttatgtgtttgtatttttaaaattttgaaccatgtaaatatagtacttattcacaaacttaaatttaaaagtttttttwaaattttttaaacgaaagaaactctttgcaattggaaggcaagtgaggtggaagacacattgaatggttgctatatgccaggtcatatccatggaaatttatttgaataagagaaccatttgtttcttttaggtttatggtcaaggtttaaaaagaaatgttttaagctcaccaggaagatgcccattattggtcgtaaggtaagtagaatctgtgtatgtcattttttcccctcttgataatcatacctctttctttctatttactaaacctaatattctcaaagtggaggggtgattt

SEQ ID NO: 29049 - DNA, 601 bp, Human
cttaaggagtacagctctatgggtatgatgcttggcatatacatgctctctacttccttaaagagacaggttttgtcattgtttaatgttcacataggttaagaataactcatcattggttaatacatgtttaggagggcctactctctgtttcacaggttgaatttcctatttttaaaattatgtttagattcatccttcatccataaagcaagcaaatctcagagacagtggaacttggcttttatttccttttgtaagcatgaataaaacaaatatatttgtgtttaagaagagagartataagatatgtaatacaaatgaaatacagatccatgtaaaaatgtgaaatctgcataaaggcacaaaagaaaataagtcactataattccactatcaaagataaacagatggtgtctatctttatgcatgtagctataggtagagctgtctatatagtttacatctatctatatatgtatatctgtctgtttctgagaatgctaatagtgtttgtctgtgtgtatacacatgtatgcatgagcacatatgggatggataaatagaccaaatagcttggtgcttaagagcgtaaccctgg

SEQ ID NO: 29050 - DNA, 601 bp, Human
ttttttgagacagagtctcactgtgttgcccaggctggaatgcagtggtgtgatctcagctcactgcaacttccaccttccaggcttaagcaattctcgtgcctcagcctcccaagtagctgagattacaggcgtgcggcaccatacccagctaattttttgtgtttttagtagagataagatttcaccatgttgcccaggttggtctcgaactcctgaactcaggtgatctgcccaccttggcctcccaaagtgctaggattacaggtgtgagccactgtgctcggccttgacaaatacycttacaatttctaagtgacatgtgttgaggtcttgacattgaatagtacaaaatttgatatagtctaggatgtagatgaataaagcagtggttagcactctaaaacctggtgttaaagatttccatgattatgagacctggttgccgccatcatattgccttctctttaatgtttaagtcactgtccattgctgtattctctagcatcagtaaaagaacaggaaatgaaaccagttatcttatttttgaaaggctggtgaccactggtctgaagctgtgtatagtacagagcagtgtcct

SEQ ID NO: 29051 - DNA, 601 bp, Human
tttgaacctacattgagttgctaggatggcttaaagaacaccttagattcactaaatgtaaatatgttgccatatctgctctctacactctttccctccctacccgcttcttccctcatcccccacctgcatacctaccattcccctatttatctgtgtatacttttgttgttccatccagcagtgtttttagtgtacttctggttttacctgagccaaagtttaatttattattttgctgtaaactgaacctcatttagttgctattaggcataaagaaagggggaggacatcattatayttaaagaaacacatgaggattctttgttttacctgttctttcaagtagatggttgttagttttcgtaaactatgatagataaacttctgtttagatctgttgtctttagaaaaaacgaaatctcaggttatgtaggatagatagatttaactcaatatgctgcaatggtgtcctagaggtgctaatcctatcagatactcatcatatttgcagtcattataaagactgcagatttaattattgaagggcccattcgaagagcacctaatttagtttctttttttttttccaggaagcatt

SEQ ID NO: 29052 - DNA, 601 bp, Human
gcggcttcattcttgaagtcagtgagaccaagaacccaccaattccggacacagtagaagcccattgggcttttaaattttatttactctaatttcattctaaagaattctgttttgtagttctccttttattttattattattttttgagacagggtgtcactctgttgctcaggccagagtgtagtggtgccatctcagctcactgcagccttgacctctctgggctcaagcgaccctcccacctcagcccccttgagtagctgggactacaggcatgcaccaccatgcctcgctaatwtttgtatttttagtagagatggggtttcaccatgttgcccaggctggtcttgaactcccaagctgaagtgatctgcctgccttggcttctcaaagtgctgggattacaggcgtaagccaccacgcttggccgtcttttttttttttttttttttttaatctgcttggttgttttttatagtccttttccttggcttaacttttgtttacttaaatatattacacataaatatgttgtattctgtgtctgataattccaatatccatgagccttacctgattctgctggcttcagtcatgg

SEQ ID NO: 29053 - DNA, 601 bp, Human
cccccttgagtagctgggactacaggcatgcaccaccatgcctcgctaatttttgtatttttagtagagatggggtttcaccatgttgcccaggctggtcttgaactcccaagctgaagtgatctgcctgccttggcttctcaaagtgctgggattacaggcgtaagccaccacgcttggccgtcttttttttttttttttttttttaatctgcttggttgttttttatagtccttttccttggcttaacttttgtttacttaaatatattacacataaatatgttgtattctgtgtctgwtaattccaatatccatgagccttacctgattctgctggcttcagtcatggttccttgtttccttatatttgtgattttattttatttatttatttttttatgagccactcatttttctgggaacctagggattctttgaggcctagattgaagttaagtctggaagttctcttcttccagagaagatttgtcatacctttttgagttgctggggattgccaccacactggaaccaaattaagtcaaatccttagcttgtcattttgtaccacagaggtagtgtgaattctgaccacaaac

SEQ ID NO: 29054 - DNA, 601 bp, Human
ttttttttttttttaatctgcttggttgttttttatagtccttttccttggcttaacttttgtttacttaaatatattacacataaatatgttgtattctgtgtctgataattccaatatccatgagccttacctgattctgctggcttcagtcatggttccttgtttccttatatttgtgattttattttatttatttatttttttatgagccactcatttttctgggaacctagggattctttgaggcctagattgaagttaagtctggaagttctcttcttccagagaagatttgtcrtacctttttgagttgctggggattgccaccacactggaaccaaattaagtcaaatccttagcttgtcattttgtaccacagaggtagtgtgaattctgaccacaaactcacataaaggcttccttgttacacattcttgaaagattgctatttttctttacttgaacatcagggttgagaaaaacagtttttcttttctcttttgcagtagtgggatttatttcttgtacactgtagagtgtggtctttttccagccatctcctgttggactccttatcttgggcagtctctaatgtatc

SEQ ID NO: 29055 - DNA, 601 bp, Human
tatttttctttacttgaacatcagggttgagaaaaacagtttttcttttctcttttgcagtagtgggatttatttcttgtacactgtagagtgtggtctttttccagccatctcctgttggactccttatcttgggcagtctctaatgtatcttctggtccatcctttgctcatctgtcagtgtaggagtttgaagtctgaagggtctggtgccacctcagggtgaaagctagttttgccactcacttatcttgcaggattcttgattttgctttgtttgggggtttagcaagtttctttmtgttaggttagtgataggtttaaattttttttttttgatgttttatcaagttttttagttatttcagttaggaaggttgctcaaggtatataatattgctagaaatagaagttccataattgttttttccatgttacagaccttcgtctatttgaaagcccctttctccctgaatcttctctgccccacatttttctgggttactccgcttttcatatgatttcacagacttccaaccatcgcagtcattctctgtatgacttttggttgcctctggccagattgaacacagttctccac

SEQ ID NO: 29056 - DNA, 601 bp, Human
gcagtctctaatgtatcttctggtccatcctttgctcatctgtcagtgtaggagtttgaagtctgaagggtctggtgccacctcagggtgaaagctagttttgccactcacttatcttgcaggattcttgattttgctttgtttgggggtttagcaagtttctttatgttaggttagtgataggtttaaattttttttttttgatgttttatcaagttttttagttatttcagttaggaaggttgctcaaggtatataatattgctagaaatagaagttccataattgttttttccatgtkacagaccttcgtctatttgaaagcccctttctccctgaatcttctctgccccacatttttctgggttactccgcttttcatatgatttcacagacttccaaccatcgcagtcattctctgtatgacttttggttgcctctggccagattgaacacagttctccacatttggagtggcattgatctttcaatctctgtcttttttaaatctgggttcaataaacttatttcagaccttttccttgaagtcagcatttttattcttggcaatgtttattttattccttgctgttcctaatgt

SEQ ID NO: 29057 - DNA, 601 bp, Human
tttggttgcctctggccagattgaacacagttctccacatttggagtggcattgatctttcaatctctgtcttttttaaatctgggttcaataaacttatttcagaccttttccttgaagtcagcatttttattcttggcaatgtttattttattccttgctgttcctaatgtctttgttagttctgtatggatgctactggctttgtttttttaggtctgtagctcattctttttgtttcatggtctaggttttgaactctttgttttcttaaattcatgttcttatgatattttcctawagtgagaaagttataaggggtttccttcatcccttagcttgtttccttctgtgttgggtttttattttgcatgctacatactaccttttcccctgccttttagtttgtttgcatagtttccttgccattttctctcatcttggggtggcattctccagacattgttcttatgcactgtgggtgcttcctgtctgagaccatttggctggggacaaagctcagccaaagctttgttctatctgtattagaataaccaggtctattctgagattctcttcaaagttacctatcagagttcac

SEQ ID NO: 29058 - DNA, 601 bp, Human
tagttactgaggcctccattttcttacttcacagttaaaattcctgtttctctttgggtataggaggtagaaagaagtgggagagtaatagcattttaaaacacagaatcaaaaatacatattaaaagtagaacttaggcccaggcacagtgactcacgcctgtagtcccagcaccatgggaggctgaggcaagtggatcgctcgagcccaggaattcgagaccagcctgggcaactaggtgaaaccctgtctctacaaaaaatacaaaagttagccaggcatggtggggtgtgcctgtartcccagctactttgggggatgaggtgggaggatctcttaggcctgggaggtggagattgcagtgagccgagatcacgccatggcactccagtctaggtgaaagattgagaccccatctcaaaaaaaaacaaaaaagaaaaaagtagaatttaggtattcctacttttacagtcaaaagtccactggtgtttgcataacaatgatgttttgactagttattggactaaaagtaggacacatgaagcaggtgactaggaatttggaaatattattgcttaggtcattactggaccttacgaa

SEQ ID NO: 29059 - DNA, 601 bp, Human
actaaaagtaggacacatgaagcaggtgactaggaatttggaaatattattgcttaggtcattactggaccttacgaagagattgttgcactggtgacttggactttgctggtccctccccgactcttcacagctggcttgacgactcttgtgacattctgaggttttatgctaaaccacaggacatgctgctgatttgcagagctgacctcagctgtaagcactttgtcttctgcagcgtagaaatgtagtgacctacaagtgtcccatgcccaagttgggtgcattattttgtggtgayggtcacatgtttcataaagacttcctgagtcaaaaaatgacttttctcagttcatcttccatataactcctggccacagggattttgtatccaatggtatttttgttctatgtgtggatattattttagcaaagttcagtggtcactttctctgattccatcttgtattaagctacactaaatatgaaaacgtagaaagttttacttcttatcaacagatgctaatgtatgacattgagtgaaacactttaattcctcaagggctcagttttctcacctgtaaattgaaaaaacctttca

SEQ ID NO: 29060 - DNA, 601 bp, Human
gagtagttgaggaaagtctaaagcaaatacccgtgacctcattttctctttcaacactatttgaaatactatttccaaatgtgtaggagaaatggggattttagtttcttcaggtttgttgtctttcagagttggaaggggccactgagctgatgcttggccgctgtgtgaacatttctgcttgaacatgtgttgtgccgggaagccttcttctcattctcactgaggtgcctgtctttggtaggcaaccgttagccagctctgccttgtgttgctctcatccaaagtctctgtcccccarctttccgcctgccagcctagctttatgctttggatccctcactgtgggatcacttctgagtcctcttcctattgccagaatgatttcctaaataggagggaagtttctgcagaaaatcagttggcctctttttgggtgtgcttaaaaagaaaagtagagcagtctaaacacttaaatttttaatttggggaaaaataatcagaacttactcccggtaatttagattagctgctaatggtgttttctattattttggcctgagttacattattctcctcttccctgtcatttagtgtggct

SEQ ID NO: 29061 - DNA, 601 bp, Human
tttcctgcttgataccgcagagcgtttgaggtcatgcatatttaaatataaaattgataccatatttcagatgaattattttgaagggaaaatacatttgaaagataaattttgttgggaatgttaaaaatagccattttttaaaaacatgggaggcataatacaaaatagccttgtgtttatagcccatctttccacccatgtcttgcagtttttattatagggctataaaggaaattctcttatgttctttgttttttggaacaagctggctgtcaaatacaaaataccccttcatgtygacgcttgtctgggaggcttcctcatcgtctttatggagaaagcaggatacccactggagcacccatttgatttccgggtgaaaggtgtaaccagcatttcagctgacacccataaggtgagctaaggaggagatcaagtgttaccagttgattattttgactattattgataaaataaattggtagcttccccgcaaagtataaaattaactatagaattctcatcagatgcttgttttaaactctctctttgccgtcaccagatcagctggttcaggtgatggggtatagtggtagag

SEQ ID NO: 29062 - DNA, 601 bp, Human
agaacgaaactccatctcaaaaataaaaaataaataaaaataaaaattagccacatgtggtggtgtgcacctttggtcccagctacacaggaggcttaaggcaagaggactgcttgaacagcccaggaatttgaggttacagtgagctatgatcacaccactgcactctagcctgggtgacagagcaagaccctgtctcaaataaataagcaaacaaataaataaaaattagatatatataaaaggtcctcctatagctctgatagggccatttattaagacctgctataccatttcttgstttagggattacatatgactttttagaactgtggagatgggcagattacttttccagaaatttttttagtacatctttcatgcctcagaagcatctaggggaatataattgggagttgggtagacaggttcgaagtcagtgattgagtcattagatctagatggggtttgggccttggaattccatttttattgttccatctatgattctgatctcagtaagaaccactgatccagtgtagccctcttcttttttgaagatgagaagactaaagcccaaagggttagattgcattcatta

SEQ ID NO: 29063 - DNA, 601 bp, Human
cttaaggcaagaggactgcttgaacagcccaggaatttgaggttacagtgagctatgatcacaccactgcactctagcctgggtgacagagcaagaccctgtctcaaataaataagcaaacaaataaataaaaattagatatatataaaaggtcctcctatagctctgatagggccatttattaagacctgctataccatttcttgctttagggattacatatgactttttagaactgtggagatgggcagattacttttccagaaatttttttagtacatctttcatgcctcagaagcayctaggggaatataattgggagttgggtagacaggttcgaagtcagtgattgagtcattagatctagatggggtttgggccttggaattccatttttattgttccatctatgattctgatctcagtaagaaccactgatccagtgtagccctcttcttttttgaagatgagaagactaaagcccaaagggttagattgcattcattataaggaagactttgaatgattaaagagatagtgaccaggggattgtatgtgactgaatttactttttcttccttcatttatttttttgttttaa

SEQ ID NO: 29064 - DNA, 601 bp, Human
ccttctttgcgtagcacgcgtcggggttctaagtggattaggcaccaagaacacaaaactgggttctggtctctaatcgttattaccaacatggggaaacgtgtctcttcacatttcagcccggaagaacacctctttcctcttcctcatgcgcttaagggtagcggcctactcagtcagcggccaattaccgtgagctttcgggattccgccgcgcggtccacacttacctgccgggctctctgcagtgcatctttgaaagcgtcgttaactcctccaccaccaccgccgccaccaccgscaccagctgagccagaagaggggggaggcactgttgaatagtctgccatggttgcactataagagccgctgccgcctgttcagagacttcctctcagctaacagctaagaaagaaagaaaatggcggccgggccgtcgaagctctattacattcttgcgcgaccatcgtgccgtaaaggggcggagactgaaggaacaaaatctcgcgatgtttccgaggcaacgcgctggtgtgggttagggctgagaaagaacgacaggaacagagacgtcgcgaggattaagtttaagacttcgcga

SEQ ID NO: 29065 - DNA, 601 bp, Human
attatagcatattggtttaattttttttaaatttgcccttcttgtccagtaatacagtgtattgttgtaattgttctattttatttttttaattaaattaaaattttgagacagggtcaggctgttgcccaaggatgtagtgcagtggcacgatcatggctcacttatgcaactacataaaggacccaacattgtcaacattctagacttgacctcccaagttcaagcaatcctcccacctcagccttctggatagctggtactacaggcaagcaccaccacgtctggctaattttttggtttttttttttttttttttgagatggagtctcgctctgttgcccaggctggcatgcagtggcgcgatctcggttcactgcaagctccacctcccgggttcacgccattctcctgcctcagtctcctgagtagctgggactacaggcgcccactactcccggctaattttttgtatttttagtagagacggggtttcaccgtgttagccaggacggtctcaatctcctgacctcgtgatccacccgcctcagcctcccaaagtgctgagattacaggcgtgagccaccgcgcccagcctatt

SEQ ID NO: 29066 - DNA, 601 bp, Human
ccggccacaattaatgggacagattgtaaaataggagaaaaaggtatatatttacaaagaaattcaggctagctgatccaaaatactcataaaccaactaacttcaaagatacccaataatatgaacaaaatcttaacattgaaattgttactttagcttttgacccagtttaaaaggaatacttacagtcattttgaggagcaactttcttagcatctggttgatctgcaaaattaagtgtcttttaattttttgccaattaagtacaaagcttctcccctcccaaacaagaataaatamcaatataaacatttattgaaatatctgaaggtatggtttatcatttgaaccaaaactgccaaaattcaaccccaactcagtaatctaaaaaagaaacgatacttcattctcttcacgttcaaaagatgcacagacattaaaatagttatctgattcttaagaaatcactgaccttaatgtatgttaagcacattagaatgacacaagacaacgtactttaggtccattactagcaaaatatcacatgctaaaggctaatgatgcttccacctcaggaactgaagactggggggagaaaag

SEQ ID NO: 29067 - DNA, 601 bp, Human
agatctgttcacctcctctgccaattactagttagaaaaaaaaaaattttttttttggttgaaagattctaaagtatgttttgatcatgttttcaaaactttaaaaatcaagttacttactgaatccaaccattccatctggaactttgtattcttctgtcattacagatctgctaagaaataacagaaagcaccattttccttcaatgaaagatactttgtttacaaataaaagataatctattaataaaaatggaagtctaatgtctcccaatggcttaaactaaggttctaggctcasactcatgtcaaaaaatatgatcttattacttgagtagttaaattaagaaatttaagatgacacatcaagtgaagaagggatgatgaatggaacagtctgaaggcattaactgtaaagaagttgaagtggagtttagagaatgtcatcttaacagttactctaattcacccctgttcttctaaaatgtggttaattccacctatctctccaaatcacaaatttttctcactcaaaagaaaaatcatcactttatggtaccttcccaaggggagtgatatgaactaggtacaccaaaaaata

SEQ ID NO: 29068 - DNA, 601 bp, Human
taaggtagtagttcttcctgctccaagatctttaccttaaagcaatttaaactttctccattaataaagcatcatcaagcagactctgatatagaggtaacttcagatttcatgaaggaaaatacttttccataaaaacaaaaaatgaaaatgttaactttctatcaaacctgaacacttcgaagaaggtctgtaataatttctgcagcatgttgacatcggtctggaggtcctgttatttgtgctatcctttcgggtgttgtcccatcatcttcaaaacaaagaaacaaaattaattaamcaataaatgtatgtcaaaactcactgctgccaacacttacaagattattatatgtactcacctggcttaaactgaatgcgaacaccagcatcattttgtatttttttgatcatctctccatttcttcctattacaatgccaacagcaaatcttggaatggggaccttatgtaaaaaagactaagtattaagaaagctagcttctcagggtttaaagtaaaaaaaagtattttaaaaaagcgccatttcctgaaaatctgcctcaaatcataaaagtacatataattctatatttatagta

SEQ ID NO: 29069 - DNA, 601 bp, Human
ttatgttttacttgttacatattaacataagaattcttttctactaaaatacggtcagagaaaaagcattgccacttgtttacgacagcaacagaaagtgtccagaaaaatgaataatgtgttaaaacattaagagtttaaaatacattgccttttcctattattaatccagttttcccagttggcacaataaaattaaattcctgtagtccaccaggtggtcccatgttccagttgccttgacctctacctcttcctcgaccaccaggtccaggtccaccaggattaccagcctatagasagggaaagacaagaacgaagagtcagcacagaaatacttttgtttcatgataaaattattaagtttatttttcccagctctcatatacctgaatcagaaatgtagagatgaactggccctaataagtaataacattttttaaaatacaagagtaaataaggtagcacttaaggtagtagttcttcctgctccaagatctttaccttaaagcaatttaaactttctccattaataaagcatcatcaagcagactctgatatagaggtaacttcagatttcatgaaggaaaatacttttcca

SEQ ID NO: 29070 - DNA, 601 bp, Human
aattttaggaagcatttcatgcttctcttaaaatacatttacatttacttagtatgtttaaacataaacttaatgtgattataataaaatatttgaattaactgcttttaaaagcagtgtaaatataaactaatacacttataaacattcaaatttttaaaatatgagtcgggaaaaaccaaaatgcacaaacaaaaacactcaaaccactttttgggtcaaaagacatttcttatgctaataattatctcttagttcgctttctctagaagctagtaagattaaaatcctgctctttctmtaaatatacatgagatccctcatttatgttttacttgttacatattaacataagaattcttttctactaaaatacggtcagagaaaaagcattgccacttgtttacgacagcaacagaaagtgtccagaaaaatgaataatgtgttaaaacattaagagtttaaaatacattgccttttcctattattaatccagttttcccagttggcacaataaaattaaattcctgtagtccaccaggtggtcccatgttccagttgccttgacctctacctcttcctcgaccaccaggtccaggtc

SEQ ID NO: 29071 - DNA, 601 bp, Human
ccctcactcatctcccacatcaactgaagtgcgaacagtttgagacctttcaatcttctagaaaccagaaaaaacttgattgtcttttatactaggaataccatacaattaaaacttttaaattttctattataccttcattctgaacagtagcaattctcagctgcttaataaaggttagtcaagtttgagaaaaatgagcaagaatttctagaaaaagaaaattgcaaggtaatataattgtaaggtgttattaggacacctgccaaacttttctcaattgcccaatgtactgcttttktatgttggatgtttacatatctcaatagtgtcattatctgtattttttttttttttttgagatgaagtgtctcactctgttgcccaggctggagggcagtggagcaattctcaaggagttctcctgtctcagcctcctaagtagctgggattacagacacctgccaccacatccagctaatttttgtatttttagtagagacagggtttcgccatgtttgccaggctggtctccaactcctgacctcaagtgatccgcccgcctcagccttccgaagtgctagcgtcacaggttttagcc

SEQ ID NO: 29072 - DNA, 601 bp, Human
ctagaagcaattacacctcagtagcaacaagcatactcaagtctcgtttctaactaccatactctactaaaaggaataagagctccttgaagaaatagctgactcgagggctggagcccagaaagcacaaaataacaatcttactgtgccagacagtatggaagtgcttaaaagaatgacaggtatttcaaaaggatataggcaccaccctgaatatactccctgactggccaaatccaggataatctgattatcaaaattataaaaatactttaaaaatataacctactgcaaaaatcaraaatccataatgatataaagaacttaatatatcaatgttgacttactgatttggagggctgtatgatggttatgtatttttgaagaagtacccaacaggacatcatgtctacagtttagtcttcagtgatttctttcagaactaattatgctggatataattagcttccttcagaactaattataatggatatttaaaataaatacagatacacatgtatgatatagatggtaacagagtaaacaagggaataaaacattaacagctgggctatctgggtgctccgggtattcttcttac

SEQ ID NO: 29073 - DNA, 601 bp, Human
attattatttaacatctaattattatttaattatttctatgccatgttttcctacagaggattcaagacagtatagtatagtatctctaactggcagggaaatggtaaaaaaaaataaaaaattaaagacaaggtaaaatgtcttcccttaacaataaaaattagaattccacccacccactcattttgagtaaaacataaaaagtaaaacaaaaaagactaaacagtaaatgtattaatggccatattacaaataatcaatatggtaaaataaagcacagaagccaaactcattcctccrtaattacctaaatccattaacaagcctttatttttacctacttaataataactagggaccctatctaggggacattacccattgagaaaatagaagttgaagttagtgatttttaacccaaacacgtgaccaggtctcactatgatgccaaggctggcctcaatctcctgtgttcaaggaatccttccaccttagcctcccaagcagctgggactacaagtgtgtgccaccgcacgtggctcatgctcaagtcttttaaaatggtgatgctatttaattaaagttaagttgattacaggt

SEQ ID NO: 29074 - DNA, 601 bp, Human
acctgaggtcaggagttcgagaccagcctggccaacatggtgaaactctgtctctactaaaaatacaaaaattagctgggtgtggttgggcgcctgtaatcccagctacttgggaagttgaggcaggagaatagcttgaacccaggaagcagaggttgcactgagacgaaatcgcaccattgcttggggagtaagaccaagactccgtcttaaaaaaaacaacaacaacgagatatgcatgtgaaggacttgcccaactaatctgttttgctcataaaattaacaggtgaggctgggtgcrgtggctcacacccataatcccaacactttggaaggctgaggcaggtggatcacctgaggtcaggagtttgagaccagcttggccaacatgatgaaagcccgtatctactaaatatacaaaaaatcagccggatgtggtagcaggcgcctgtaatcccagctacttgggagtatgaggccggagaatcgcttgaacctgggaggcggaggttgcagtgagctgagattgcgccaccgcactccagcctgggcgagagtgagactccctctcaaataaataaataaataaaattaacaagtg

SEQ ID NO: 29075 - DNA, 601 bp, Human
gacaaatgctcatcaagcacctgactaaattacctagcattatttcctttaagatatacacatgtggccaggcgcagtggctcacacctgtaatcccaacactttgcgaggctgaggcgggtggatcacctgaggtcaggagttcgagaccagcctggccaacatggtgaaactctgtctctactaaaaatacaaaaattagctgggtgtggttgggcgcctgtaatcccagctacttgggaagttgaggcaggagaatagcttgaacccaggaagcagaggttgcactgagacgaaatcrcaccattgcttggggagtaagaccaagactccgtcttaaaaaaaacaacaacaacgagatatgcatgtgaaggacttgcccaactaatctgttttgctcataaaattaacaggtgaggctgggtgcagtggctcacacccataatcccaacactttggaaggctgaggcaggtggatcacctgaggtcaggagtttgagaccagcttggccaacatgatgaaagcccgtatctactaaatatacaaaaaatcagccggatgtggtagcaggcgcctgtaatcccagctacttgggagtat

SEQ ID NO: 29076 - DNA, 601 bp, Human
cactaggatggggaatcaggaaatctgaagtcctagcatcatacccctgccactggaaaagtcaacaacagttggctttgagataaagatatctccctattattccctttctccttccatttaagaaatgtgaagactgaaccaagttttatgctttaaggtttcttatttgtggtaaaaagatcctgatgacaggtaaggtacctagaagaaattaaagcagttaagcaactaatcatttacaaaaagaacttttatagaaaaagacaaattgactccgtatgatgatgacaaatgctcrtcaagcacctgactaaattacctagcattatttcctttaagatatacacatgtggccaggcgcagtggctcacacctgtaatcccaacactttgcgaggctgaggcgggtggatcacctgaggtcaggagttcgagaccagcctggccaacatggtgaaactctgtctctactaaaaatacaaaaattagctgggtgtggttgggcgcctgtaatcccagctacttgggaagttgaggcaggagaatagcttgaacccaggaagcagaggttgcactgagacgaaatcgcaccattgctt

SEQ ID NO: 29077 - DNA, 601 bp, Human
ggttcagagtctaccacatcagtccttatcataatggccttcctcaagtcaaacttttcccaaatgtcttcacttctccaaacaagaattactcctttctattttgaaaccctgtttgttctcttaagggtcttaaaaaaatccctgtattctagctttaaaaacacccatctttactgctgttccttataagcctctgaaatcttatcaagattttctctacttgggaggctgaggcagaagaattgcttcaacctgggaggtggatgctgcaagtgagccgagatcatgccactgcacytcagcctgggcgacagggaaaggctccatctcaaaaaaataaaataaaaaaaaataaaataaaaatttatcctcttagtttggtgttatccttgggaacttagaattgttttgaaatataaacctaattttgggaaacttaacccacacctgttttcaatagttttttttttttttcagtaaataagcaaataatgacaaattaaaatctatgaatggagttttctgttcttaacaagaaaaacttaaattaggctccaaaagctgtgaaagcctgcctagtttggcaaaaggggcacta

SEQ ID NO: 29078 - DNA, 601 bp, Human
tcagcctctagagtagctgggactacaggcccaccatgcctagctgacatttttctctttttttgtagagatggggttttgccatgttgtccaggctggtcctgaactcctggactcaagtgatccacctgccttggcctcccaaagtcctgggattacaggcgtcaaccactgtgcccagacattgagtttatttagagcaaactgtcttgtctgcaacttactttgaaatggttcatacacaaaaaacatacatataaagcgcatacagcaaacttttaaaaaatgatgaagctgagtrtctgatgccttatttccccaatttctgaaggtatataattttctaaataaaaaattgagaagagagagtatatgttctcctattcagtttctttacttaagcactattttatttcgtttgtaactcgcttggctttgtgaaataactaccatagacaaaaatactggagcatggacacacaggaagctctttttatgtttgtaggatgctgccaacaagaccaatttcatagtttcagaaagcagtctatcaccattgtaaaacaggtcacagactcaaagcaactgagtgaaagaattt

SEQ ID NO: 29079 - DNA, 601 bp, Human
cttccccgtgtgtgtggattttgcctgtaggaacacaggactcaccgctgtagatacttgcagaagcactgaagctcctggagggtctcctttgcagtctggaagatttcctccacgagaaacaagtccactaagtgggcacagacatcctcacagcaacgggccacacggaccctctggtctgtctctactgcattcctagaaacagggcaatcagcatggaagacactgcacttggggcccacagacactgagggcttgcttgaaaagtgcaagagtcagtcaggcgcggtggctcacrcctgtaatcccagcactttggaaggccgaagcgggtggatcatgaggtcaagagatccagaccatcctggctaacatggtgaaaccctgtctctactaaaaatacaaaaaaattagcctggtgtggtggcgggcgcctgtagtcccagctactcgggaggctgaagcaggagaatgacgtgaagccgggaggcagagcttgcagtgagcagagatcgcgccactgcactccagcctggacgacagagcgagactccgtctcaaaaaaaaaaaaaaaagaaaagtgcaagagtcggccagg

SEQ ID NO: 29080 - DNA, 601 bp, Human
tacttatattttgagaattcacccttattggtgcatgcagccataatctggcttgttcatagctgtctcccagcacctagtgcagtgggcaaatggcaggcaccctataaatatcagttgacatacagagtagccaccacgtcccaatctaactcctgacttttccccttatattgtatgtgtgtgtgtgtgtgtgtgtaatcaagtatttctgaaatgcagtataatccaattagtctattttaggtattcattgctataacattttccctcatccttttaccactgaatacagaaactratagctcatatattttgaatttgttaaaagactcttccccgtgtgtgtggattttgcctgtaggaacacaggactcaccgctgtagatacttgcagaagcactgaagctcctggagggtctcctttgcagtctggaagatttcctccacgagaaacaagtccactaagtgggcacagacatcctcacagcaacgggccacacggaccctctggtctgtctctactgcattcctagaaacagggcaatcagcatggaagacactgcacttggggcccacagacactgagggcttgcttgaa

SEQ ID NO: 29081 - DNA, 601 bp, Human
accactggcaacggggacagctcagcatgctgctacagccaagcctccacctcatatcagatggagcaaaggaaggctcagagcaaagcagggatcatgagcccatctgtgccaagagccacaagaaaggacagaaagtctctggatggtttcgcaagcagctgctgctcgcacaatggacaggggtctgttgtagaaggaagactcacttctccccatactcccttttatactgttccaactaccaaggacactattactgattttaaattttattatgaaatgaatcatacaacatacrtaacacatatatgcccagttataagattaataaatcatcaagcacctgtgcacttacacccagttgagaagttgtggccatgagaggcaccacctcccattcccaaaagtaaccactatgctgagattatgatcattattttccttcttttctttagggttataccactatatataaatctgaaacaacctatttagtttgaatatacactatttgtatattccctattaattgctttttctccactacttatattttgagaattcacccttattggtgcatgcagccataatctggctt

SEQ ID NO: 29082 - DNA, 601 bp, Human
agccacatgaaagtccatcaacagaagaccaggaaggtcatttatggtacattatcgcactgacctcaagaccactggcaacggggacagctcagcatgctgctacagccaagcctccacctcatatcagatggagcaaaggaaggctcagagcaaagcagggatcatgagcccatctgtgccaagagccacaagaaaggacagaaagtctctggatggtttcgcaagcagctgctgctcgcacaatggacaggggtctgttgtagaaggaagactcacttctccccatactcccttttayactgttccaactaccaaggacactattactgattttaaattttattatgaaatgaatcatacaacatacgtaacacatatatgcccagttataagattaataaatcatcaagcacctgtgcacttacacccagttgagaagttgtggccatgagaggcaccacctcccattcccaaaagtaaccactatgctgagattatgatcattattttccttcttttctttagggttataccactatatataaatctgaaacaacctatttagtttgaatatacactatttgtatattccctatta

SEQ ID NO: 29083 - DNA, 601 bp, Human
ccaggaggaggacaagacatgacatgaggccccagcggtgtgcctgctaggccctccaggctgcctccccagtccccacccactgggaggccagggagccctgaggccaggcaagaggtggcacctacatgggttctaaataaaggccaagcccagcatggccaggaatgcaggctgaggggggtcctggcatggccctgaggagccggttctgctcggggtaaccaggaggagtggcagggaggaccagggccacaccaaggggcctcaagagggaaataatggagggtggaggtggagyctggaagatgctgccacagaaagggggcagtgtgtgaaggagacggcgggaggaacagagggatggggcggggatgggatcggaagacacaggccagcgtggacctccggctcctccaacaaggatggaagtggcaggtacttaaactgggacgagcaggaaaagaacacgtgatgcagagtcagactcaggcaccaggacgctgagtctttcaaggtgaactcagagctctgctttgccagtggaacaagtcacatgtccacaactgtgggagacaaccttcaaaatgcaaccctgtgc

SEQ ID NO: 29084 - DNA, 601 bp, Human
accccactgccggcgcagaacctgatggggctaaatgaaacccacaagacagttttcagagggaacatccagtgatgaccaggaggaggacaagacatgacatgaggccccagcggtgtgcctgctaggccctccaggctgcctccccagtccccacccactgggaggccagggagccctgaggccaggcaagaggtggcacctacatgggttctaaataaaggccaagcccagcatggccaggaatgcaggctgaggggggtcctggcatggccctgaggagccggttctgctcggggtraccaggaggagtggcagggaggaccagggccacaccaaggggcctcaagagggaaataatggagggtggaggtggagtctggaagatgctgccacagaaagggggcagtgtgtgaaggagacggcgggaggaacagagggatggggcggggatgggatcggaagacacaggccagcgtggacctccggctcctccaacaaggatggaagtggcaggtacttaaactgggacgagcaggaaaagaacacgtgatgcagagtcagactcaggcaccaggacgctgagtctttcaaggtgaac

SEQ ID NO: 29085 - DNA, 601 bp, Human
tccccaatgttggaggaggggcctggtgggaagtgattgtatcatgggggtggaatccccctggctgttctcatgatagtgagctctcacgagatctggttaagtgtgtgacaactccccctcactgttctcatgatagtgagctctcacgagatctggttaagtgtgtgacaactccccttcgctgttgtcatgatagtgagctctcacgagatgtggttgtgtgacaactccccctcactgttctcatgatagtgagctctcaacaagatctggttaagtgtgtggcaactcaccctcrctgttctcatgatagtgagctctcaggagatctggttaagtgtgtggaaactcccccttgctgttctcatgaaagtgagcctcgcgagacctggttaagtgtgcagcacctcccccttgctgttctcattacagtgagctgtcacgagatctggttgtttagaagtgtgtggcacctcccactttgctgttctcatgatagtgagctctcacgagatctggttaagcatgtggcatctcccccttctctctctcttcctcctgctttggccatgtaagacatgcctccctccccttagcc

SEQ ID NO: 29086 - DNA, 601 bp, Human
aggctgaggtgagaagatcagttgagcccaggaggtcaaggctgcggtgagctgttatcacaccactgccctctagcctgggtgacaacaaagcaagaccctgtctcaaaaaaacacaaagagactgtagttgctttaaaaatatgacttctgtatgctatgtggttacagaaaataagatcatgtcaattttttcttttttaaaatgccaaaagtttctttaaggggaaaaaaatggaactatagtaaacagactataaactatcttactgaagagtctaaaatgaagcaggtctatcartgtaccttaacacagcttgaaataacaatcaactcttaaatgcttttggtctaagactgttgccaagtaatatggtttggatttgtgtccctacccaaatctcatgttgaactgtaatccccaatgttggaggaggggcctggtgggaagtgattgtatcatgggggtggaatccccctggctgttctcatgatagtgagctctcacgagatctggttaagtgtgtgacaactccccctcactgttctcatgatagtgagctctcacgagatctggttaagtgtgtgacaactccccttc

SEQ ID NO: 29087 - DNA, 601 bp, Human
tataaagactttcaggaaaagaagaaagaaaaatatcacacagacctaggtccacaaataccacatcttactatgaagctgatctgcacaaaacaggctgttgttttaaaatggagcaacgatctgtactcgttcttttttttttttttttttttttgagccagggtctcgctctgtcgcccaagctagagtgcaatggcacaaacttggctcaccgcagcaagcaaacctgcctcagtagctgagactacaggcacgggccaccatgcccagctaatctttccattttttttgtagagtstcactcaaagggtctcactatgttgctcatgctggcctcaaactcctgggctcaagcaatcctccctccacagcctccccagttgctgggattacaggcatgagccactgctcccggcttctacttgttcttaattgggcaggaggagggggcactccattccattagaatggaactggctcattctaatgtgacttaaaattctgaagcattaagattttcagcaatagaaaacatccctagagtttgaaatacatgttttttacagatcaaatttctcatacctgagaccttaagaat

SEQ ID NO: 29088 - DNA, 601 bp, Human
gtaagtgaaagtaatgaaaacacagaagtaaacacaaagtaattatagttcacctttatacacacgttaacagaaatcatctgatcccctttgctgctaagtgagttgaaaagcgaaagcgtctgaatcccaccagcatcgctggatgtgtcatccactgagccttcatctcccatgaacttgacttttaaccaatttgctagaattctacagatttaaaaaaaacaaaaaacaaaaaaaacacttgaagaatctaattctatatttgaattataaagactttcaggaaaagaagaaagaraaatatcacacagacctaggtccacaaataccacatcttactatgaagctgatctgcacaaaacaggctgttgttttaaaatggagcaacgatctgtactcgttcttttttttttttttttttttttgagccagggtctcgctctgtcgcccaagctagagtgcaatggcacaaacttggctcaccgcagcaagcaaacctgcctcagtagctgagactacaggcacgggccaccatgcccagctaatctttccattttttttgtagagtgtcactcaaagggtctcactatgttgctca

SEQ ID NO: 29089 - DNA, 601 bp, Human
ctttcttaaatgaaaatgaaggtaacagcagcagtaaactaatttccagtagatgaaatgtgactttgtaatcccaggaaaagggaagaatttgcaccaagaagttactgttacctcagaatggcaagagcatggatggctcttatcatcatctttatacttcttttacatttcctcattttttaaaagttttgtgtacatattacatttaggaaatccaatatatagtattaaaacagaaaaagtaaagaagcaggctgggcttggtgcccactactcaatttgactggcttaaaaaaaatttttaaacgacatgtacggacagacataatacttgcttctgagcctcccagtctttcaaaaccacattagggaataagcagtatttgcatggttccagtgatatctgggagtaagtgaaagtaatgaaaacacagaagtaaacacaaagtaattatagttcacctttatacacacgttaacagaaatcatctgatcccctttgctgctaagtgagttgaaaagcgaaagcgtctgaatcccaccagcatcgctggatgtgtcatccactgagccttcatctcccatgaacttgactttt

SEQ ID NO: 29090 - DNA, 601 bp, Human
agctgggcctagccactcacttctgacagacagaagccaacaaaagcaacaggatgtcacttctaagtttaggttataaacacactcagacttccatctaggctcacctcttgctcactctgatgaaagccagctgccatgctgtcagctggggagaggcccatgtggcaggaactgaggaagtctttggccacagcctgcaaggaagtgaatcctgacacaagctcactagagtgagctgggaagtagatacccttcagtcaagctttcagatgaggccacaatcctagccaacattttsatttccacccatgagaaaccttgagccagaagacccaagctaagctacacctggattcctgacccacagataccatgataacagacattattttaagctgctatgttaggagtaattagttatttaggaataaggtaactaatacatttatattaatgggaagtcagcagagaacatttaaatggataaactgagaaatggctgtgtaagtgtgtgatctggaaacaggagaaaaatgcagccctgaagaaaggagttaagagaggaaggaggagctactatgtctcattttaaatcacg

SEQ ID NO: 29091 - DNA, 601 bp, Human
cagagagaaaaggcttccacagagaaaaccaggccacacagaaaggaacaggaatggtacagcaacaatggatgctaggtgacagtggagcaaaactggaaggcaaataattttctttcttttgagacggggtcttcctctgtcaacaccggagtgcagtggtgcgatcacggctcactgcagcctcgaactcccaggttcaagcaatcttcccacctcagcttcccaagctactagaactacaggcacacaccaccatgcccagctaatttttgtattttttatagagacagggtttcamcgcgttgcccaggctggtctcgaactcctgcactcaaaacaatccgctcacttcggcctcccaaagtgctgggattacaggcataagccactatgcgcggccaggaaaataattttctacctataattttacaaacgtagctaaactatgaagcaaatgtcagaatgaaataaatgcattttctttttctttcccccagcttaaggtattttgttaataaaatcattttcataatggaaaagactcagaaaattcccctcgcatgacatataacatccaacaaggggctgaaccaagaaa

SEQ ID NO: 29092 - DNA, 601 bp, Human
atcaattgatgaggcctaacatctatctaatagaagttcaagagagaacagaaaaaagacagagtgtcataaagacatgaaaatgtcccagaagtgaaataggagtctctagcctgaaaggacctgctaagccctgcacagtgagtgaagctagtccagtgccagtgtaacaaagtgaatttttaggacgccatgaacagagagaaaaggcttccacagagaaaaccaggccacacagaaaggaacaggaatggtacagcaacaatggatgctaggtgacagtggagcaaaactggaaggmaaataattttctttcttttgagacggggtcttcctctgtcaacaccggagtgcagtggtgcgatcacggctcactgcagcctcgaactcccaggttcaagcaatcttcccacctcagcttcccaagctactagaactacaggcacacaccaccatgcccagctaatttttgtattttttatagagacagggtttcaccgcgttgcccaggctggtctcgaactcctgcactcaaaacaatccgctcacttcggcctcccaaagtgctgggattacaggcataagccactatgcgcggcca

SEQ ID NO: 29093 - DNA, 601 bp, Human
ttttttttttttgagaagggggtcttattatgttgcccaggctggtcttgaattgctgggctcgagcagtcctcctggttcagcctcctgagtagctgagattacaggttcgaggagccaccatgcctagcttcagacttcctttttaaagaaaacgtcaaataacattgtttcttcatatattcagaggacaatcaccctagaaaaataatttctatatctgcccttcagatataaggcatgttcatattttattttatttttatttatttattttttgagatggagtctcactctgtcrcccaggctggattgcagtggcacgatctcagctccctgcaatttctgcctcctggattcaagcaattctcctgcctcaccctccctagtagctgggattacaggtgcccaccaccacacccagctaatttttgtatttttaatggagacagggtttcaccatgttggccaggctggtctcgaactcctgacctcaagtgatcagcctgcctcggcctcccaaagtgctgggattacaggtgtgagccaccgcgcccacccatgttcatattttaaatttatagaaacaaaaatgagaata

SEQ ID NO: 29094 - DNA, 601 bp, Human
ctcaggaaaccagccctgaacatccccttcaccatgcacagaaatggagtcttctcctttttggaaggactaacagcttcactatgtgccaaggtgccttcacaccctatggttatcttacttcctatagttattttaattcctggcacctctttctctaaattgttagcaaagactccccctgccctattttttttgtttttgagaagggggtcttgctatgttggccaggctggtctcaaactcctgagctcaagcagtcctcctgcttcagcctccgagtagcagagactacaggtgygaggagccaccacgcccagcttcagacttcctttttaaaggaaacatcaaataacattatttcttcatatattcagaggacaattaccctagaaaaataacttctgtatctgaccttcagatataagacatgttcatattttaaattcatagaaacaaaaacactaaaaaattttacatgaacaatttaatttgcagatagcaggactgtgggcaaattttatcttttattttgatttctgcttatgtttttagaaagttatctgtataaaacatacaactgctgccaggcgcagtggca

SEQ ID NO: 29095 - DNA, 601 bp, Human
gagcaccgagggcttgtgctgagtggtttgcttccctttgggttccttcaataatgagcatgagttagacctactacagaccacacaccacaatttagaagggcgcctgaggcccaaaggggagtgtctgtgctaatgccacaacttctgccagataagcagctcattcccttctgagtgcataggaaggagcagccccatgccatactgggcttgagccagccagatggcctgtcggatctgtgtcaaaacagcccaaagacctcagccaggaacaggggcacagccagagccatagaasaaggcctctttgacaaagaaagaatgttaaatcagcactgagtgccatggctgcggcttggggacagggctacatggtccccatgctctttgccccttgtctgttctgaaaacagggaccctgtgggcaggcaggacaggatcagggttggtgttcctcccagtaccacttgtcacttttctcctgaagctgagtgaactcccatggactgccttgctggtcaggaaaggctaacagcccccactccacaaaacccagcttgttctggctcatgaacccaaaggaccaaaggaaggtgca

SEQ ID NO: 29096 - DNA, 601 bp, Human
tgattccactgttcctaacattctaccaagaagcatgttttttttctattttggtagttttatgttaggtagccttatcaagttaggactttttttttttttaacccaagctaaagaaagtacccaaaataaagaaattttatcaggaacaggtataaattttaagaaacgtatttcaacgcctgctaaaattaccacttatttttctattatggcaacaaattacattaatagattttcactgttattgtttatcctgggagaaagcatacttgtgaacttttttaggtactgtgctttsgaaccaaatttggaagtgagatgaaatgtcagctgtactctcctggttaggtatgatttcagggtcaggtatgcctgataaatgaagtgagatgctttaactttgttctagaatagtttctactgcatgggaatgatctgttccttgaggatttgtcacagtctgcccacagtggactggatttggcatgtaggatgttaatttctatttactttgcaagaaaaatacagtttagcaagcaacagaaacatactgaacatgaacctcaccgtccctctctcagctgtagctccttctgcg

SEQ ID NO: 29097 - DNA, 601 bp, Human
ccctagtattggcaaggttttttatagatagctcttggatacatttggaagtaatgtttacaaatggtgagagagaaggcatctgacatttttttctaaacacatgccaatgtttgtcttttccccactaatttcaataatttggcctaacacttttgtcacatattctgactctttattctgatccatttatctactctggcatccccacatggttttaagtactggagctttactgtatgtcttggtatcaggccaagcaaaccatgttagtcttatttaaaactttctcagcaattgrtgcatatttgtttatcctgatgaattttagaacttaccagtactgacatcttcacagcattgtatcctgtcaacaacctagtctgaacctcaatggttcaggtttcctttgcacatacaggccctgagaactcatatgttaatgagaaagacattccgggaaaccaggaggtgaggagaccaaggattaggctccactcctattatgaagatgaacagtttttagagtatcatggagttggagaaggtacttcaaggatctctatggggaacaagaaggaacagcaaagttccaccatcc

SEQ ID NO: 29098 - DNA, 601 bp, Human
taagtacatgatttgaaatgtttatggtcaagagaaaatatttctacagcatcatgtaaagcatgtagatacatttgcacatgtgcattaacatgtaagaacatgtgcctcagacacatgtgccctcctggaacagctcatgctggccccatgcctgcttccaagcttccatcaagtcagggagtggagcaaagagggaaggcagcccctgcactgtagggacccttatgcacagaggcattgagactgcctgttcctcttggaagcttctgctctcaagaggcagctaggtttttggagyttctctgcttcatgtcttgcttcccaccctagggttccagattctgttcttccctagtattggcaaggttttttatagatagctcttggatacatttggaagtaatgtttacaaatggtgagagagaaggcatctgacatttttttctaaacacatgccaatgtttgtcttttccccactaatttcaataatttggcctaacacttttgtcacatattctgactctttattctgatccatttatctactctggcatccccacatggttttaagtactggagctttactgtatgtcttggt

SEQ ID NO: 29099 - DNA, 601 bp, Human
cagcagggcaggagggggaccacggacatcctaggagcaaggaggggaggatcaagtatgggatgctaccaaggactgggattcacggtcatgttcaaccctgggccttcatccccatgggaaagaaggctgaagaagtgagtatcacaagcgtttttgaggagttttaccattaagagggcagaaacatgaagtggtggctaaagagggaagtgggaccaagacagggaggcatgtttcatgtctgtgtgctgctgatgggcaccacctaatatggggaggggtggtagcacgagagagwtactcattgaatgaatgtccttgggtaggtgggagatgagatcccagcccagggaagggctgactgactacgagctgcatggttcgtttccagcaacaagaggcgtcaggaaggggatatagggaggatgctggatgtggctgggagggcagggaaggcagaggacaacctgtggaaggtcccttattcctgattctactcagtaaaatggtaaacatggccatcaaatgaaagcaaaggaaaggtatgcatgggagggagggaagtgggcaatgtagaggaggggcagccccagctcct

SEQ ID NO: 29100 - DNA, 601 bp, Human
tcactctgttgcccaggctggagtgcagtggcataatctcgggtcagtgcaacctctgcctcccaggttcaagtgattctcctgcgtcagcctcctgagtagctgggattataggcaagtgccactgtgcccagctaattttttgtacttttagtagagatggggtttcaccatattgcccaagctggtcttgaactcctgacctcaggtgatccacccacctcggcctcccaaagtgctgggattacaggagtgagccactgtgcttggccaattttattattatttttttttgacaagktctcgctctgttggccaggccggagtgcagtgttacaatcttggctcactgcaaccttgacctcccaagctcaaatgatctcacctcagcctcccaaatacctgggactagaggcgcatgccacccagctaatttttgtatttttttgtagaaacgggattttgctgtattgtcaggctagtctacaactcctgaactcaagtgatgtgcacacctcagcctcccaaagtgctgggattataggcatgagtcaccacacccagccttaagcctttgctttttactaagaatataactaag

SEQ ID NO: 29101 - DNA, 601 bp, Human
aatgccaaagctcagacaatatgtgctccaacagaagctgctgtcatcaccttaatgcccttaattacacatcagcacacagttacaggtcttattcagttcttaagaatatttcaattctattcttcatttatttcgtaggcagaaactcaaaatcagttgggtctctttaacaatgatatggataaagtttaagaaaaggtctaatttgagctaataatttgtcggtcatcaaaacatcataggataaatcgtgatattacttttttccccagccattctctcaatctttaattcttaygtaaatgccaaatgtatacgttcttctcacctgtgggctagtagttacagatgttttcatcacaggttcaatagtgtgagaaagagacactagagtctgaggaagatagaggggaagggaagttaaatccgtaaatgctcctgagtcttcagacaaccattgctgaagctgatcttcaaacctgaaacaatatgtaataaattcaaaaatatttgagcattaggaagttaactattgttcattaatcttctatatatacttaaaaactttttaagcctttgcttttttaaaattttatat

SEQ ID NO: 29102 - DNA, 601 bp, Human
gtaagtctgcaagggccatgcggagaggcgtggcttatggtagcacaggagtagagccaaaggttctaagttttacttctgaaaactcttcctttcccaggaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggmtaaggtgtgtatgccgcgtgatttctaggaacttccagtgccaaggagcgtaaaaatcaacctttcccaatcatccttcagttcttttttccttttcagttttcttcccacaggcccagaaaaactgttccagtgctgaaaaagagctaattttaagaacccagcttttggttataaggcattactattgactatatttggcaggcacgggttgtctaatcacccaactatttaaaaatttaagcttggaaactgttctcttattggatacagaccacatacaagcaaaacctcctaggt

SEQ ID NO: 29103 - DNA, 601 bp, Human
cagcgtgggcaggggcctggccgggtggagggtgcagggcggtggggcagtgtagaaggcagggccgggacctgaggccgggctggggcaggcgggctggggcctttatcattcggatggaagggggaggggagggaagggaggaagaggctgtgggggaggggagcatgccgagggcttccacaattagcaggttttggttaatctggaagggaggggcagagagcattctagtgggggcttctcctgaggcctcagtctccacccctgagttgcctttgggtggccaggcccggcttcmaaggggctgcgatgacccatggctactttatcccgtcttccctggtcaggtttcaggaccccatttaacaaatgggggagtatttagcccatgccaagctcccaaggcgtggggcgctcctggagttcaagatctagcagctgctagtaggccctgaactatgggggctggatatccacccaggacatgatcaggtggagcttcctggaggagaaggccatgaagcccgcaccctaggaacaagagggggacacattgactcaactgatttcctgggagttgcttcaggagcccaggtgg

SEQ ID NO: 29104 - DNA, 601 bp, Human
tcaggtcatacggcagccgctacctacacccgcgcgagagagttgccgagagaagctgcgggaagaaaccgaggaaatttgttatctgcggaaacctgggctcaaacttcgggcttggcggagtcctttctggcacaagcgcctttgggtggattgaaacagcgcgatgtgacggacttgagatagtgctttcagcaggaaaaaaccagagaggaaaaaaatccaaaaacatcagtcggaatatcagggagccaggaaagaagttaccaaacagtcccactttgggaacttttcaattctyagaaagttgacccggctcaaaagttgggggaaagagctgcaaaaaaataataataaattaaagaaataatcataaaaatgaccagccaaagaggtgtgagccgctgtcggttcttaaaaaaagagacactgccagtaatgagctttactctttgttatttaattattttctaagctttacgtctcatcgcaaagtaaataaattatgcctatcattttggcagcttaagataattttgttggcggttcgggtgtgactaggatagtgtaaccctgtaagtgaattacccctccctgcaat

SEQ ID NO: 29105 - DNA, 601 bp, Human
ggactcgcgcctctgtgaggtcgatcttcagggccagctcctcccgagtgtagatgtcggggtagtgagtctccgcgaagaccctttccagctctttgagctgggcactggtgaaagtggtgcggatgcgccgctgcttgcgcttctcgttgaggccgccgtggtccgtgaagagtttgtaaggaactagagtatgacagaggagacagaaagtgagcaaatcagccggcagctcgccggccgtggagctagaatgtgaggactccaaggtcaggtcatacggcagccgctacctacaccygcgcgagagagttgccgagagaagctgcgggaagaaaccgaggaaatttgttatctgcggaaacctgggctcaaacttcgggcttggcggagtcctttctggcacaagcgcctttgggtggattgaaacagcgcgatgtgacggacttgagatagtgctttcagcaggaaaaaaccagagaggaaaaaaatccaaaaacatcagtcggaatatcagggagccaggaaagaagttaccaaacagtcccactttgggaacttttcaattctcagaaagttgacccggctcaaaagttggggg

SEQ ID NO: 29106 - DNA, 601 bp, Human
tatgcacatgtagaaatatttcccttttaaatagaagcattcattataacacatataaataaattcaaaaatctgaaacataacttatgacaattatgttcacaaacatagtccaacaggaaaaaaaaagaaatcagacagacatgcacctgataacaaaaatatataccattgtctgaaccgtggcctctctaaacacaaaagattgaacccgtgagaaccttattacaccataaagacacgccatagagactacaagaagagaaaaacattatacggtcacgtagaggagacagtctgyactgatattaacacgatacaattgagtcacagaacacagttgtagaaagacaccgaaaaagttaaagcctcaacattcaactaatatctagagtttgtgccttttaaaataaaaacaacaacaaagaatcaaaacagagatgtctaaactgcgcgaagaatggaaccctcaatatacagtccatccaccatacaggatgtgagtccagttcggatcattccaacagaaatgcaaaccgagacacccctgcaaacgtgtgtgtgtgccttttccttgctcggtagatttctctgcagccag

SEQ ID NO: 29107 - DNA, 601 bp, Human
aatggtacactcttggaaaactatatgcacatgtagaaatatttcccttttaaatagaagcattcattataacacatataaataaattcaaaaatctgaaacataacttatgacaattatgttcacaaacatagtccaacaggaaaaaaaaagaaatcagacagacatgcacctgataacaaaaatatataccattgtctgaaccgtggcctctctaaacacaaaagattgaacccgtgagaaccttattacaccataaagacacgccatagagactacaagaagagaaaaacattatacrgtcacgtagaggagacagtctgcactgatattaacacgatacaattgagtcacagaacacagttgtagaaagacaccgaaaaagttaaagcctcaacattcaactaatatctagagtttgtgccttttaaaataaaaacaacaacaaagaatcaaaacagagatgtctaaactgcgcgaagaatggaaccctcaatatacagtccatccaccatacaggatgtgagtccagttcggatcattccaacagaaatgcaaaccgagacacccctgcaaacgtgtgtgtgtgccttttccttgc

SEQ ID NO: 29108 - DNA, 601 bp, Human
gaaactccatctccaaaaaaaaaccccactgaattgtacatttctaaaaagtggctttggccaggcagtggctcatgcctgtaatcccagcactttgggaggctgaggcgggttaactgcttgagtccaggaattcgagaccagtctagtctaggcaacacagcaaaaccccatctctataaaaataagccaggtatggtggcacgtgcctgtaattcccactacttgggaggctgagctgagagggtcgcctgagcctgggaggtcaagaatgcgtaagccgtgattgtaccactgcackccagcctgggtgagaccctgtctcaaagaaaaaaaacaaaaaaggtagcttttgtggaatgtgaattatatctcaattttaaataaaggttatgcccatctattgacacaaaatgatgtccctgagattttattcaatgaaaaaagaacagccttgataaaaccacacgtatagaaaaaagtgggcaacatggcctgaactctccccaggcacccccaacagaaaacgcagtctgggagcctgcagcctcagatgaagggctgggttgaggccccagacctgcagagggcggctctgggc

SEQ ID NO: 29109 - DNA, 601 bp, Human
tggagtctcactctgtcgcccaggctggagtgaagtggctcgatcttggctctctgcaacctccacctcccaggttcaagtgattctcctgcctgagcctcctgagtagctgggagtacaggtgcccgccaccacacctggctgatttttgtatttttagtagagaccaggtttcactgtgttggccaggctggtcacgaactcctgacctcaggtgatctgtccgcctcagcctcccaaagtgctgggattacaggtgtgagtcaccgtgcccggcctaattttttttttttttaagackgagtctcgctctgtcacccaggctagagtgcagtggtgcgatcttggctcactgcaacctccgacttccgggttcacaccattctcctgactcagcctcccgagtagctgggactacagctgcccaccaccacgcccggctaattttttatatttttagtagaggtggggtttcacagtgttagccaggatggtcgcgacctcctgacctcatgatctggctgccttggcctcccaaagtgctgggattacaggcgtgagccaccgcgcccagccaatttttatatttttttaatagaga

SEQ ID NO: 29110 - DNA, 601 bp, Human
tagctaggacgacaggcacaagccaccacgcctaatttttttttttttttttgagatggagtctcactctgtcgcccaggctggagtgaagtggctcgatcttggctctctgcaacctccacctcccaggttcaagtgattctcctgcctgagcctcctgagtagctgggagtacaggtgcccgccaccacacctggctgatttttgtatttttagtagagaccaggtttcactgtgttggccaggctggtcacgaactcctgacctcaggtgatctgtccgcctcagcctcccaaagtgytgggattacaggtgtgagtcaccgtgcccggcctaattttttttttttttaagacggagtctcgctctgtcacccaggctagagtgcagtggtgcgatcttggctcactgcaacctccgacttccgggttcacaccattctcctgactcagcctcccgagtagctgggactacagctgcccaccaccacgcccggctaattttttatatttttagtagaggtggggtttcacagtgttagccaggatggtcgcgacctcctgacctcatgatctggctgccttggcctcccaaagtgctg

SEQ ID NO: 29111 - DNA, 601 bp, Human
cataaggacacccaccaatgggttgccctgtgtgtcacatgaggtcacactacaggatgacaagcacccaacccaacacaccgtcatcatggttgggatgtaagatggaacagccatgttggaaaagcctgacagctcttcactgagtttccagatgacccggccacgccactcttaggtatctgcccgaaaaatgagcacgcatccacaccatcacttctacacggatgtccccaggagccagaaggtggaagcagcccagacgccttcaatggatgaacggacaaacgcccatccacaygatgggacatactcagccatgaaaaggagcgaggctctgacacaggccacagcgtggatgcaccttgaggacgccacattcagtgagagacgccagacacaaaaggccacacagtgtgtgatcccatttctaagaaatgtctagaacaggataattcagagacaggaaggggacgcgtagtgccagaggctggggtgcaggatgtggagtggctgctgatagggacaggacttcgtttctctctttccttttggagatagggtctcactcttgcccaggctggaatgcaatggctcaatc

SEQ ID NO: 29112 - DNA, 601 bp, Human
cggggctctgctctcagcctgccatggacaagcgccggcaactcatcctctccaggacataaggacacccaccaatgggttgccctgtgtgtcacatgaggtcacactacaggatgacaagcacccaacccaacacaccgtcatcatggttgggatgtaagatggaacagccatgttggaaaagcctgacagctcttcactgagtttccagatgacccggccacgccactcttaggtatctgcccgaaaaatgagcacgcatccacaccatcacttctacacggatgtccccaggagccaraaggtggaagcagcccagacgccttcaatggatgaacggacaaacgcccatccacacgatgggacatactcagccatgaaaaggagcgaggctctgacacaggccacagcgtggatgcaccttgaggacgccacattcagtgagagacgccagacacaaaaggccacacagtgtgtgatcccatttctaagaaatgtctagaacaggataattcagagacaggaaggggacgcgtagtgccagaggctggggtgcaggatgtggagtggctgctgatagggacaggacttcgtttctctc

SEQ ID NO: 29113 - DNA, 601 bp, Human
actcgactgcagccaccacctgctcgtcatctttccagacaggaccctacctcctgcggaacccaccaccgagttcctcatttcaatgcccttttctatttctataagttcttattttatttttttaactctgtcacccaggttgaattgcagtggcaggatctcaactccgcctcccaggctccagtgattctcctgcctcagcctcccgagtacctgggactacaggcatgtgccaaaacacccagctaattattttatttttagtggagacggggtttcaccatgttggccaggctgstcttcaactcctgacctcaggtgatcctcccgcctcggcctcccaaagtgctgggattacaggcgtcagccactgtgcccggccttatttctgcaagttctgcagggcttttaatgatctgtctgctatttttcacagtcttgttcttttcttttgttgacaattcttcctatttcaccatcttcatttcgggaagttctctgagcgcgcagagagtgtaaatggacctcaaacccaaaagagggggcccagaggtaccacggccggaggaggatgccgccagccgctccggatggaacc

SEQ ID NO: 29114 - DNA, 601 bp, Human
accctggctcacctactcgactgcagccaccacctgctcgtcatctttccagacaggaccctacctcctgcggaacccaccaccgagttcctcatttcaatgcccttttctatttctataagttcttattttatttttttaactctgtcacccaggttgaattgcagtggcaggatctcaactccgcctcccaggctccagtgattctcctgcctcagcctcccgagtacctgggactacaggcatgtgccaaaacacccagctaattattttatttttagtggagacggggtttcaccawgttggccaggctggtcttcaactcctgacctcaggtgatcctcccgcctcggcctcccaaagtgctgggattacaggcgtcagccactgtgcccggccttatttctgcaagttctgcagggcttttaatgatctgtctgctatttttcacagtcttgttcttttcttttgttgacaattcttcctatttcaccatcttcatttcgggaagttctctgagcgcgcagagagtgtaaatggacctcaaacccaaaagagggggcccagaggtaccacggccggaggaggatgccgccagccg

SEQ ID NO: 29115 - DNA, 601 bp, Human
ccacctggagcttccctcggctgccctggcccttgagcccgtcctgaggatttgtgctttgactctgacagggagcagcaggaagctgccagcccactgcctccatgcgggtccttggagggcagacggtggagcggcgcttcctcagctcccgcggtcaggccccatcagggatggtcacagtccagccacaggggcgactctgcccatcagtccccctggggcagcgaccagatcctggctggggcagcaccgggacaggccctctctatgggcctaaggtcaatgcaggtgggggctygctgggcccaggccaatgaacccacccgtaggagccctcactgggcagcagggccaggagggcaccagggactggccgcagagtccactcggggcaggcgtctgtggcttggaacctgccctcgccaaggcactggggggttaaggagcagatccctcagacggccttgggccagaagctccctggagagctgggcacctcgaggagcgtctgggagcctcaccctgtcccagtggctcctggcacccctgggagcgtcagcaccaccccaaagctgggtgcctgtgtcgccactaaaca

SEQ ID NO: 29116 - DNA, 601 bp, Human
aattgacatccagaaccaagtagagaagcaaaggttgaagaaagacaagagaagagagaagactggtaggaaaagattccagtgggaacaagaacagaaggcaatggcagaggagggagggtcagcagaacagaaaagggggcaaagctcttgagaccagaagaaaggagataaggaaagatgcagacagggagatgaagatgcaacaaggaatatacaaagggttctactgaaaaaaaaaaagtaattttctctaccaataaccgaggaagacagattgcagcaattcccaaaactgggrcagcagagaggtagaggagcaatgctatagaagattgccctaagggtccctgagtattcactccataggggctcaaccagctgccaagttatattcagtctactcaagatcacacccctttgaccaaataagactatgtccaaggtagtcaaggtaacatatatgtactgcttcccacaaaaactttggatatctttattaaactccaaaacaccacaaagagttaaaaggtatagacttccacttattaaatgaattttcaaaaagagggaagctgtcactgggtcagtcttagctcta

SEQ ID NO: 29117 - DNA, 601 bp, Human
gtagatcccccagatggtaagagataaattcctaatacgtgtctagcaaacaaagctcggtaaatagaaattgacatccagaaccaagtagagaagcaaaggttgaagaaagacaagagaagagagaagactggtaggaaaagattccagtgggaacaagaacagaaggcaatggcagaggagggagggtcagcagaacagaaaagggggcaaagctcttgagaccagaagaaaggagataaggaaagatgcagacagggagatgaagatgcaacaaggaatatacaaagggttctactgaaaaaaaaaaagtaattttctctaccaataaccgaggaagacagattgcagcaattcccaaaactggggcagcagagaggtagaggagcaatgctatagaagattgccctaagggtccctgagtattcactccataggggctcaaccagctgccaagttatattcagtctactcaagatcacacccctttgaccaaataagactatgtccaaggtagtcaaggtaacatatatgtactgcttcccacaaaaactttggatatctttattaaactccaaaacaccacaaagagttaaaaggt

SEQ ID NO: 29118 - DNA, 601 bp, Human
caggaagaaaggctatcagtatacacttacctttaaaaagtaaaaaaaaaaaaaaaagaaaagaaagtagatcccccagatggtaagagataaattcctaatacgtgtctagcaaacaaagctcggtaaatagaaattgacatccagaaccaagtagagaagcaaaggttgaagaaagacaagagaagagagaagactggtaggaaaagattccagtgggaacaagaacagaaggcaatggcagaggagggagggtcagcagaacagaaaagggggcaaagctcttgagaccagaagaaargagataaggaaagatgcagacagggagatgaagatgcaacaaggaatatacaaagggttctactgaaaaaaaaaaagtaattttctctaccaataaccgaggaagacagattgcagcaattcccaaaactggggcagcagagaggtagaggagcaatgctatagaagattgccctaagggtccctgagtattcactccataggggctcaaccagctgccaagttatattcagtctactcaagatcacacccctttgaccaaataagactatgtccaaggtagtcaaggtaacatatatgt

SEQ ID NO: 29119 - DNA, 601 bp, Human
ttcttctggggccgttcctccctacatgacaaagtccttttcttctgctgctgctcttctctagtgacaccttagaggctttccacctggtcttaatgaaggagactagatcccttgcaagtgactgcaggggtgtgaatgtcctcccagtatgagaacaaaagaatgcaataacttatatggtccttcaatccagagagaagaaacaaacaacagcacatgcagaacccgagcagaggagtagctttttcattcactgctgaggaagctaaagggaaaataacaagaaaatacagcgacrcctttttttttttttctgagatggggtttcactctgtcacccaggttggagaacagtagcacaattttggctcactgaaatttctgcctcccaggctcgagtgatcctcccacctcagcctcctgagtagctggaaccacacacacacaacaccacacccagttaattttttgtattttgggtagagatggggttttgccatgttgctcaagctggtctcgaactactgagctcaactgatcgcccgcctcagccacccaagtgctgggattacaggcagaagcactatgtccggccaag

SEQ ID NO: 29120 - DNA, 601 bp, Human
agctagaattacaaaattccagctattctaccacgcccagctaatttttatatttttagtagagacaaggtttcaccatgttggccaagctagtctcaaactcctgacctcaagtgatccgcctgccttggcatgccaaagcgctgagattacaggcatgagccaccaaacccagcctaaaaatgtgtattttttaaggtaaagtatttattatactttttagtgtccttcttgttctccctgcatcaaatctgtgctagggagaatctaagaaaaagaaagagattttgcctgctttgcyaccataattttaaagaggaagcaatatgccctggatgctactgtgatggagatgacagtcaccttcttcttctggggccgttcctccctacatgacaaagtccttttcttctgctgctgctcttctctagtgacaccttagaggctttccacctggtcttaatgaaggagactagatcccttgcaagtgactgcaggggtgtgaatgtcctcccagtatgagaacaaaagaatgcaataacttatatggtccttcaatccagagagaagaaacaaacaacagcacatgcagaacccgagc

SEQ ID NO: 29121 - DNA, 601 bp, Human
tcatcaatctccctaacaacccacaggtcctacgtgactaggttcaccacccacacattccccccacccctccccagacatactgcattccaaccacgtggataatttcttcattccttaaagaaaccaagtttctccttgctgttccttctaatgggaacacttttacccaaacctctcctggctcactcctatatatctttcaggctcaacataaatgtcactttctcagagaggctctgttgacccttgacatcatattagcaccccatccctccctctgttttggcttcaaaggaarctagtaaataattggttttggggtgccaaaaaggaagacatggcctgctgaaacaaagcaggatggaagccgggaagcaagacgtcacagaaagccttaagatctgcacgtgctcctctgaagacaaggtatgcccatggcacagagccatgagcctggaatgtgagtttgagataagatcaaaatgtgcatttttgttgctgttttttgagtcagagtcttactccatcccaggctggagtgtagtggcacaatctcggctcactgcaacctctgcctcccgggttcaagcaattctca

SEQ ID NO: 29122 - DNA, 601 bp, Human
gaagttgccaacttctgtgtaagtatagtgccagtgcctacaacacagcctcgctcacataaacaagggtatagcctggatgtcaatctgcaaagtaatctgtaaaggaagcaaaagtcggccagtggctcatgctgtaatcccagcactttgggaggctgagacgggtggatcacctgaggtcaggagttcaagagttcaagaccaacctgcccaacatggcgaaaaccgtctctagaaaaaatacaaaaaattaactgggcatggtgtcaggcacctgtaattccagctacttgggagrctgaggcaggagaatcgcttgaacccgggaggcagaggttgcagtgagctgagattgcacccctgtactccagcctggatgacaagagcgaaactccatctcaaaaataataataaaaaaaaaggaaacagaagtctagtaaaacctcaattaggtgacccttgattatctgaaatgatttcatgagaaaagtctagaaaaaaaccaaaaagccctgacagaagagaagggctttctgagagtccattccgaagcaacagtgcagaatctggatcaggtgagatccagatccctctgtgc

SEQ ID NO: 29123 - DNA, 601 bp, Human
tacttttaaagaactgattaaaattctaatcattcaacattagtttgttattactattatccacatttgtgcaaggcaatgagaagttgccaacttctgtgtaagtatagtgccagtgcctacaacacagcctcgctcacataaacaagggtatagcctggatgtcaatctgcaaagtaatctgtaaaggaagcaaaagtcggccagtggctcatgctgtaatcccagcactttgggaggctgagacgggtggatcacctgaggtcaggagttcaagagttcaagaccaacctgcccaacrtggcgaaaaccgtctctagaaaaaatacaaaaaattaactgggcatggtgtcaggcacctgtaattccagctacttgggagactgaggcaggagaatcgcttgaacccgggaggcagaggttgcagtgagctgagattgcacccctgtactccagcctggatgacaagagcgaaactccatctcaaaaataataataaaaaaaaaggaaacagaagtctagtaaaacctcaattaggtgacccttgattatctgaaatgatttcatgagaaaagtctagaaaaaaaccaaaaagccctga

SEQ ID NO: 29124 - DNA, 601 bp, Human
agtctaatggcttgatctaataatgccattctcaagttgggaagataacataaataatttgaatctctccctacctaacatgccaaaataatggctacttttaaagaactgattaaaattctaatcattcaacattagtttgttattactattatccacatttgtgcaaggcaatgagaagttgccaacttctgtgtaagtatagtgccagtgcctacaacacagcctcgctcacataaacaagggtatagcctggatgtcaatctgcaaagtaatctgtaaaggaagcaaaagtcggccrgtggctcatgctgtaatcccagcactttgggaggctgagacgggtggatcacctgaggtcaggagttcaagagttcaagaccaacctgcccaacatggcgaaaaccgtctctagaaaaaatacaaaaaattaactgggcatggtgtcaggcacctgtaattccagctacttgggagactgaggcaggagaatcgcttgaacccgggaggcagaggttgcagtgagctgagattgcacccctgtactccagcctggatgacaagagcgaaactccatctcaaaaataataataaaaaaaaa

SEQ ID NO: 29125 - DNA, 601 bp, Human
aagaaataaacacaccttttctatagaatgattttacttttgctctgtctctcaaaatttgttttcatttgcttataaccactccctcccttccttggtatcagattaagtatgttttgattttagaaatcgtttaataatgtaatgctagttttcataattaaatatcaataaattcaagtggtatgaaagttacactcgcgagtttcaacagaaaaagaatgttaatattttggaggccaggccaggtacaggtaatggtttgtaaagtattacaaaccctttcattaagcaactctgyctagaagctgcctctcactgtagccaagagtctgacctgcacctgataactcagtaagctagtggacgttagagagtgccaaacattctttaaaaaacaataaacatggacgccttctagtaacacctgaagggtccttgtgtatctgactcatgcccaagggaagaaaaagccttattcttatagaactatcaaaagtccaagtcacaggcaaggaaaaaaaattacacatgctaggtgatatttagcagaaattcttagaaattctggtgaaagcacaattctcacaacgtccagagg

SEQ ID NO: 29126 - DNA, 601 bp, Human
acaggtgacactcatgtggaattggtcatacccctgactgcatcatttaggttctaattttaaaagaactcaagagttaagaaataaacacaccttttctatagaatgattttacttttgctctgtctctcaaaatttgttttcatttgcttataaccactccctcccttccttggtatcagattaagtatgttttgattttagaaatcgtttaataatgtaatgctagttttcataattaaatatcaataaattcaagtggtatgaaagttacactcgcgagtttcaacagaaaaagaaygttaatattttggaggccaggccaggtacaggtaatggtttgtaaagtattacaaaccctttcattaagcaactctgtctagaagctgcctctcactgtagccaagagtctgacctgcacctgataactcagtaagctagtggacgttagagagtgccaaacattctttaaaaaacaataaacatggacgccttctagtaacacctgaagggtccttgtgtatctgactcatgcccaagggaagaaaaagccttattcttatagaactatcaaaagtccaagtcacaggcaaggaaaaaa

SEQ ID NO: 29127 - DNA, 601 bp, Human
gaaagaaatgaatgaactcggtgtccccttcctccctaccttctccagtttgaggaaaaaagtggtgggaagataggtcagagaagtggtatatttcacattcttggaagaattccttggttacctttatttaagcaatcaacggacaaaaacacagctcatcagccctcatgggcatctgactgcgtagccaaggggctcgttcggggattttgtgtcttccatcccacccacagccccacaacaaagctacagtccttcagaccagttccgcttcctgcgttctcccactgaagccagrttaaacaccttgcggttcctccctcaacagaggggcaggactacagccccagccggcacctaaccaggaggccccacagaggatctcagctgcttctgctgattggagagatttgccggacagctgaaaggctggagacttaagttcacagtacgcctgcaataaacagcaattgctcatcctcatcctcccttccctatttctcatcttcacgcctttgctcttacctttctcctggcagtgggctcagtttgggaaaatctaacgggaaactcaagagaggcgtgtaaaccaaacacc

SEQ ID NO: 29128 - DNA, 601 bp, Human
ctagctaaataccttctaattaacaataaggcatttctgcctctgaaaaaatagttgagtccaaaggccacacccgggaaagaaatgaatgaactcggtgtccccttcctccctaccttctccagtttgaggaaaaaagtggtgggaagataggtcagagaagtggtatatttcacattcttggaagaattccttggttacctttatttaagcaatcaacggacaaaaacacagctcatcagccctcatgggcatctgactgcgtagccaaggggctcgttcggggattttgtgtcttccmtcccacccacagccccacaacaaagctacagtccttcagaccagttccgcttcctgcgttctcccactgaagccaggttaaacaccttgcggttcctccctcaacagaggggcaggactacagccccagccggcacctaaccaggaggccccacagaggatctcagctgcttctgctgattggagagatttgccggacagctgaaaggctggagacttaagttcacagtacgcctgcaataaacagcaattgctcatcctcatcctcccttccctatttctcatcttcacgcctttgctc

SEQ ID NO: 29129 - DNA, 601 bp, Human
ccagcttcagaaaaacaatttctggctttgctgccccattttttcctcagagctttctagttaaatcaaaatttcttcccttgttcctatctagccctcccactttacctgcaatatcccacagctgaagccgcactatctcgtagtcagaccactggagaaccttcagagcaaaatccactgaaaatatatgtacattatactttaataaaatttcactgtaaaaaattaatagggataaactcaaatcaaataggcagtgaaaccctatggacacacaactccaatcccatatgtttawctttaagccctcaattcactgagatgagtccacatgcgtgtatttagtgtgagatggatgattcatactcactctccaaaggggtttccagcttttactctactgtcaagctcatttatttgctactgtttgtctccaagactgggggtgggagtaactatgaaaacaattctcattctcaggttaaatagtttctgggagatttagggggttttctcagggaaggggtgatgggggagaagggggaaatgagacaagtgtggttgctttcgtatcttccacattcaatttcactgttgg

SEQ ID NO: 29130 - DNA, 601 bp, Human
aaagaaagtctcacccttggctgggcgcagtggctcacgcctgtaatcccagcactttgggaggctgaggcgggcagatcatgaggtcaggagagcgagaccatcctggctaacacaatgaaacccagtctctactaaaaatacaaaaaaattagctgggtgtggtggtgggcacctgtagtcccagctactcgggaggctgaggcaagagaatggcgtgaacctgggaggcagagctggcagtgagccgagatcgcgccactgcactccagcctgggcaacagagcgagactccgtctcaaaaaaaaaaaaaagaaagaaagtctcactcaccctcaacatcctttgaaggaggtagagatgattttgccaacttaagaaggggaaatggatgcccagaatcagagagcattttacttcctttctaaccacagatagaggctagggaccattttctgagattggccacataccttgttggccaagagcaggcagggcaccggctctccattgggtagtgtgagcttgctgtctaggtcctgtttccacctctggctgttgctgaaggtagtggcattggtaacgtcaaacataataacac

SEQ ID NO: 29131 - DNA, 601 bp, Human
tcatgatatcaatgaatatcaaatggaaaaataagctcagaagtaggtgagaattatgatctctaaaacgcaggtgctgatttctaatccttctcataaaattccggatcacaaattgagggctgatgagaagatcttacaccgaaggcactaactggcactaatgtgagccagcaacatgtgaaaggctaatccaggagatgcagaaatgcacatgggttccaggtgtcttttctaagtgacaatgggcctccttactggacagtagtcaggagacaattcaaatgtacttaataaaatkgtcaggtgggcaaccaaagggaagagacttaaaagacctcccagaactgggatggaaaataagccaaacactactagcagcaggaccagctggaggacttggtttgtagattgatgtagtccccttgggtggacaaagacatgatatcttctgtggaatttctcatcatcttttcaatgaggactctaaaagacaaaaaataagcctgagaagcttattttggaggaaaagcagaaatggcagatgtagtctgacttatcatcagagagtatttggtaaagccagaaggtttaaatgccc

SEQ ID NO: 29132 - DNA, 601 bp, Human
gatgcccagaccccctccttctgcattccagaatcagatgtttacattccaagacagaaagaatctgaaacaacggcctacaagaaatttgggaaatgacatttgatctcattttcctctcaattggaagtcatgatatcaatgaatatcaaatggaaaaataagctcagaagtaggtgagaattatgatctctaaaacgcaggtgctgatttctaatccttctcataaaattccggatcacaaattgagggctgatgagaagatcttacaccgaaggcactaactggcactaatgtgagycagcaacatgtgaaaggctaatccaggagatgcagaaatgcacatgggttccaggtgtcttttctaagtgacaatgggcctccttactggacagtagtcaggagacaattcaaatgtacttaataaaatggtcaggtgggcaaccaaagggaagagacttaaaagacctcccagaactgggatggaaaataagccaaacactactagcagcaggaccagctggaggacttggtttgtagattgatgtagtccccttgggtggacaaagacatgatatcttctgtggaatttctcatcatc

SEQ ID NO: 29133 - DNA, 601 bp, Human
aaacttaattatgacgttagaagtttcaaaaatacagtgacttctgggacacttctagtagccaaaaatccacagatgcccagaccccctccttctgcattccagaatcagatgtttacattccaagacagaaagaatctgaaacaacggcctacaagaaatttgggaaatgacatttgatctcattttcctctcaattggaagtcatgatatcaatgaatatcaaatggaaaaataagctcagaagtaggtgagaattatgatctctaaaacgcaggtgctgatttctaatccttctcayaaaattccggatcacaaattgagggctgatgagaagatcttacaccgaaggcactaactggcactaatgtgagccagcaacatgtgaaaggctaatccaggagatgcagaaatgcacatgggttccaggtgtcttttctaagtgacaatgggcctccttactggacagtagtcaggagacaattcaaatgtacttaataaaatggtcaggtgggcaaccaaagggaagagacttaaaagacctcccagaactgggatggaaaataagccaaacactactagcagcaggaccagctggagg

SEQ ID NO: 29134 - DNA, 601 bp, Human
acaaacttcccaggtattcccgaccagccagatttgggaaccactgacttaggacacttatttaaggtctatcacagaacttcaggcctcagagtttagtaagaatatcgataactttgggtaggttataaatcaccatcctagagataatttaacaaattaaacggtctagtagtgatttgatactaaaaagccctgcccaatttagtacttaaattacctaatgattttctgtctatctactttcctaccccaggctaggacctgcacataatatgtttcctatgactaagtgcctacrtgttcacaaagttgccccagtggaggttgttaacttctctcttttcttcttccattcagattcccaaagctgtgaggagcagacctatttcgaagcatcacagccagctgatgtcacttgcagtattatgcattaagacatcaacccagaaacctgcaaatgggagacactaggcaatcctatcatgaggattaagctctttgtggaagaaaatgctttcattgcatgagataggtagtttaaaaatgactattcttttttcttttttttttgagacggagtccttctctgtcacccagg

SEQ ID NO: 29135 - DNA, 601 bp, Human
ccacgcctggctcaggacccaaaaatcttaaaacatttttaaaaaattttaacaaacttcccaggtattcccgaccagccagatttgggaaccactgacttaggacacttatttaaggtctatcacagaacttcaggcctcagagtttagtaagaatatcgataactttgggtaggttataaatcaccatcctagagataatttaacaaattaaacggtctagtagtgatttgatactaaaaagccctgcccaatttagtacttaaattacctaatgattttctgtctatctactttcctmccccaggctaggacctgcacataatatgtttcctatgactaagtgcctacatgttcacaaagttgccccagtggaggttgttaacttctctcttttcttcttccattcagattcccaaagctgtgaggagcagacctatttcgaagcatcacagccagctgatgtcacttgcagtattatgcattaagacatcaacccagaaacctgcaaatgggagacactaggcaatcctatcatgaggattaagctctttgtggaagaaaatgctttcattgcatgagataggtagtttaaaaatga

SEQ ID NO: 29136 - DNA, 601 bp, Human
ttggccaggttgatcttgaactcctgacctcaggcgatccacctgcctcagcctcccaaagtgctgggattacaggtgtgagccaccacgcctggctcaggacccaaaaatcttaaaacatttttaaaaaattttaacaaacttcccaggtattcccgaccagccagatttgggaaccactgacttaggacacttatttaaggtctatcacagaacttcaggcctcagagtttagtaagaatatcgataactttgggtaggttataaatcaccatcctagagataatttaacaaattaaayggtctagtagtgatttgatactaaaaagccctgcccaatttagtacttaaattacctaatgattttctgtctatctactttcctaccccaggctaggacctgcacataatatgtttcctatgactaagtgcctacatgttcacaaagttgccccagtggaggttgttaacttctctcttttcttcttccattcagattcccaaagctgtgaggagcagacctatttcgaagcatcacagccagctgatgtcacttgcagtattatgcattaagacatcaacccagaaacctgcaaatggg

SEQ ID NO: 29137 - DNA, 601 bp, Human
ttctttttgtttttttttttttggagatggagtttcactcttgttgcccaggctgaagcgcaatggtgtgatctcagctcactgcaacctctaactcccaggttcaagtgattctcctgcctcagcctcccaagtagctgggattacaggtgcccgccaccacgcccagctaatttttcttatttttagtagagacggggtttcagtatgttggccaggttgatcttgaactcctgacctcaggcgatccacctgcctcagcctcccaaagtgctgggattacaggtgtgagccaccacgsctggctcaggacccaaaaatcttaaaacatttttaaaaaattttaacaaacttcccaggtattcccgaccagccagatttgggaaccactgacttaggacacttatttaaggtctatcacagaacttcaggcctcagagtttagtaagaatatcgataactttgggtaggttataaatcaccatcctagagataatttaacaaattaaacggtctagtagtgatttgatactaaaaagccctgcccaatttagtacttaaattacctaatgattttctgtctatctactttcctacccca

SEQ ID NO: 29138 - DNA, 601 bp, Human
aaatgtaaatacaaaaggtctgggtctctgtatctttacaaagttctccagcaatggtttccaaaccaggcttatcacaatcaccagggaagctctgaaaacaacaacacattcctaggcttcatccctagaaattctgattcagtaggtttgaggtcgggacccaaaaatctttttctttttgtttttttttttttggagatggagtttcactcttgttgcccaggctgaagcgcaatggtgtgatctcagctcactgcaacctctaactcccaggttcaagtgattctcctgcctcagyctcccaagtagctgggattacaggtgcccgccaccacgcccagctaatttttcttatttttagtagagacggggtttcagtatgttggccaggttgatcttgaactcctgacctcaggcgatccacctgcctcagcctcccaaagtgctgggattacaggtgtgagccaccacgcctggctcaggacccaaaaatcttaaaacatttttaaaaaattttaacaaacttcccaggtattcccgaccagccagatttgggaaccactgacttaggacacttatttaaggtctatcacagaac

SEQ ID NO: 29139 - DNA, 601 bp, Human
gatttgtatttgtatttaaatgtaaatacaaaaggtctgggtctctgtatctttacaaagttctccagcaatggtttccaaaccaggcttatcacaatcaccagggaagctctgaaaacaacaacacattcctaggcttcatccctagaaattctgattcagtaggtttgaggtcgggacccaaaaatctttttctttttgtttttttttttttggagatggagtttcactcttgttgcccaggctgaagcgcaatggtgtgatctcagctcactgcaacctctaactcccaggttcaagygattctcctgcctcagcctcccaagtagctgggattacaggtgcccgccaccacgcccagctaatttttcttatttttagtagagacggggtttcagtatgttggccaggttgatcttgaactcctgacctcaggcgatccacctgcctcagcctcccaaagtgctgggattacaggtgtgagccaccacgcctggctcaggacccaaaaatcttaaaacatttttaaaaaattttaacaaacttcccaggtattcccgaccagccagatttgggaaccactgacttaggacacttattt

SEQ ID NO: 29140 - DNA, 601 bp, Human
gttgagaggcctggagggagacaaagaggaagggacagggaagtcaacaccccctgctagcagggacgccctcctcccccattctcacctcttctctcagctgatgattctcctcctccagcagcctcagcttctcctgcaaggcttccagctgtgggcagtggtgctggtgcagcaatgcctcctgcgaaatcctaggggagggaggaatgggagtcagggtgcagggagtggggcttcccagttcccagcccaccagggctaagggcagtgttctcaattagttccagcaaccctgccrgcaagcacatcacctgtgtccctcttaacaaatgaggaaattgaggctcagagaaaggacttgcaggtgcaaaggcaggaactcacagcttaggggcatcacagggatgagcacactgcaggtcttcctctgcttcttcttcttcctgttcctcttctgcctccttttcttcctcctcctcttcttcatcctcatcctcctcatcagaatctgagtagagctggaggagctcatcccgcaagttcacctggtgtctgaggtataaaatctggcaggaagagagaggagccatgggttggg

SEQ ID NO: 29141 - DNA, 601 bp, Human
ttcagggagttgcagaacccagcaggaaggaaggtcagttctggggtaaagggaacagcaggagttcagctgttgccactttgcgtttgcatctcaccagctacacttgaactcctcaggcacaaacactgctcctcactcatcttcataaacacacagtgcctaggacgatgccaggcacagccactgccccgtgcatgactctgaactgtcccagccctgggtgcctggtctctggcagctcatggctccctcttgcctgccccaaataagagaagacaggcttggaggagacccaccttttttttttttgagatggagtcttgctctgtcgcccaggctggggtgcagtggcgtgatctaggctcactgcaaactctgtctcccaggttcaagcaattctcccacctcagcctcccaaggagctgggactacaggcttgtgccactgcatctggctaatttttgtatttttagtagagatagggtttctctaagttggttaggctggtctcaaactcctgacctcaggtgatccgccggcctcagcctcccaaactgttgggattacaggcatgagccaccgtgcctggcctgagacc

SEQ ID NO: 29142 - DNA, 601 bp, Human
ctgagatcatgacattgctctagctgggcgacagtgagactccgtcaaaaaaaaaaaaaaaaaaaatttgccaggcgtgatggcacacaccagtagtcccagctactcaggaagctgaggcaggagaatcacttgaacccaggaggcaggggttgcagtgagccaagactgcaacactgtactccatctcaaaaaaaaaaagaaagaaagaaagagagagagagagagagagagagagagaaggaaagaaagaaaagaaagaaaagaaagaaaagaaagaaaagaaagaaaagaagaaagaaagaaaagaaagaaaagaaagaaagaaagaaagaaagaaagaaagaaagaaagaaagaaagaaagaaagaaagaaagaaagaaaatgaggtcttgccaggttcccaggctggggctggagtacagtggctattcataggtgcgatcctattactgatcagcatgggagttttgacctgctctgtttctgacctgagccagttcacccctcctcaggcaacccagtggtactccactccctggaccatactgaccctgtcggcatagtgtactacagcccagaattcacaggctcaagcaa

SEQ ID NO: 29143 - DNA, 601 bp, Human
tgagctgagatcatgacattgctctagctgggcgacagtgagactccgtcaaaaaaaaaaaaaaaaaaaatttgccaggcgtgatggcacacaccagtagtcccagctactcaggaagctgaggcaggagaatcacttgaacccaggaggcaggggttgcagtgagccaagactgcaacactgtactccatctcaaaaaaaaaaagaaagaaagaaagagagagagagagagagagagagagagaaggaaagaaagaaaagaaagaaaagaaagaaaagaaagaaaagaaagaaaagaagaaagaaagaaaagaaagaaaagaaagaaagaaagaaagaaagaaagaaagaaagaaagaaagaaagaaagaaagaaagaaagaaagaaaatgaggtcttgccaggttcccaggctggggctggagtacagtggctattcataggtgcgatcctattactgatcagcatgggagttttgacctgctctgtttctgacctgagccagttcacccctcctcaggcaacccagtggtactccactccctggaccatactgaccctgtcggcatagtgtactacagcccagaattcacaggctcaa

SEQ ID NO: 29144 - DNA, 601 bp, Human
cagtgagctgagatcatgacattgctctagctgggcgacagtgagactccgtcaaaaaaaaaaaaaaaaaaaatttgccaggcgtgatggcacacaccagtagtcccagctactcaggaagctgaggcaggagaatcacttgaacccaggaggcaggggttgcagtgagccaagactgcaacactgtactccatctcaaaaaaaaaaagaaagaaagaaagagagagagagagagagagagagagagaaggaaagaaagaaaagaaagaaaagaaagaaaagaaagaaaagaaagaaaagaagaaagaaagaaaagaaagaaaagaaagaaagaaagaaagaaagaaagaaagaaagaaagaaagaaagaaagaaagaaagaaagaaagaaaatgaggtcttgccaggttcccaggctggggctggagtacagtggctattcataggtgcgatcctattactgatcagcatgggagttttgacctgctctgtttctgacctgagccagttcacccctcctcaggcaacccagtggtactccactccctggaccatactgaccctgtcggcatagtgtactacagcccagaattcacaggct

SEQ ID NO: 29145 - DNA, 601 bp, Human
cacggtagcacaggcctgtaatcccagctactcaggaggctgaggcaggagaatcacttgaacctgggaggcggaggttgcagtgagctgagatcatgacattgctctagctgggcgacagtgagactccgtcaaaaaaaaaaaaaaaaaaaatttgccaggcgtgatggcacacaccagtagtcccagctactcaggaagctgaggcaggagaatcacttgaacccaggaggcaggggttgcagtgagccaagactgcaacactgtactccatctcaaaaaaaaaaagaaagaaagaaaaagagagagagagagagagagagagagaaggaaagaaagaaaagaaagaaaagaaagaaaagaaagaaaagaaagaaaagaagaaagaaagaaaagaaagaaaagaaagaaagaaagaaagaaagaaagaaagaaagaaagaaagaaagaaagaaagaaagaaagaaagaaaatgaggtcttgccaggttcccaggctggggctggagtacagtggctattcataggtgcgatcctattactgatcagcatgggagttttgacctgctctgtttctgacctgagccagttcacccctcctc

SEQ ID NO: 29146 - DNA, 601 bp, Human
gagcagggcaccagggtgagtggtcagtaagacccagccgccacactgaggtaaagttggtggggagacagaccacagtcacacatcatacaggccatgatgggcaaatgtcaagggtgtacagggcaggggcatcacagctacagcacccaacccgacctgcaaggtaaggaaggattcctggaaaaaggaaccactaagctaagaccacagggcaagtgaagctcacccaggcaaagaaggaaaaacatgggtccaagctgactggaaaggcccagaggccatcataagacactgggasggggagggcccagaacagtgcacacaggccagaccacagtagtgggcaagggggtggggtttatcctttggccaatggaaagctatttgggagttttaggcacagtaatgacgtggtcagacttgggtttgttggtttatttatttatttgagaccgaatctctgtcgtccaggcaggagtgcaatggtgcaatcttggctcactgtaactgccgcccgagtccaagcgattttcctgcctcagcctcccgagtacttgggattacaggcatgcgccaccacgcccagttaatttttgta

SEQ ID NO: 29147 - DNA, 601 bp, Human
gaggcaggaagaaggaagctagggtcccatggggctacgacaagagggttccacacacacccgactcaccatccggcagcgctgctgcagcttcagcacctgggcctgcagccgagcgacctcctgctgctgccgttcatagttttccagcctgagcaccagcacctccgacagctcagccatctgttggctggcctccactggggagggcagaggacaggtcagccctggctcccctggccttcagggaccagctctggccctcccagatgcctctgtctcccccaccctcggctgctgygctgtgccagtgggtcctgcagggctttgcattcctcactcaggtcttccattcaagaaatgttcattgactgatactgagcagggcaccagggtgagtggtcagtaagacccagccgccacactgaggtaaagttggtggggagacagaccacagtcacacatcatacaggccatgatgggcaaatgtcaagggtgtacagggcaggggcatcacagctacagcacccaacccgacctgcaaggtaaggaaggattcctggaaaaaggaaccactaagctaagaccacagggcaagtga

SEQ ID NO: 29148 - DNA, 601 bp, Human
ggcctggggtccccactctgggccagtggctctccagggtgggggcagaagccggcagcgagactcacctcttcctggagctgcatctggatttccttctccgaagccagctgcttctgcaacttttcagtctcagccccatactcgaaggacccaaaaccagtgaacccccatctgaggcctacccactcagggcaccccctgcttccagcaagtcttcccaggcacatcagtgagtccttggcagcccatgaaatgacaagtcacacggaaggagggcaaagaaggcaggggagtcacrcagcctggttcctagaagactccaggaccctctctgggccttggtctcctcaagataacaaggggtcaagataaggggctctctgaggtctctgactctgacacagaaagggacctcaggcctggtggagccgagtggaggcaggaagaaggaagctagggtcccatggggctacgacaagagggttccacacacacccgactcaccatccggcagcgctgctgcagcttcagcacctgggcctgcagccgagcgacctcctgctgctgccgttcatagttttccagcctgagcaccagc

SEQ ID NO: 29149 - DNA, 601 bp, Human
gtgtcatgtgggggacccagggcaggtccctgcactccacaccactcagaccttgatggaactgtcacctgctgggctgtgccaggcatggagggggtggaaacggacaagactcagttcctgctagtcctctccagagtcaggtagctgccaagggcctggggtccccactctgggccagtggctctccagggtgggggcagaagccggcagcgagactcacctcttcctggagctgcatctggatttccttctccgaagccagctgcttctgcaacttttcagtctcagccccatactsgaaggacccaaaaccagtgaacccccatctgaggcctacccactcagggcaccccctgcttccagcaagtcttcccaggcacatcagtgagtccttggcagcccatgaaatgacaagtcacacggaaggagggcaaagaaggcaggggagtcacacagcctggttcctagaagactccaggaccctctctgggccttggtctcctcaagataacaaggggtcaagataaggggctctctgaggtctctgactctgacacagaaagggacctcaggcctggtggagccgagtggaggcagg

SEQ ID NO: 29150 - DNA, 601 bp, Human
gcaggtcctgcagctgggaacccacccacacgctctgctgggacccaggcacacccagtccagcactcctgcctatctgctctcaggctgaggccagaggcccaggttctggactccgagtgtcatgtgggggacccagggcaggtccctgcactccacaccactcagaccttgatggaactgtcacctgctgggctgtgccaggcatggagggggtggaaacggacaagactcagttcctgctagtcctctccagagtcaggtagctgccaagggcctggggtccccactctgggccagyggctctccagggtgggggcagaagccggcagcgagactcacctcttcctggagctgcatctggatttccttctccgaagccagctgcttctgcaacttttcagtctcagccccatactcgaaggacccaaaaccagtgaacccccatctgaggcctacccactcagggcaccccctgcttccagcaagtcttcccaggcacatcagtgagtccttggcagcccatgaaatgacaagtcacacggaaggagggcaaagaaggcaggggagtcacacagcctggttcctagaagactccagg

SEQ ID NO: 29151 - DNA, 601 bp, Human
caccaaggctgagacacaggcacagacgtaggaaagtgggcagccaggggagggtcctcaccagaggcacgctgtatgggtaatgggtggcagacccagtggacaccgggggttgctggcggagggtcttcacctcctcctgcatctcaatcagcatgcccccacaatccatgtacttctcccgcaggtcctgcagctgggaacccacccacacgctctgctgggacccaggcacacccagtccagcactcctgcctatctgctctcaggctgaggccagaggcccaggttctggactccragtgtcatgtgggggacccagggcaggtccctgcactccacaccactcagaccttgatggaactgtcacctgctgggctgtgccaggcatggagggggtggaaacggacaagactcagttcctgctagtcctctccagagtcaggtagctgccaagggcctggggtccccactctgggccagtggctctccagggtgggggcagaagccggcagcgagactcacctcttcctggagctgcatctggatttccttctccgaagccagctgcttctgcaacttttcagtctcagccccatac

SEQ ID NO: 29152 - DNA, 601 bp, Human
ccagaggacccccacagaacccccacccataggctcaggcacagaagggaactgggatctcaatcagccaccaaggctgagacacaggcacagacgtaggaaagtgggcagccaggggagggtcctcaccagaggcacgctgtatgggtaatgggtggcagacccagtggacaccgggggttgctggcggagggtcttcacctcctcctgcatctcaatcagcatgcccccacaatccatgtacttctcccgcaggtcctgcagctgggaacccacccacacgctctgctgggacccaggyacacccagtccagcactcctgcctatctgctctcaggctgaggccagaggcccaggttctggactccgagtgtcatgtgggggacccagggcaggtccctgcactccacaccactcagaccttgatggaactgtcacctgctgggctgtgccaggcatggagggggtggaaacggacaagactcagttcctgctagtcctctccagagtcaggtagctgccaagggcctggggtccccactctgggccagtggctctccagggtgggggcagaagccggcagcgagactcacctcttcct

SEQ ID NO: 29153 - DNA, 601 bp, Human
tctcctggaaaccaggaagagtctcctatggtggagagaacagacgttaccagaggacccccacagaacccccacccataggctcaggcacagaagggaactgggatctcaatcagccaccaaggctgagacacaggcacagacgtaggaaagtgggcagccaggggagggtcctcaccagaggcacgctgtatgggtaatgggtggcagacccagtggacaccgggggttgctggcggagggtcttcacctcctcctgcatctcaatcagcatgcccccacaatccatgtacttctcccrcaggtcctgcagctgggaacccacccacacgctctgctgggacccaggcacacccagtccagcactcctgcctatctgctctcaggctgaggccagaggcccaggttctggactccgagtgtcatgtgggggacccagggcaggtccctgcactccacaccactcagaccttgatggaactgtcacctgctgggctgtgccaggcatggagggggtggaaacggacaagactcagttcctgctagtcctctccagagtcaggtagctgccaagggcctggggtccccactctgggccagt

SEQ ID NO: 29154 - DNA, 601 bp, Human
agccacgcacctctccataaaatacacagggtctgagatcatcctccttagagacgttctgagctcctcagccagcgtctcctggaaaccaggaagagtctcctatggtggagagaacagacgttaccagaggacccccacagaacccccacccataggctcaggcacagaagggaactgggatctcaatcagccaccaaggctgagacacaggcacagacgtaggaaagtgggcagccaggggagggtcctcaccagaggcacgctgtatgggtaatgggtggcagacccagtggacacygggggttgctggcggagggtcttcacctcctcctgcatctcaatcagcatgcccccacaatccatgtacttctcccgcaggtcctgcagctgggaacccacccacacgctctgctgggacccaggcacacccagtccagcactcctgcctatctgctctcaggctgaggccagaggcccaggttctggactccgagtgtcatgtgggggacccagggcaggtccctgcactccacaccactcagaccttgatggaactgtcacctgctgggctgtgccaggcatggagggggtggaaacg

SEQ ID NO: 29155 - DNA, 601 bp, Human
actacaaaaattagctgggcttggccaggtgcagtggctcacgcctataatcccaacactttgagaggcccaggcgggtggatcacaaggtcaggagttcaagactagcctggccaacatctctactggcccatctctactaaaaatacaaaaattagccgggcgtggtgatggccacctgtagtcccagctactcaggaggctgaggtaggagaatcgcttgaacccaggaggcggaggttgcagtaagccgagatcacgccaacctggacaacaaaacaagactccatctcaaaaaaamaaaaaaaaaattagccaggctcgtgcctgtagtcccaactacttggaaggctgaggcaggagactcgcttgaacccaggagatggaggttgcagtgagccaagatctcgccactgcactccagtccaggtgacagagtgagactcgtctcaaaaaaaaaaaaaaacctcaggctgggcatgatggctcacgcctgtaatcccagcactttgggaggctgaggcgggcagatcacctgaggtcaggagcttgagaccagcctggccaacagggtgaaactgtgtctctactaaaaatacaa

SEQ ID NO: 29156 - DNA, 601 bp, Human
tactaaaactacaaaaattagctgggcttggccaggtgcagtggctcacgcctataatcccaacactttgagaggcccaggcgggtggatcacaaggtcaggagttcaagactagcctggccaacatctctactggcccatctctactaaaaatacaaaaattagccgggcgtggtgatggccacctgtagtcccagctactcaggaggctgaggtaggagaatcgcttgaacccaggaggcggaggttgcagtaagccgagatcacgccaacctggacaacaaaacaagactccatctcaaaaaaaaaaaaaaaaaattagccaggctcgtgcctgtagtcccaactacttggaaggctgaggcaggagactcgcttgaacccaggagatggaggttgcagtgagccaagatctcgccactgcactccagtccaggtgacagagtgagactcgtctcaaaaaaaaaaaaaaacctcaggctgggcatgatggctcacgcctgtaatcccagcactttgggaggctgaggcgggcagatcacctgaggtcaggagcttgagaccagcctggccaacagggtgaaactgtgtctctactaaa

SEQ ID NO: 29157 - DNA, 601 bp, Human
tttgaggggctggaaagtccaaccccccaggcccacccccacccgtctccacacagaccctgatggttcctcctggttctgtcccagccaggggagaggggagctaggtaccagctccaaggcttcaaatacccagcccatccccctggtgggagggaggaagaatggtcaccaacactgcataggccccatcttcttttatgtccctgaccctgcacggaatacaccaacagggttaacacccacttctgcctccctcctgcatgatttaaccttcatagcccaccccacagctacttgmcataggaacaaatccattctagacaggctcagacaggtcaaatgacttgcccaaggacacacagtcaggaaagggaccacgctgggccttagtcccaggtgttcccagctcctaagccagtgcctgtcacctctcagcccatagtcagttgaaaagaaagcttcagtccccactcagagctgcctggaatcagacggccacccagggggcaagatttgaaggaaaagtggggcagctccttcccagaacagttctcagttcagccagccgagatagcagggccttctccggagttgcagg

SEQ ID NO: 29158 - DNA, 601 bp, Human
ggcagggagggccccgtgggggcactcacctttctggagcatcttccacctcagctgccgcctgtaatgggcatcttgccagttggccagctgctggaggacataattcatgtccaggtgtgaagggcccaagccgctggcctccagggctgatgtcaccacgttcatccgcgttgcctcatccagctccagttccacctcctcccagccctcggtctcctctgacaccagctctgcctcttccatcaccccttcctcagccggcaccttcttggcagcccccagctcctcctggggcacsaactcctccgcaggcgtgaaatcttccccccgcatgatatccgctgccagcatcaacccttcctcagcctcaaacccccgcacctgctctcgatcctcactgtagcgaaaatcatacctgggcgggagatagcgacatcttttgaggggctggaaagtccaaccccccaggcccacccccacccgtctccacacagaccctgatggttcctcctggttctgtcccagccaggggagaggggagctaggtaccagctccaaggcttcaaatacccagcccatccccctggtgggagggagg

SEQ ID NO: 29159 - DNA, 601 bp, Human
actttggggtttctggctggggagaggagaccctgttccaccccacaaccctgcaggaggccctagcccaccttctgacacccaggggactgttccaactgtggcccttgctggtgaaggcctttgtccccatagcctgggcagtcccagaaggcctctcttcctcccaggccgtgggagggtggctggtcctgtcctccagcctgggtcagcccccaggctgctccaccatcccacccaccgccccccgtgtttgttttgactgctgctgccactgctgcagagttggagagcctggggkatagaggaggcaggggttgggggtaggggaagcaagcgggcagagatgggaagctgaggcgcagtgtgggggcacagtcccagccctaacccccagcccagcccccaggagaaaagtggatggagatctggaatcctaagcaaatgccacataaatgagcactgacactacggttcccactgaaggggatcagaggtgtctatgcaaatgatatgcaaagtccatgcaaataagcacagcaggtagagccaggctggggcaggtgagcactcggggagcttatccaccctctcttttcat

SEQ ID NO: 29160 - DNA, 601 bp, Human
ccactgggcagaggggccctcacccacccacacacagagacacttgtggttacaaacagtaggtagggactgagaagaaaggatgaagaacagggaagacagccaggtccctcaagtcaacaagaaccagggtggctaccattagcatgggcatcaaggggtgaggggcacattgttgggaaggcgctcacaactccctgccggtggaagctgggccctgttccctgctcagggctgagtctggtagccagcgggcctctcccgggcttctcctgccccctgggctgccatgtggcccagrcctggcagccacagcttttgcaccagctgcagagcgagggccggggttcctaccgcctgtccctgaagacgttggaaaagcctccaacatgtgggaaagggcagaacatggaagaggaagccaggggcagggaggggtccccaagctccagcccaggttcatgaacacagagggtgggctggtgacagacacagggtcccatttcagaggatgggaaggagggtctgcgggtgtggggcttggccaggcagcaggaggggcctcaagctgtctgtggggcctctgcaggctgctggggaa

SEQ ID NO: 29161 - DNA, 601 bp, Human
gacacccccaggccactggcagaagagggagggagggagaggagacacaccactgggcagaggggccctcacccacccacacacagagacacttgtggttacaaacagtaggtagggactgagaagaaaggatgaagaacagggaagacagccaggtccctcaagtcaacaagaaccagggtggctaccattagcatgggcatcaaggggtgaggggcacattgttgggaaggcgctcacaactccctgccggtggaagctgggccctgttccctgctcagggctgagtctggtagccagygggcctctcccgggcttctcctgccccctgggctgccatgtggcccaggcctggcagccacagcttttgcaccagctgcagagcgagggccggggttcctaccgcctgtccctgaagacgttggaaaagcctccaacatgtgggaaagggcagaacatggaagaggaagccaggggcagggaggggtccccaagctccagcccaggttcatgaacacagagggtgggctggtgacagacacagggtcccatttcagaggatgggaaggagggtctgcgggtgtggggcttggccaggcag

SEQ ID NO: 29162 - DNA, 601 bp, Human
agcatccaccctttctctacaacttcgccctgccaagtgcacacacacactccctagagagacagctggaggctgggccaggagggtatagatcctttatttcctgcaccacacgcacacaggctgacaagcaataggagattgagaggtgctgtgtgaaggggggcaggtacctgcaggaggcctcagtcccagcccccagctattgaggaacaaaggtgtgggaaagggcagaacatggaagaggaagccaggggcagggagggggggatcaagacagaggggagaggggctgggccayggatgggagcctggacacccccaggccactggcagaagagggagggagggagaggagacacaccactgggcagaggggccctcacccacccacacacagagacacttgtggttacaaacagtaggtagggactgagaagaaaggatgaagaacagggaagacagccaggtccctcaagtcaacaagaaccagggtggctaccattagcatgggcatcaaggggtgaggggcacattgttgggaaggcgctcacaactccctgccggtggaagctgggccctgttccctgctcagggctga

SEQ ID NO: 29163 - DNA, 601 bp, Human
cctttatcctcagggatgagtgggcatggagccccaggcagggttgtggtcaccctgccaatcagctttgccagctctggcttagggtggggcccctcatccctgaagtgggagctcaagcccaggagggagggcagggggatgggggtctttgtgccccctcccacccatatccttcaacttcacacttaccttggggacatatctgggccagggggaactccatgagggcagcctcacaagggatcccagagcagggtgtgtgtatgtgttccggaaaggtgtgcacactcagcaactmatcatctctcctctcaccctggccccgggggcaggaaatgtcgccttacccacagccttagttctggcgaggactcacgtcatggaaagccttaagacgattgtcccacccccggaagccacgcagctgtagatagcggtggtatagcggtggggggtatctgtgtcactctgtgtttaggtgttaggaagcccttactgctgcctgaccttcatccctccagattctttctctgccccctcaccccaaactagaacttccctttctctctctctctctctctctctctctctctctctc

SEQ ID NO: 29164 - DNA, 601 bp, Human
acctttatcctcagggatgagtgggcatggagccccaggcagggttgtggtcaccctgccaatcagctttgccagctctggcttagggtggggcccctcatccctgaagtgggagctcaagcccaggagggagggcagggggatgggggtctttgtgccccctcccacccatatccttcaacttcacacttaccttggggacatatctgggccagggggaactccatgagggcagcctcacaagggatcccagagcagggtgtgtgtatgtgttccggaaaggtgtgcacactcagcaacwcatcatctctcctctcaccctggccccgggggcaggaaatgtcgccttacccacagccttagttctggcgaggactcacgtcatggaaagccttaagacgattgtcccacccccggaagccacgcagctgtagatagcggtggtatagcggtggggggtatctgtgtcactctgtgtttaggtgttaggaagcccttactgctgcctgaccttcatccctccagattctttctctgccccctcaccccaaactagaacttccctttctctctctctctctctctctctctctctctctct

SEQ ID NO: 29165 - DNA, 601 bp, Human
aatgcactgggcaaatggtcactgacacagagtgcagatgcctgcttctgggactcaatgcactgcaccctggtcatctgcggactcagcctgagcttccagagggcctaggagcagtaagggagtgagtgggcaactcggcgcatgaaggaggtactcctcattttcgttctctctctctgtgccccagcccgttggcagacccggatcattcctgccttctcttggagtggcctttgtccatctgcaagtccttccccatgggagggtgggagagatgagggactgcaccgcgctgccrccccaggtttccactcaccgcagtgtagcccaggttctggcagctcctgcgggtcatgtctgtgatctggaaggtgctgaaggttgggatgggggcttcgtgactccctgtgagcacaaagagggctgccggggtttctcagagaggaactatgtctgtctctgcctcccacccctcctcccaggctcaggggatctggagggctgggacagtcttaacgacaggaaaaacgcagaagggcagcaggggagtttctcaggcatgaggttaagtagccaaggcggcatggggggctaatgc

SEQ ID NO: 29166 - DNA, 601 bp, Human
gaatgtggaatgcactgggcaaatggtcactgacacagagtgcagatgcctgcttctgggactcaatgcactgcaccctggtcatctgcggactcagcctgagcttccagagggcctaggagcagtaagggagtgagtgggcaactcggcgcatgaaggaggtactcctcattttcgttctctctctctgtgccccagcccgttggcagacccggatcattcctgccttctcttggagtggcctttgtccatctgcaagtccttccccatgggagggtgggagagatgagggactgcaccrcgctgccaccccaggtttccactcaccgcagtgtagcccaggttctggcagctcctgcgggtcatgtctgtgatctggaaggtgctgaaggttgggatgggggcttcgtgactccctgtgagcacaaagagggctgccggggtttctcagagaggaactatgtctgtctctgcctcccacccctcctcccaggctcaggggatctggagggctgggacagtcttaacgacaggaaaaacgcagaagggcagcaggggagtttctcaggcatgaggttaagtagccaaggcggcatggggg

SEQ ID NO: 29167 - DNA, 601 bp, Human
acagagtcattccctggcctggaggatgaagaaacatgacgcaggaagtcaccctagaggccagaatgagggagggcttacttcataatatgagggactgacctagttcgcagggaaaattattgactgggcaggagagaaggactgagacgggaatgtggaatgcactgggcaaatggtcactgacacagagtgcagatgcctgcttctgggactcaatgcactgcaccctggtcatctgcggactcagcctgagcttccagagggcctaggagcagtaagggagtgagtgggcaactcrgcgcatgaaggaggtactcctcattttcgttctctctctctgtgccccagcccgttggcagacccggatcattcctgccttctcttggagtggcctttgtccatctgcaagtccttccccatgggagggtgggagagatgagggactgcaccgcgctgccaccccaggtttccactcaccgcagtgtagcccaggttctggcagctcctgcgggtcatgtctgtgatctggaaggtgctgaaggttgggatgggggcttcgtgactccctgtgagcacaaagagggctgccggggtttct

SEQ ID NO: 29168 - DNA, 601 bp, Human
agtgggccttctcctgactttgatccacctgccaccttcttttcctcatacccagcctctcctgtctattttagggtacaattgcccagaaagtccttcctaaagtctaacttaaatcccttcttcagctccagctgttctggcttccagagactctccttcctttgccctctgggtcctgagggcttttaatccagcagcagtgagctgtcacactgtgctctaggaggggcgggaaaggcagcacagccttccagatggacagagtcattccctggcctggaggatgaagaaacatgaygcaggaagtcaccctagaggccagaatgagggagggcttacttcataatatgagggactgacctagttcgcagggaaaattattgactgggcaggagagaaggactgagacgggaatgtggaatgcactgggcaaatggtcactgacacagagtgcagatgcctgcttctgggactcaatgcactgcaccctggtcatctgcggactcagcctgagcttccagagggcctaggagcagtaagggagtgagtgggcaactcggcgcatgaaggaggtactcctcattttcgttctctctct

SEQ ID NO: 29169 - DNA, 601 bp, Human
tcagcagcccggggaatgagctaagagcccggctcctcacgggatcagacccaagccccgcccctcccgagccccgccttgtgtcgcccggcgcggggcctcgcccctcacctgtaagtcagcacgaaggtcaccgcgctctcgctgaaccgcaccaagtagcacccctgaggcttgggctccagcagcctctctgcctccctgtgggtgacggagagagggggccgaaccctgctctgacacttccagcctcgcctctgtctccccggctctcacgaggaacccctacccccaagcaagmatgctggagcggctagagaaaggctagggcggagatggggagagagagcacgtgggcgctgctctcccgctgcagggattaggcgtggacaggggccaggggtcccattcaggagacccccgcatcctcccctggcctcatcctgaaagggcagcctgcaggggctgctactgcagctacagggatgggaaagtagttggacttccagatttcagaagtcaaagctgaactgaggaggtgaacaaagagttagggagaaatgaggctgagaaatggaggagggagattctgcaagggtgg

SEQ ID NO: 29170 - DNA, 601 bp, Human
tttagaatttactacaggaggtagaggaaagttagtagctttacttaatgtagtaagctcaaagtcaaaaccctggctaaacatgcaaaattggtttcctaatccttttttagtcttctgtgtctgaggactgtgttaggagattcaataccttctccccactccaacattccttttctgcaggtccagaatggctacaacagtccctgatggttgccgcaatggcctgaaatccaagtactacagactttgtgataaggctgaagcttggggcatcgtcctagaaacggtggccacagcyggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctg

SEQ ID NO: 29171 - DNA, 601 bp, Human
gagaccagcttgggcaaaatagcaagacttcatctctatttaaaaaaaaaaaaaaaaaaaaaaaaagaatcaagtgattttgctcttatctggagttgagacaagccagatgttctcgtgttgttttcataagcaaaagaggctaaactgatggccagaaagtactcctgctcatagggacctattcattggtctccagggtttacactgacctttaagtctaatcacagggggtgggtggttttgggataggaatgaggaacctccaaggccatgttcttagctccagctaaaaataggkctttcctttgctcttaagcctgaggtgtggaacttcctggtgctactcactgcagctatggtccctgtctagggcacttggaagtctgaagggaggcggaggagggcaggaggggttatttaaccacccagcccctcctgtccgttccgtggcttcactccatcacctcactcctgtacttcctgttctcattcactgatgagtcttccttccttcattcatttcaagggccactgtcagctttctcccttaaaatgcttctctggcctccatgctttgctgctcactttcctccctggg

SEQ ID NO: 29172 - DNA, 601 bp, Human
caggatcaggcattccccagtttcccctggtaatcactccaccctgtgcatctgtaggactttgaaatgctcttatcagggtctgtctcattgcactgttatttatgtacctgtcatatgttccttactctccagtgtcagctgcaaggagggatcattctggttaatctttatgtgcttcaccatctctctcttttttttttttttttgagacagagtctcgctctgtcacccaggctggagtgcagggacataatcttggctcgccacaagctctgcctcccaggttcaagcaattctyctgcctcagcctcccgagtagctgggattacagacgtgcaccattatgcccaactaatttttttgtgtttttagtagagacggggtttcaccatcttggccaggctggtctcgaactcctgacctcatgatccgcccgcctaggccttccaaagtgctgggattacaggcatgagccaccgtgcccagccacgatctcttaaataaaggcgtttaagtgtttgttcagcaaattgggcccataaatttggtgggaaataaatgaattgctttgaactgcattcatgatgattgcatgtgt

SEQ ID NO: 29173 - DNA, 601 bp, Human
ctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatccttwggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcc

SEQ ID NO: 29174 - DNA, 601 bp, Human
tcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctytaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaa

SEQ ID NO: 29175 - DNA, 601 bp, Human
catctctaagattatcaacattggcaattttgcctcaaggttgagaaatataaaaagaaattatggaggcaaattgtgaaatttaacatcttcagagaataagataggccttcagtaggaagagaagtgtatgtatctgactagcagcctggaagatatgtctgcccaccccttcctcagtttgagaacctcaggagccatcctaactggtgggcaaaagaaagatgcaaagagctctcaaggtccctgtagcccaataaagccatgatctttataagcatccttaacagtaaggctgccaaaaaaaaagcacaaagtggggcaaatactctgcaaatagagtcatgcagtttctgtccggtaggtggaagtaccacccaggccttgatcctgcttctgttatctctgttcccatagcgttaccactagttgtgtaccaagagtgctcttctgtttctcaagccaaaaggagtttattggtataagaattgtgagtcttttcacttaagcatttacagaaagctgggcacagtggctcatgcctgtaatcccagcactttgggaggctaaggcgggcggatcacctgaggtcaggagttcg

SEQ ID NO: 29176 - DNA, 601 bp, Human
gagccatcctaactggtgggcaaaagaaagatgcaaagagctctcaaggtccctgtagcccaataaagccatgatctttataagcatccttaacagtaaggctgccaaaaaaaaagcacaaagtggggcaaatactctgcaaatagagtcatgcagtttctgtccggtaggtggaagtaccacccaggccttgatcctgcttctgttatctctgttcccatagcgttaccactagttgtgtaccaagagtgctcttctgtttctcaagccaaaaggagtttattggtataagaattgtgaktcttttcacttaagcatttacagaaagctgggcacagtggctcatgcctgtaatcccagcactttgggaggctaaggcgggcggatcacctgaggtcaggagttcgagaccagcctggccaacatggtgaaacccatgtctctactaaaaatacaaaaattagccaggcgtggtggcaggcacctgtaattctagctatttgggaggctgaagcaggagaatcacttgaacctgggaggcagaggttgcaatgagccaagatcacgccattgcactccagcctgggaaatacagcaagac

SEQ ID NO: 29177 - DNA, 601 bp, Human
tcaagccaaaaggagtttattggtataagaattgtgagtcttttcacttaagcatttacagaaagctgggcacagtggctcatgcctgtaatcccagcactttgggaggctaaggcgggcggatcacctgaggtcaggagttcgagaccagcctggccaacatggtgaaacccatgtctctactaaaaatacaaaaattagccaggcgtggtggcaggcacctgtaattctagctatttgggaggctgaagcaggagaatcacttgaacctgggaggcagaggttgcaatgagccaagatsacgccattgcactccagcctgggaaatacagcaagactctctccaaaaaacaaaaaacattttaccgaaactccactccctggcaaatcttagttcccagaatcatagaattttagagccaggaaaggccatggagatcacagaatttaaccccctcaattacagataaggaaacaggcaaagagatggccgggcaactccctcaaggttagccaacaagtcagtggaaagatcaactctaggtccttgacttcctgtccagttctcttttcactctatatatagactacagagcaataa

SEQ ID NO: 29178 - DNA, 601 bp, Human
aaccccctcaattacagataaggaaacaggcaaagagatggccgggcaactccctcaaggttagccaacaagtcagtggaaagatcaactctaggtccttgacttcctgtccagttctcttttcactctatatatagactacagagcaataatggtagggtgacttaattgaatgactgaaactataccacaatgtcagtatgaatttaggaaacaaggaaggtatcagagggaaacacaggaaggtttctggaagtctatatcccaaagctatgtatgtggggataagggtggataaaayatctatcaaggaaaatctgttttaaaaacatacataagcatataatacaacctgctttaattaatgcagaaattaatgaacaaatgtaaaaatgcctttaaaaatttacaaagcatacatgagtaagttcatattttagccctgttactgtgatcatagacaagttacttctctgagcctcaggcctcccatctattaaaatgaggctggtaaaattaacctcatagtggttgtggtatgctgtctggcacgtagtaggagctcattaaatgatggctatcactgctatggaaagttggt

SEQ ID NO: 29179 - DNA, 601 bp, Human
gacttcctgtccagttctcttttcactctatatatagactacagagcaataatggtagggtgacttaattgaatgactgaaactataccacaatgtcagtatgaatttaggaaacaaggaaggtatcagagggaaacacaggaaggtttctggaagtctatatcccaaagctatgtatgtggggataagggtggataaaatatctatcaaggaaaatctgttttaaaaacatacataagcatataatacaacctgctttaattaatgcagaaattaatgaacaaatgtaaaaatgcctttaaaaatttacaaagcatacatgagtaagttcatattttagccctgttactgtgatcatagacaagttacttctctgagcctcaggcctcccatctattaaaatgaggctggtaaaattaacctcatagtggttgtggtatgctgtctggcacgtagtaggagctcattaaatgatggctatcactgctatggaaagttggtggtgcagtacctacctctcaggattcttgatctcttcagtgacatagttgagggtgtcccagcctgagtaggagaacagagctgagtacagtgccagggc

SEQ ID NO: 29180 - DNA, 601 bp, Human
aagttcatattttagccctgttactgtgatcatagacaagttacttctctgagcctcaggcctcccatctattaaaatgaggctggtaaaattaacctcatagtggttgtggtatgctgtctggcacgtagtaggagctcattaaatgatggctatcactgctatggaaagttggtggtgcagtacctacctctcaggattcttgatctcttcagtgacatagttgagggtgtcccagcctgagtaggagaacagagctgagtacagtgccagggcaatgtcacccactgcaaatgatgarccctcaaaggaattctcaaaatgagtagaggctcctggaacccaagaacattggaaggcaggggattagtggctcattctcccacttcaagatggtcaagtaaaggactgacagaatatggtaatataatagcaggtaagtggcctacaacacctttggcagcaagagtaccagtaagggaacaggaaacagaagagagacgtctatagagatagaccagaatgccctgcatcctaatgacatagatggggatcttgacaggaagggtccagggtagctttctaggataagaaaccacca

SEQ ID NO: 29181 - DNA, 601 bp, Human
ccagtaagggaacaggaaacagaagagagacgtctatagagatagaccagaatgccctgcatcctaatgacatagatggggatcttgacaggaagggtccagggtagctttctaggataagaaaccaccatagagcagaaaagctggagaatagaaacaatgcagttctgttctgctctgcaggctgcctgattcctgcctcctatcacaatctgccaaaggcagctcccagggcatggctgtcaaccctttgccaagatcagcctcctctgggaggcagcgtgcatggaagttaaaggayagacttttgggtcagttgtcctggatacaaatttcaactcctctacttaccggtagcaacttgggcaagatatttaattcttttttttttttgggggggggacagagtctcgctctgtcgcccaggctggagtgcagtggcgtgatctcagctcactgcaaccaccgcctcctggattcaagcgattctcctgcctcagcctcccgagtagctgggattacaggcgcctgccaccatgcccggctaatttttgtatttttagtcgagatggggtttcaccatcttggccaggctgatctt

SEQ ID NO: 29182 - DNA, 601 bp, Human
agggtccagggtagctttctaggataagaaaccaccatagagcagaaaagctggagaatagaaacaatgcagttctgttctgctctgcaggctgcctgattcctgcctcctatcacaatctgccaaaggcagctcccagggcatggctgtcaaccctttgccaagatcagcctcctctgggaggcagcgtgcatggaagttaaaggatagacttttgggtcagttgtcctggatacaaatttcaactcctctacttaccggtagcaacttgggcaagatatttaattcttttttttttttkggggggggacagagtctcgctctgtcgcccaggctggagtgcagtggcgtgatctcagctcactgcaaccaccgcctcctggattcaagcgattctcctgcctcagcctcccgagtagctgggattacaggcgcctgccaccatgcccggctaatttttgtatttttagtcgagatggggtttcaccatcttggccaggctgatcttgaactcctgacctcatggatccacccgcgatggcctcccaaagtgctgggattacaagcacgagccactgcgcccggcccaaggtacttaatt

SEQ ID NO: 29183 - DNA, 601 bp, Human
gggtccagggtagctttctaggataagaaaccaccatagagcagaaaagctggagaatagaaacaatgcagttctgttctgctctgcaggctgcctgattcctgcctcctatcacaatctgccaaaggcagctcccagggcatggctgtcaaccctttgccaagatcagcctcctctgggaggcagcgtgcatggaagttaaaggatagacttttgggtcagttgtcctggatacaaatttcaactcctctacttaccggtagcaacttgggcaagatatttaattcttttttttttttgggggggggacagagtctcgctctgtcgcccaggctggagtgcagtggcgtgatctcagctcactgcaaccaccgcctcctggattcaagcgattctcctgcctcagcctcccgagtagctgggattacaggcgcctgccaccatgcccggctaatttttgtatttttagtcgagatggggtttcaccatcttggccaggctgatcttgaactcctgacctcatggatccacccgcgatggcctcccaaagtgctgggattacaagcacgagccactgcgcccggcccaaggtacttaattc

SEQ ID NO: 29184 - DNA, 601 bp, Human
ggcgaagcagctcgggaagagaggctgtaccatgtagttggcaaaggtgatggcaatgatggcctggctggtgggctcaatgatgagcagggaggtccagagtctgatgaaagcaaggaatcctccaaaggcctccaggatataggcatagctggccccagatttcttaatggtggtgcccagttccgcataacaaagggccccaaagacggagaagaggcccccgacagcccagatgaccagagagagaccaaaggaggcactgtatatgagcacacccttgggggaaacaaagatgccygagccgatcatgttccccacaatcaggcacacgccgttaagcagtgagatctccttcttcagcttcacctgctccggccctgggctggccccatcacccaaaggggaggtttccacctcaggctgggaggccacttcatactcagtgctgtcaaccatggtggaggagaggaaacccttcaccagcttcctggcattgccctttaaggaagaaagatgatgctatagattaggtggttggcaattacatagaacctctacccgcctccaacacagggtaatacgggcagctcaccaacca

SEQ ID NO: 29185 - DNA, 601 bp, Human
ccaaaggaggcactgtatatgagcacacccttgggggaaacaaagatgcccgagccgatcatgttccccacaatcaggcacacgccgttaagcagtgagatctccttcttcagcttcacctgctccggccctgggctggccccatcacccaaaggggaggtttccacctcaggctgggaggccacttcatactcagtgctgtcaaccatggtggaggagaggaaacccttcaccagcttcctggcattgccctttaaggaagaaagatgatgctatagattaggtggttggcaattacatwgaacctctacccgcctccaacacagggtaatacgggcagctcaccaaccaatgcggagacctccaaataaccttttctccagctcactcatcaaaacaaccccaacttgaatatttgtctatctatctatgtatttatttatttattgacagagtctcgctctgtagcccaggctggagtgcagtggtgcaatctcggctcggctcactgcaacctcagcctcccgggttcaagcgcttctcttgcctcagcctcccaagtagctgggattacaggcacctgccaccacgcgtggctaat

SEQ ID NO: 29186 - DNA, 601 bp, Human
gagccgatcatgttccccacaatcaggcacacgccgttaagcagtgagatctccttcttcagcttcacctgctccggccctgggctggccccatcacccaaaggggaggtttccacctcaggctgggaggccacttcatactcagtgctgtcaaccatggtggaggagaggaaacccttcaccagcttcctggcattgccctttaaggaagaaagatgatgctatagattaggtggttggcaattacatagaacctctacccgcctccaacacagggtaatacgggcagctcaccaaccamtgcggagacctccaaataaccttttctccagctcactcatcaaaacaaccccaacttgaatatttgtctatctatctatgtatttatttatttattgacagagtctcgctctgtagcccaggctggagtgcagtggtgcaatctcggctcggctcactgcaacctcagcctcccgggttcaagcgcttctcttgcctcagcctcccaagtagctgggattacaggcacctgccaccacgcgtggctaattttttttttttttttttgagatggagttttgctcttgttgcccaggctgga

SEQ ID NO: 29187 - DNA, 601 bp, Human
atcacttgagcccgggaggcagaggttgcggtaagctaagactgggccattgcactccagcctgggcaacaagagcaaaactctgtctcaaaaaaaaaacaaaatcaaaaacaaaacactaaatgttggttctctctgagcctgctataatacaagacaggcatgggggcagtgtggcggctcccagaaaataactataatggcttgaccccgagttttcagccttatccaaaacccgtcttccctccaatttcagcttcagggatcacctgtgctgaggtacaacattaggaactgaccytaccagcagctaatctgtgggagcgtctcatgacactgctcttttccccaaggactctacgtctgccaaaactaaaggcttcagaaacctgctggaaacccacaaccatcctcctgcccaaagagcatcccttaacccttagctggagtcttcagccctggcaaagcccaagtagacccacttcaccctgaaagaagacaggctattatcttttccttgcttttcctttcccattctctggtattctaagcctcctgctatcgatccctcacatcagcatcgttgaatcacccaaaaaag

SEQ ID NO: 29188 - DNA, 601 bp, Human
gatcacctgtgctgaggtacaacattaggaactgaccctaccagcagctaatctgtgggagcgtctcatgacactgctcttttccccaaggactctacgtctgccaaaactaaaggcttcagaaacctgctggaaacccacaaccatcctcctgcccaaagagcatcccttaacccttagctggagtcttcagccctggcaaagcccaagtagacccacttcaccctgaaagaagacaggctattatcttttccttgcttttcctttcccattctctggtattctaagcctcctgctatcratccctcacatcagcatcgttgaatcacccaaaaaagtatgaatgagagaagggcgatccaatgtaccataaaacctagggatgattggaggcagctgatggccactccctaccccagagttgctgctggagagatatcaccccgagccaaggcagggagacagctgcagccaggcagcacatgctggaaaacaccgaacaggagacagctgagaggaaaatgggagaggctagtcaagcaatggagagatgttagggtgagaggcactcgggagaagaagcgattagacactgcacagc

SEQ ID NO: 29189 - DNA, 601 bp, Human
cactccctaccccagagttgctgctggagagatatcaccccgagccaaggcagggagacagctgcagccaggcagcacatgctggaaaacaccgaacaggagacagctgagaggaaaatgggagaggctagtcaagcaatggagagatgttagggtgagaggcactcgggagaagaagcgattagacactgcacagcagcaaagaggagggttagcaaggtaagtggagatgagaagagggtggaacgcacactcactccttggtcctggatataagcaggttctcacggcagtgtgagcrgcagtcagggagagaagtgccttccaggatctgtggtctgatgctcctccttcccagccagcagtaaaagggaaggccagacaaatgcctatggatttaagcaagaagggtggaggaggtgaggcagcccgcaaaggaaggagtgagggagggggaaaggagtattaagcaaccatctgggtccaaggttcactggcccttcacatctgcaaaaggggcagctaggagctcttggctcagcactttctgtgataagaaggtgctctctcaggaatctcctttgtcagctctgctctggga

SEQ ID NO: 29190 - DNA, 601 bp, Human
ctcctttgtcagctctgctctgggaccaggggcccagaagaaaggacagtcagctgagtgcagtatctgtagccctggggaagctgtcccagagcaagttagctgaggacaggacagtagcggggaaggaatacacagcactctctctctctgtgtcctccatgccccaccctagcctctcttctctctcaccccaagcatttaagaaagggaggaaggttgcacagtgtgacacaaaggcttgttcccatgctgagattacaggaagtgtaagagcagtctctacaccatgtgactgggygttctaagagaactctgcacacttccccatgcaaagagagactggggggttgcctccaagcctgggccactgccccaaagtctgagcctcagactacttcaaaagaaacacagtcaagagatcaaatatctgactgcatccccaccagacccacgtgccttttcattcttgacaaaacataccaagatctctgggataagcataaattcctataaacgccttcctcaaatataagttgactccactttcctaaaaaatatgaggaaatcaggccagacgcggtggctcacgcctgtaatc

SEQ ID NO: 29191 - DNA, 601 bp, Human
gtgactgggtgttctaagagaactctgcacacttccccatgcaaagagagactggggggttgcctccaagcctgggccactgccccaaagtctgagcctcagactacttcaaaagaaacacagtcaagagatcaaatatctgactgcatccccaccagacccacgtgccttttcattcttgacaaaacataccaagatctctgggataagcataaattcctataaacgccttcctcaaatataagttgactccactttcctaaaaaatatgaggaaatcaggccagacgcggtggctcacrcctgtaatcccagcactttgggaggctgaggcaggcggatcacaaggtcaggagatcaagaccatcctggctaacacggtgaaaccccgtctctactaaaaacacaaaaaaataaaaattagccgggcgtggtggcgggcacctgtagtcccagctattcgggaggctgaggcaggagaatgaggagaatggcatgaacccgggaggcggagcttgcagtgaacccacattaggccactgcactccagcctgggcaacacagcaagactccatctcaaaaaaaaaaaaaattaaaaaaga

SEQ ID NO: 29192 - DNA, 601 bp, Human
atcaaatatctgactgcatccccaccagacccacgtgccttttcattcttgacaaaacataccaagatctctgggataagcataaattcctataaacgccttcctcaaatataagttgactccactttcctaaaaaatatgaggaaatcaggccagacgcggtggctcacgcctgtaatcccagcactttgggaggctgaggcaggcggatcacaaggtcaggagatcaagaccatcctggctaacacggtgaaaccccgtctctactaaaaacacaaaaaaataaaaattagccgggcgyggtggcgggcacctgtagtcccagctattcgggaggctgaggcaggagaatgaggagaatggcatgaacccgggaggcggagcttgcagtgaacccacattaggccactgcactccagcctgggcaacacagcaagactccatctcaaaaaaaaaaaaaattaaaaaagaatatgaggaaatcagatttcactgaattctgttggacagacaggcccagaacaggcagaggaagctgagcactttttggaaatcacatagtttatgctatctttattatttactttaaatctggtattct

SEQ ID NO: 29193 - DNA, 601 bp, Human
actccactttcctaaaaaatatgaggaaatcaggccagacgcggtggctcacgcctgtaatcccagcactttgggaggctgaggcaggcggatcacaaggtcaggagatcaagaccatcctggctaacacggtgaaaccccgtctctactaaaaacacaaaaaaataaaaattagccgggcgtggtggcgggcacctgtagtcccagctattcgggaggctgaggcaggagaatgaggagaatggcatgaacccgggaggcggagcttgcagtgaacccacattaggccactgcactccarcctgggcaacacagcaagactccatctcaaaaaaaaaaaaaattaaaaaagaatatgaggaaatcagatttcactgaattctgttggacagacaggcccagaacaggcagaggaagctgagcactttttggaaatcacatagtttatgctatctttattatttactttaaatctggtattctgagtctcttttaccaacagaaatagaccctatccattctgaaatccaactgtctgtttcttctcctatctgttctaaccctctttggttattctacaaccagagaatagagatctaaa

SEQ ID NO: 29194 - DNA, 601 bp, Human
ggctcacgcctgtaatcccagcactttgggaggctgaggcaggcggatcacaaggtcaggagatcaagaccatcctggctaacacggtgaaaccccgtctctactaaaaacacaaaaaaataaaaattagccgggcgtggtggcgggcacctgtagtcccagctattcgggaggctgaggcaggagaatgaggagaatggcatgaacccgggaggcggagcttgcagtgaacccacattaggccactgcactccagcctgggcaacacagcaagactccatctcaaaaaaaaaaaaaattraaaaagaatatgaggaaatcagatttcactgaattctgttggacagacaggcccagaacaggcagaggaagctgagcactttttggaaatcacatagtttatgctatctttattatttactttaaatctggtattctgagtctcttttaccaacagaaatagaccctatccattctgaaatccaactgtctgtttcttctcctatctgttctaaccctctttggttattctacaaccagagaatagagatctaaatatctctgggagacatctctaccatacatcctcccattctagctc

SEQ ID NO: 29195 - DNA, 601 bp, Human
gtgcagtggtgcaatctcggctcactgcaacctccacctactgggttcaagcaattctcctgcctcagcctcccgagtagctgggattacaggtgcacaccaccacgcccagctaatcttttttgtttttagtagagtcggggtttcaccacattgaccaggatggtcttaaactcctaaactcaggcaatccgcccacctcggcctcccaaagtgctaggattacaggcatgagccattgtgcccagcctaatttttgtatttctagtagagacgaggttttgccatgttggccaggccrgtcttgaactcctggcctcaactgatccacctgcttctgcctcccaaagtgatgggattacaggcgtgagccaccggtgccaccttagaccttgcttttggacaggaattatctacatgaattacctgggggaagatgtaagcagactagattaaaaagaaagaaagcctctgtcatccttcagtctatagcctagacgaaaggctccaacaaagtttgttaatctccttcctggctgcccctcccctttctcattctttgcagggataagaggtgattacaagtcctcttggcagtgct

SEQ ID NO: 29196 - DNA, 601 bp, Human
tagctgggattacaggtgcacaccaccacgcccagctaatcttttttgtttttagtagagtcggggtttcaccacattgaccaggatggtcttaaactcctaaactcaggcaatccgcccacctcggcctcccaaagtgctaggattacaggcatgagccattgtgcccagcctaatttttgtatttctagtagagacgaggttttgccatgttggccaggccggtcttgaactcctggcctcaactgatccacctgcttctgcctcccaaagtgatgggattacaggcgtgagccaccgrtgccaccttagaccttgcttttggacaggaattatctacatgaattacctgggggaagatgtaagcagactagattaaaaagaaagaaagcctctgtcatccttcagtctatagcctagacgaaaggctccaacaaagtttgttaatctccttcctggctgcccctcccctttctcattctttgcagggataagaggtgattacaagtcctcttggcagtgctgctattgctagggtgcccacttctaaagcaaacaaaaaaaaaaacacaaacacatcatcacgcctgcccttttaaga

SEQ ID NO: 29197 - DNA, 601 bp, Human
cagcacgccctagtggtagcaccaggaagtgctagtggactctaacctacttcagtctgcccgtgcgcactaggcaagggaggctgccatgcattgagaacatgaagaccccctcttttctcaaccactacctagcaccctggacaagaaggcaccatctttggcagctcacatttctccctgagaccctgggtcttagggtaatgcttccaccattcaggcagccccaccattcaggcagcctgggaccagcaacacccctaggctctcccaaaggggctcttctaccccaggtttttgktttttttttttttttggtttttgggttttttttacccgagatggagttttgctttgtcccccaggctggagtgcagtggcacaatctctgctcactgcaacctctgcctcccgggttctcctgcctcagcctcccaagtagctgggattacaggtgcccgccaccgcgcccagctaatttttgtatttttagtagagatggggtttcaccatgttgtccaggctggtctcgaactcctgacctcgtgatcctcccacctcagcctcccaaagtgctgggattaaaggtgtgagccaccgt

SEQ ID NO: 29198 - DNA, 601 bp, Human
attcaggcagcctgggaccagcaacacccctaggctctcccaaaggggctcttctaccccaggtttttggtttttttttttttttggtttttgggttttttttacccgagatggagttttgctttgtcccccaggctggagtgcagtggcacaatctctgctcactgcaacctctgcctcccgggttctcctgcctcagcctcccaagtagctgggattacaggtgcccgccaccgcgcccagctaatttttgtatttttagtagagatggggtttcaccatgttgtccaggctggtctcraactcctgacctcgtgatcctcccacctcagcctcccaaagtgctgggattaaaggtgtgagccaccgtgcctgacccaccccaggttttacatgagaaaccccataagataacagcagcccttgttgcctttccctgtctgagatgcattcatctctgaacacccagtgaagattacaggacaacacactcatcctacagcttgtggaagaaatttgattcagaaactggcagcagggcctccagtatgcagtgctgggcaggacagccaatggagcccctcaccctaacctcaccctc

SEQ ID NO: 29199 - DNA, 601 bp, Human
ggttctcctgcctcagcctcccaagtagctgggattacaggtgcccgccaccgcgcccagctaatttttgtatttttagtagagatggggtttcaccatgttgtccaggctggtctcgaactcctgacctcgtgatcctcccacctcagcctcccaaagtgctgggattaaaggtgtgagccaccgtgcctgacccaccccaggttttacatgagaaaccccataagataacagcagcccttgttgcctttccctgtctgagatgcattcatctctgaacacccagtgaagattacaggayaacacactcatcctacagcttgtggaagaaatttgattcagaaactggcagcagggcctccagtatgcagtgctgggcaggacagccaatggagcccctcaccctaacctcaccctcgaatgacaacaccaaaacacaatttctccaggaactagcacataattcggggtcttggctcctcagccaagctcagggaactactgtaagaacacactttctctcccagagaccccatgtcctgccttcctggctccaatcagtctgtgctgcctcccctaacaacagaaacagaaaacagat

SEQ ID NO: 29200 - DNA, 601 bp, Human
ccaagtagctgggattacaggtgcccgccaccgcgcccagctaatttttgtatttttagtagagatggggtttcaccatgttgtccaggctggtctcgaactcctgacctcgtgatcctcccacctcagcctcccaaagtgctgggattaaaggtgtgagccaccgtgcctgacccaccccaggttttacatgagaaaccccataagataacagcagcccttgttgcctttccctgtctgagatgcattcatctctgaacacccagtgaagattacaggacaacacactcatcctacagcytgtggaagaaatttgattcagaaactggcagcagggcctccagtatgcagtgctgggcaggacagccaatggagcccctcaccctaacctcaccctcgaatgacaacaccaaaacacaatttctccaggaactagcacataattcggggtcttggctcctcagccaagctcagggaactactgtaagaacacactttctctcccagagaccccatgtcctgccttcctggctccaatcagtctgtgctgcctcccctaacaacagaaacagaaaacagatacactctggtatgactagat

SEQ ID NO: 29201 - DNA, 601 bp, Human
ccctcgaatgacaacaccaaaacacaatttctccaggaactagcacataattcggggtcttggctcctcagccaagctcagggaactactgtaagaacacactttctctcccagagaccccatgtcctgccttcctggctccaatcagtctgtgctgcctcccctaacaacagaaacagaaaacagatacactctggtatgactagatttccccatcactccaagctagaagctcagctcctccctccccagttctctgtttgtttttctatattccactgtggctaagacagtctctttaaaaaaaaaaaaaaaaagtgaaacaaaaaagaaattgtttactcctgtggccagggcttccattaaggaagggctgaagtctctgggcagaaggttcagcccagggagggacagggctgggatcaagaaacaggaggctcttgggtctccattcagccaatttttaggactccatcctcctcctgcacttcccctctcgcccattgtccctcctctcccacctcttacctgtccagtgacctttgggcaggtgcggggaggaggggctaccagctgagtcaggggagaggggaaggtgcta

SEQ ID NO: 29202 - DNA, 601 bp, Human
agtgaaacaaaaaagaaattgtttactcctgtggccagggcttccattaaggaagggctgaagtctctgggcagaaggttcagcccagggagggacagggctgggatcaagaaacaggaggctcttgggtctccattcagccaatttttaggactccatcctcctcctgcacttcccctctcgcccattgtccctcctctcccacctcttacctgtccagtgacctttgggcaggtgcggggaggaggggctaccagctgagtcaggggagaggggaaggtgctagttaggagaaccaagsgtatcgctcatgctgcaacagctgttgactctgaggagcagaaaaagcagagggtaacggggactgaaatggaaaacaggaaaacacatgtgtgactctggccggcagcggggaggggccaggggacgggctggagctgggactgcctggtcagacccagaggacctcagtgcctgcccgcctccaggcaccttctctactacactggcaccaaatacctgagtctcagctccttctcctccctacctcagcctcaccccccccttccttgttgccctacatttactgagcacttaagct

SEQ ID NO: 29203 - DNA, 601 bp, Human
ttgtttactcctgtggccagggcttccattaaggaagggctgaagtctctgggcagaaggttcagcccagggagggacagggctgggatcaagaaacaggaggctcttgggtctccattcagccaatttttaggactccatcctcctcctgcacttcccctctcgcccattgtccctcctctcccacctcttacctgtccagtgacctttgggcaggtgcggggaggaggggctaccagctgagtcaggggagaggggaaggtgctagttaggagaaccaagcgtatcgctcatgctgcarcagctgttgactctgaggagcagaaaaagcagagggtaacggggactgaaatggaaaacaggaaaacacatgtgtgactctggccggcagcggggaggggccaggggacgggctggagctgggactgcctggtcagacccagaggacctcagtgcctgcccgcctccaggcaccttctctactacactggcaccaaatacctgagtctcagctccttctcctccctacctcagcctcaccccccccttccttgttgccctacatttactgagcacttaagctttcccctccattgacagt

SEQ ID NO: 29204 - DNA, 601 bp, Human
cctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgyttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgtta

SEQ ID NO: 29205 - DNA, 601 bp, Human
ctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctrggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgactt

SEQ ID NO: 29206 - DNA, 601 bp, Human
aggagtaaaggatcctgctgacacatttctcatccttctaggttgttcttcgtgggctcccgggagggccacctaccggaccttctgtccatgatccacattgagcgttttacacctatccctgctttactgttcaatgtaagctttgctgggaccacggggctcaggtggatctgtgcattgctccttctgatttgtgctaagttgttaaataagagggaccctgagaaaggccttactctaagatgtgaaaaacagttcattttttgttgtcatttaattcttttatggttttattacatttaattttggattaatctggaatttatattatagcatagtattgagaaaggtggggattcacttaattttttctcgaatggcagccagctataccaatatcgctcactcaacaatccattttcccacagttttcaaacttttatcacagaaaattaatagctaatttttttagggtccttaatatgtgccaattattattgtatgccccttaaatgtgccatctcaactaatcctccccatcagcaccaagtctccttagtttagctttatactgactatctgaaaactaaagagggac

SEQ ID NO: 29207 - DNA, 601 bp, Human
tggcttctatgacataagatacatgagaagaaaatttctttcctgatttctcttccactcactctataactggtgttgtccccagggccgggggtataatagtcatccaataaatatttgccatgtgaacacacagaagcatgaaaaataaaagagagttttgtcccgttcattctttttactggttttcacacaccagtccatgtgttgtgcctccctggggcaagcaaagaattagagaagtcaaggccttgtaaaagaacatagtgtccagctgggcgtggggctcacacctgtaatyccagcactttgggaggcttaggtgagaagattaccttaggtcaggagttcgagaccagcctgaccaatatggtgaaaccctgtctctactaaaaatacaaaaaaagaaaaattagctgggcatggtggcacgtgcttgtagtcccagccgctcgggagggtgaggcaggagaattgcctgaacccaggaggcggaggttgcagtgagccgagatcgcgccattgaactccagcctgggctacagagcgagactccatctcaaaaataaaaaaagtagtgtcaccttccctctgctcagcc

SEQ ID NO: 29208 - DNA, 601 bp, Human
attttcccatctgttaagagtttggcttctactacctgaaaaatattcttattaaggcgatctctttcttagcctgtctttagtcctcatcctattggacctctgaagcaagtgatgctgaccactttccaattttgaaacaattcccatggcttctatgacataagatacatgagaagaaaatttctttcctgatttctcttccactcactctataactggtgttgtccccagggccgggggtataatagtcatccaataaatatttgccatgtgaacacacagaagcatgaaaaataaragagagttttgtcccgttcattctttttactggttttcacacaccagtccatgtgttgtgcctccctggggcaagcaaagaattagagaagtcaaggccttgtaaaagaacatagtgtccagctgggcgtggggctcacacctgtaatcccagcactttgggaggcttaggtgagaagattaccttaggtcaggagttcgagaccagcctgaccaatatggtgaaaccctgtctctactaaaaatacaaaaaaagaaaaattagctgggcatggtggcacgtgcttgtagtcccagccgc

SEQ ID NO: 29209 - DNA, 601 bp, Human
tgctggtagctcatgtttccatctgagatgaggacagattgatgaaaggtataggggagaaaggcaacagcttggagtggtgacttgggcagggaccagattctaggctccttgtgggttatgctgtagccccaggattcattccttcagtaaatgataacagcacttgctgtgtaccaggtattggtgctatgtacagaaagactttccccctcacttcccagaaaatgccgaggccatcaggtctcctgatctcctctgtgcagacatctataagcgtgctggtccttcctgttgttgmagaggaaggagcaggtgtgcctttcctggcagactctgctacttgggctcggggttccagcacttcccctcttcttcagcagtttgctccatcagttggcccttctctttggtgggtgctcacttggagccagctctccaatagcttctctcctctccacttaggagagacacaaaatagcgtttcgcatctctcctcttcccacttactggatgtactactttttatttttaaattaattttttttagagattggggtctcactatgttgcccaggctggtctcaaactcctggtctca

SEQ ID NO: 29210 - DNA, 601 bp, Human
cttagcagtgattgcatttgttccgagatcatagatgcaggaggattatgaaaccctgtgcgtttaagtgccttttctgtgccctgcccccagacatttgctgaccagacgtttggcatgttcagctggaccatccccattgctgttgccctgtcctgctttgggggcctcaatgcatccatctttgcttcatcaaggtactgtgtctctgtgtcactgataatagaccacaatatttcattctctggggcttaggcataagagttccttttttccctccttctcatgggcatatagggtttgtgtgtgtgtgtgtgtgtgtgtgtgtgtgtgtgtgtgttggtatgtgggcatgtacttgcctttgtgcaagtagcacatttgtatgctggtagctcatgtttccatctgaggtgaggacagattgtgtgctgatagctcatgttatgtgttgatagctcatatttatgtgctggtagctcatattttgtgtgctggtagctcatgtttatgtgctggtagctcatgttttgtgtgctggtagctcatgtttccatctgagatgaggacagattgatgaaaggtataggggagaaaggca

SEQ ID NO: 29211 - DNA, 601 bp, Human
aagccgagattgtgccactgccctccagcctaggtgacagagcaagattccatctcaaaaaaaaaaaaaaaaaaagaattgcccttgttgggctgggcgcggtggctcatgcctgtaatctcagcactctgggaggccgggaggctgaggcagatggatcacctgaggtcaggagtttgagaccagcctggccaacatggagaaaccctgtctctactaaaaatacaaaaaattagccgggggtggtggtgggtgcctctaatcccagctactcgggaggctgaggcaggagaatcgcctkaaactgggaggcagaggttgcagtgagccaagatcttgccattgcactccagcctgggcaacaagaacgaaactctgtctcaaaaaacagaaaaagaaaaagaaaaaaagaattgcccttgttgattcttagactgctggtctagcctgtgtacttatatcaagttagtagagctagccatgtggatgtccctggaggctcaggagcatcctggggtcaaattgggttttgagtaatcctcccctgaagatctgttccttagggaaccactgctgtgtatgagaatggacacccctgagg

SEQ ID NO: 29212 - DNA, 601 bp, Human
ttgaaaacaggaggcggaagttgcagtaagccgagattgtgccactgccctccagcctaggtgacagagcaagattccatctcaaaaaaaaaaaaaaaaaaagaattgcccttgttgggctgggcgcggtggctcatgcctgtaatctcagcactctgggaggccgggaggctgaggcagatggatcacctgaggtcaggagtttgagaccagcctggccaacatggagaaaccctgtctctactaaaaatacaaaaaattagccgggggtggtggtgggtgcctctaatcccagctactygggaggctgaggcaggagaatcgccttaaactgggaggcagaggttgcagtgagccaagatcttgccattgcactccagcctgggcaacaagaacgaaactctgtctcaaaaaacagaaaaagaaaaagaaaaaaagaattgcccttgttgattcttagactgctggtctagcctgtgtacttatatcaagttagtagagctagccatgtggatgtccctggaggctcaggagcatcctggggtcaaattgggttttgagtaatcctcccctgaagatctgttccttagggaaccactgc

SEQ ID NO: 29213 - DNA, 601 bp, Human
cacattctggttggtgtggagtctaaaaagctgtgcttttaagaattgcccttggcccggcacggtggctcacgcctgtaatcctaacactttgggaggctgaggtgggcgaatcagcaggtcaggaattcgagaccagcctgaccaacatagagaaaccctgtctctactaaaaatacaaaaattggctgggcatggtggtgcgcgcctgtaatcccagctacttaggaggctgaggcaggagaatggcttgaaaacaggaggcggaagttgcagtaagccgagattgtgccactgcccaccagcctaggtgacagagcaagattccatctcaaaaaaaaaaaaaaaaaaagaattgcccttgttgggctgggcgcggtggctcatgcctgtaatctcagcactctgggaggccgggaggctgaggcagatggatcacctgaggtcaggagtttgagaccagcctggccaacatggagaaaccctgtctctactaaaaatacaaaaaattagccgggggtggtggtgggtgcctctaatcccagctactcgggaggctgaggcaggagaatcgccttaaactgggaggcagaggttgcag

SEQ ID NO: 29214 - DNA, 601 bp, Human
ggtgggaaggggggtaccaccaacagttcctctggattccctgaggagaacatggcgactctgttagcttcactgctcggctgtttctatgtacatgctagcatgtgtcagtgagtgcaagagatgggagtagatttctttctgggctttttgggccaggctggcttggccaagtggacatgagtcagcctgtccctcagggctggtttcctttggtggaggctgggagcattgcaggaagccagccaagggcctaggagctcctgaagcttgggtcatgattgggtcataaaagtaatcwgtggggatagagtggctcctgtttgtggtctgtgactgccaagctacaagtaggaagactgggccctccttgagacaggtggcagggtatatggagctggaagtggggtatggaaatgggtggttattttgcagcctttacttttcatctggacttgtattcagcaatccctccccaagtcagctctcagaaaaatattaaaatattgtgaaattggcagtgtctttcctaaatgttggctttagaaagcttttcattcctggatcagagaggactggcagtgagggtaacaggcctacc

SEQ ID NO: 29215 - DNA, 601 bp, Human
gagaagatcacgctgggtgcagggtcaggaaggtgcttattttcctttgatagattctgggtccttcataggtaggttaatgtggaatccaacatgaggggcatgctggggaagaaagcaaatacaccagtggcaaattagccctgggttgggatgcccctggatgtcctttctctaccctgtcttattacgtaacccttctctttcgggtactttggaaaaagaaagatgtggaatgggcaagcagcaacatgggagagtgaggtaggtgttgcagacacagtgatacccaggcatgtattttttttttttttttgagaccaagtcttgctctgttgccaggcagtggcgtgatcttggctcactgcaacctccgactccctggttcaagcgattctcctgcctcagcctcctgagtggggattacaggtatgtgtcaccacgcccagctaatttttgtaagtttagtagagacggggtttcaccattttggctaggatggtctcgatctcctgaccttgtggtccgcccgcctcggcctctcaacatgctgggattacaggtgggagccactgcgcccagccaggtgtgtattttaatg

SEQ ID NO: 29216 - DNA, 601 bp, Human
ctgtgaccttaaaggactaactgttacgtgggtgggaatcaaatggcccaccagatttcttctgaagatgagatgggatcaaaggatcagaagtgtgactggcacaggagttgagggagggagaagatcacgctgggtgcagggtcaggaaggtgcttattttcctttgatagattctgggtccttcataggtaggttaatgtggaatccaacatgaggggcatgctggggaagaaagcaaatacaccagtggcaaattagccctgggttgggatgcccctggatgtcctttctctacccwgtcttattacgtaacccttctctttcgggtactttggaaaaagaaagatgtggaatgggcaagcagcaacatgggagagtgaggtaggtgttgcagacacagtgatacccaggcatgtattttttttttttttttgagaccaagtcttgctctgttgccaggcagtggcgtgatcttggctcactgcaacctccgactccctggttcaagcgattctcctgcctcagcctcctgagtggggattacaggtatgtgtcaccacgcccagctaatttttgtaagtttagtagagacggggtt

SEQ ID NO: 29217 - DNA, 601 bp, Human
tgaggccagattcgggcacatcacatacacatttgttgaacagataagagacttctggaaagatgatgtgcttgccgatcctgttcctattgctgattcttggaggttatctctgtgaccttaaaggactaactgttacgtgggtgggaatcaaatggcccaccagatttcttctgaagatgagatgggatcaaaggatcagaagtgtgactggcacaggagttgagggagggagaagatcacgctgggtgcagggtcaggaaggtgcttattttcctttgatagattctgggtccttcayaggtaggttaatgtggaatccaacatgaggggcatgctggggaagaaagcaaatacaccagtggcaaattagccctgggttgggatgcccctggatgtcctttctctaccctgtcttattacgtaacccttctctttcgggtactttggaaaaagaaagatgtggaatgggcaagcagcaacatgggagagtgaggtaggtgttgcagacacagtgatacccaggcatgtattttttttttttttttgagaccaagtcttgctctgttgccaggcagtggcgtgatcttggctcactgca

SEQ ID NO: 29218 - DNA, 601 bp, Human
cccagctaaatttttttgtatttttattagagaccgggtttcaccatgttggccaggatggtctcaatctcttggccttatgatctgcctgcctcagcctcccaaagtgctgggattacaggcgtgagccactgcgcccagcatgcattttgttactgaatgaagataaagaagtctggcatggtggctcacacctgtaatttcagcacttcaggaggccaaggtaggaggatcagttgaggccaggagttcaagaccagcctgggcaatgtagtgaaacactgtctctacagacaaattaaaaaaaaaaatacataaataaatagctgggcatggtggcaagcacctttagtcctagctactcatgaggccgagatagaggactgcttgagcctaggagttggaggctgcagtgagctatgattgcatgattgcactccagcctgggtgacaaagtgagaccttgtctcttgaataaaaaagagagagagagactgaaagagaaaaaagtcttatctgccttcagttttgtgtgattctgctactctccttggctgaaggagtccttaaccttccagcaggaactttgtctttcattcag

SEQ ID NO: 29219 - DNA, 601 bp, Human
gctctgtcaccagactggagtgcagtggcgctatcttggctcactgcaacctccgcctcccaggttcaggtgattctcctgcctcagcctcctgagtagctgggactacaagtgcatgccaccacgcccagctaaatttttttgtatttttattagagaccgggtttcaccatgttggccaggatggtctcaatctcttggccttatgatctgcctgcctcagcctcccaaagtgctgggattacaggcgtgagccactgcgcccagcatgcattttgttactgaatgaagataaagaagyctggcatggtggctcacacctgtaatttcagcacttcaggaggccaaggtaggaggatcagttgaggccaggagttcaagaccagcctgggcaatgtagtgaaacactgtctctacagacaaattaaaaaaaaaaatacataaataaatagctgggcatggtggcaagcacctttagtcctagctactcatgaggccgagatagaggactgcttgagcctaggagttggaggctgcagtgagctatgattgcatgattgcactccagcctgggtgacaaagtgagaccttgtctcttgaa

SEQ ID NO: 29220 - DNA, 601 bp, Human
agaggtaggaactttaactacttttgccaaggacaggctcttgataacaattgcatttttcttttctttttttttttgagacagagtcttgctctgtcaccagactggagtgcagtggcgctatcttggctcactgcaacctccgcctcccaggttcaggtgattctcctgcctcagcctcctgagtagctgggactacaagtgcatgccaccacgcccagctaaatttttttgtatttttattagagaccgggtttcaccatgttggccaggatggtctcaatctcttggccttatgatgtgcctgcctcagcctcccaaagtgctgggattacaggcgtgagccactgcgcccagcatgcattttgttactgaatgaagataaagaagtctggcatggtggctcacacctgtaatttcagcacttcaggaggccaaggtaggaggatcagttgaggccaggagttcaagaccagcctgggcaatgtagtgaaacactgtctctacagacaaattaaaaaaaaaaatacataaataaatagctgggcatggtggcaagcacctttagtcctagctactcatgaggccgagatagaggact

SEQ ID NO: 29221 - DNA, 601 bp, Human
ttttcttatttcatttttttatagagacggaacctccctatgttgcccaggctactcctgaactcctggcttcaggcaatcctctggccttggtctcccaaaatactaggattataggcgtgagtcatcatgtctgctcccattttatttgtgctttttgttgtttgttttttgagacagggtctctgtcacccaggcgggagtgcaatggtgtgatcatggctcactgcagcctcaaccttcttgggctcaggtgatcctcccacttcagcctcctgagtaactaagactacaggtgtgcgccaccatgcccagctaacttttgtagttttttggtgtagacagggttttgccattgcccaggctggtctcctgggctcaagtgatccacctgctttggcctcccaaagtgctgggatcacaggtgtgcaccactgtgccctgccaaggtgaagtttagatatggagagaaggtaagggatggccctggggttgtatgtgtagccaagccagcctgggacttagtcatgtgctcttgggagctgctagggttacatcacaattttgctcttgggtgtttagcaaagaggtaggaacttta

SEQ ID NO: 29222 - DNA, 601 bp, Human
tagttttttcttatttcatttttttatagagacggaacctccctatgttgcccaggctactcctgaactcctggcttcaggcaatcctctggccttggtctcccaaaatactaggattataggcgtgagtcatcatgtctgctcccattttatttgtgctttttgttgtttgttttttgagacagggtctctgtcacccaggcgggagtgcaatggtgtgatcatggctcactgcagcctcaaccttcttgggctcaggtgatcctcccacttcagcctcctgagtaactaagactacagttgtgtgccaccatgcccagctaacttttgtagttttttggtgtagacagggttttgccattgcccaggctggtctcctgggctcaagtgatccacctgctttggcctcccaaagtgctgggatcacaggtgtgcaccactgtgccctgccaaggtgaagtttagatatggagagaaggtaagggatggccctggggttgtatgtgtagccaagccagcctgggacttagtcatgtgctcttgggagctgctagggttacatcacaattttgctcttgggtgtttagcaaagaggtaggaa

SEQ ID NO: 29223 - DNA, 601 bp, Human
ctagttttttcttatttcatttttttatagagacggaacctccctatgttgcccaggctactcctgaactcctggcttcaggcaatcctctggccttggtctcccaaaatactaggattataggcgtgagtcatcatgtctgctcccattttatttgtgctttttgttgtttgttttttgagacagggtctctgtcacccaggcgggagtgcaatggtgtgatcatggctcactgcagcctcaaccttcttgggctcaggtgatcctcccacttcagcctcctgagtaactaagactacaggtgtgtgccaccatgcccagctaacttttgtagttttttggtgtagacagggttttgccattgcccaggctggtctcctgggctcaagtgatccacctgctttggcctcccaaagtgctgggatcacaggtgtgcaccactgtgccctgccaaggtgaagtttagatatggagagaaggtaagggatggccctggggttgtatgtgtagccaagccagcctgggacttagtcatgtgctcttgggagctgctagggttacatcacaattttgctcttgggtgtttagcaaagaggtagga

SEQ ID NO: 29224 - DNA, 601 bp, Human
gtctggttcagcctcagtcttaaagcaggccctgtttgtttccctgggtcttgggagtggatctttctgggtgctcctgcccttttcccaggagaaagacacctccggtggtcttgcccagaatttcctacccctcctccaggcatagaggttttttttttcttttatcctgccccagctgcctcaggagtgacagagtttgctgccctttcccaggggtttatggtttttattctttagaggagaagggtataggttggcctttgtattttccctcccataagccagcactaccaagagmggttttctcaggttacttgcccagtatttcttctgagtaaccactgaggtctatggaaaaaacctgagtgtctgtggctcttactaacccacacttgacatttggtaatttttaaaaaaatttacttgaattcttctgactcacctaaatggtggtctcatctttctcccactgccacaggtgagccagaccttgtatctctctatctccctggaggtggctgtctttccatcagtttcaatctagttggttgccctgtaacttcagctttctgatggctccaagaaaaattgttgtttg

SEQ ID NO: 29225 - DNA, 601 bp, Human
gggtgtggtggctcacgcctgtaatcccagcactttgggaagccgaggcaggcggatcacctgaggtcccaggagtccgagaccagcctgaccaatatggtgaaaccccgtctctactaaatacaaaaaattagctgggtgtggtggcgcatgcctgtaatcccagctactcggaaagctgaggcaggagaatagcttgaacccaggaggcggaggttgcagtgagccaagatcgcgtcattgcactccagcgtgggcaacgagcgaaactccgtctaaaaaaaaaaagagcaaaaatacttattaaaaaatatttacctaggctatttgatattgccccacaggttgatgttctgttctattttttcactttctccattttgacccttttggttttcatctcactgctaaagttccacatttgtttctgcatgctgttcaactttttcagtagaaccttaaatgtatcaaacacaattattttaaattccttgtttgatgtttccattatctgggtcatctctcaatatggtcctattgattacttttcctcttgatagtgggttgtttttcttgctttttttatgttgcttgtaacttg

SEQ ID NO: 29226 - DNA, 601 bp, Human
caggaacaccaggacgagggccgtctcacctcactcggaccacatggagacctcccttcaaaatgggagccatgtcctgccccaccaagccctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacrcagaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcaggagttgtccaccacctggtggggcagtgtgacagaggggccattggggaaggtggctagcttatcccgccccttcaagaagaaggtcagcagctcccccttccccttcacaaagatgg

SEQ ID NO: 29227 - DNA, 601 bp, Human
gcgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacacctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccrcgaggcggaccccttcaccttggctgggcctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagt

SEQ ID NO: 29228 - DNA, 601 bp, Human
cgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacacctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccaygaggcggaccccttcaccttggctgggcctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagtt

SEQ ID NO: 29229 - DNA, 601 bp, Human
atataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagttctgaaggccatgctttcagtttcccttgttgacaattgctctccagttcctatgaaagcacagagccttagggggcctggccacagaacacaaccatcttaggcctgagctgtgaacagcagggggttgtgtgtctgttytgtttctctgcttgccgaactttctcaataaaccctatttcttatttatatttacgtggtgctggtggtgtgtgtctgggaccactttgcacagcagttcttatttcccccatgctaggtctgggctgccaatctcttgccttgggggcagagcctcatctctctggctactggggttagctaccttgttggagctggcaaagccattggtgttgacatcgggggtgactcctgaagccgccatatacgtgctgccaatggttttgatcttggtgatcacccggaacttgggattgtcca

SEQ ID NO: 29230 - DNA, 601 bp, Human
tgcagggtgggatgggcactcacagagtcaaaatccgagatgatttcattgaggaaacgcagacactcaataccaccattgttgatgctctcctctgtgtagaagtcagcaaagttgggcagggaggcaaacatgactccaatctcatcatacgtctggctatacagctcctaaaaagaggtgcggacaacgtgctcaaagcatgtccgactgactggatgatgtgttggagaaatgcatctatcttccatgcatgacatgtgcactcagctttttggactcacacatcagtcagattatyccagcatttttttttttttttttaagagtgggtcttgctgtgtttcccaggctggagtgcagtggcagtaaacaagcacaattaggtatgatcgaagcacactgcggccttgaacaccaggtatctgggaccacagacacatgtcaccatgcccggctgtagattattccaactctgaataatttaaaaatagctcatcgctacttttttttttttttttttgagagatggagtcttgctgtgtcacccaggctggagttgagtggcacaatctcagctcactgcaacctccacctcctg

SEQ ID NO: 29231 - DNA, 601 bp, Human
tcccaaagtgccgggattacaggcgtgagccactgtgcccagccactactttgaataaattttaaaacagcttctctagttcctctaacagccccagctgtgaagacgagggtaccgtagagctgggaaccactctgtttggagaagttcacaggcaacagaaaggtgggctctagccaaagtcttgtcttctgacacatggcctcagagctgtacggcccacatcacgatgcctacagcagtgcactttataagaggccggagaaattcctcttttgcttatttgtgtttgctgtttagrttcagccctacctaggccccagtcccctgtccctgagaaggcctgggcccagcgggggctgcctgaaagaaagaacagatggagacaaatggcctcatggttccgggctgagaccacacccctcacctcatctctcttcttggaccccaggaaatggcgtgccacgtgctcaggcaacatgttggtgaccaaggcctcgttccagcgtcgcatctcatagacacgttccttctggtcgtggacctcaatcttccacaagaaaagtgtccgtgccagtttttctacctacagacacagaca

SEQ ID NO: 29232 - DNA, 601 bp, Human
tttgctgtttaggttcagccctacctaggccccagtcccctgtccctgagaaggcctgggcccagcgggggctgcctgaaagaaagaacagatggagacaaatggcctcatggttccgggctgagaccacacccctcacctcatctctcttcttggaccccaggaaatggcgtgccacgtgctcaggcaacatgttggtgaccaaggcctcgttccagcgtcgcatctcatagacacgttccttctggtcgtggacctcaatcttccacaagaaaagtgtccgtgccagtttttctacctrcagacacagacaaggcgaggcatgtgctctaagctggccactggatagaaggatgaaaaacaggaatggccaggcgtggcggttcatgcctgtaatcccagcactttgggaggccgaggcaggcggatcacctgaggtcaggagttcgagaccagcctgaccaacatggtgaaaccctgtctctactaaaaatacaaaaattagccgggcatggtggcgggcacctgtaatcccagctactcgggaggctgaggcaggagaatcaacttgaacccaggaggcagaggttgcagtgagccg

SEQ ID NO: 29233 - DNA, 601 bp, Human
gtatttaagaaacactgcattgcctgactgatcacagaggtagctacaaccatgcaggaatttggagaagcaagagacatcagtgatgggatttcatagccatgggactggggtacaatctcaccatggctttttaccttgttcatacatatttttatgtggagctgtggttagtttccattaccgtatggtatttcactgcatgaatataccagttatgtatccatttcctgttgatgtcatttgggttgttttcatttgttttgggggagggggtatgtctattacgaacagtgccacyttggacattctcatacatatatcctgggacatgagtatgtgcatgaatttctctaagatgtgtgtatatatatatacacatatacacacgtctgcgtgggtgtgtatgtaggagtggaattgctgggacacaggtttattttcaaccttactaaatagatcaaaatattttctaacacggttgtactaactcatactcccaccaggagtgtaagagttactattgtacttgatattgtcagagttatctggaccggtacgtgtgtgatggtatctcactagggtgtaactggcatttcct

SEQ ID NO: 29234 - DNA, 601 bp, Human
aagccacctcagcacaggcccatgagcttgaactgaggactttgcgggcgggaggaaggagacaatacagatccccagtcacgcttcatcttactcgtgctcccgaaaacgcttgtggtcgtattcatcaaagacgggacgccaggcatagaggttgatggtggccacggcgcctgcgacgagcagcatgagcgtgagcttcaccatgtggctgacctgcaccagcatgatggtggcgatgagggacagcacggccacatagttgtaatacttggggttctccaggcagctgccctccgtytccatccctgccgttgcattgctgggtcccgtgtagtactggagacagctgagctggaggccaggacggcgggcagggacacacgttcaagagaacagcaggtgctggtcacagagggctgtgcatggtagtgcacgctcagctgccacctcccgcggctcccccagaaataccgggaaagatggggaaatttaccagggactaatcatatgaaagttagtaactgcagctaagagcctcgccattgcctcatttgacattcacaaaaactctctcgagtatttttagtactgtccctat

SEQ ID NO: 29235 - DNA, 601 bp, Human
gacagcacggccacatagttgtaatacttggggttctccaggcagctgccctccgtctccatccctgccgttgcattgctgggtcccgtgtagtactggagacagctgagctggaggccaggacggcgggcagggacacacgttcaagagaacagcaggtgctggtcacagagggctgtgcatggtagtgcacgctcagctgccacctcccgcggctcccccagaaataccgggaaagatggggaaatttaccagggactaatcatatgaaagttagtaactgcagctaagagcctcgccrttgcctcatttgacattcacaaaaactctctcgagtatttttagtactgtccctattgtacagaaaactcgggccagatttgcccaaacacaattagcaagcagaaaagccaaaagtaggagccaagtctttaggcttcaaatccaacatgttcttccccatatcacactgttgcttcaggaggggccacgggaccatgagccccactcacagcctccccgtgatgacagctagtctctgcccaaatccttccattggggggatgttcactgccttctggattctttactggttctgcta

SEQ ID NO: 29236 - DNA, 601 bp, Human
cctcagcctcccaaagtgctggaattacaagtgtgagccaccgtgcccggccccccactggacttctgattagctgcagccctggagctttttcacttataccactggcagaataagtctccatgttggttgtatttgtgtgctccaattttttttttttttttttttttttgagacaaagtctcactctgttgccaggctggagtgcagtgcacaatctcggctcactgcaagctccacctcccgggttcacgccattctcctgcctcagcctcctgagtagctgggactacaggcgccygccaccacgcccggctaatttttttgtatttttagtagagacggggtttcaactgtgttagccaggatgatttcgatctcctgacctcgtgatccgcccgccttggcctcccaaagtgctgggattacaggcgtgagccactgcgcccggcaccgtgtgctccaattgttaaagtacaacaataacattatatttgaaaaaaaaggaagatagtgtatatggtactaccacaattagaggaggccgtgacaactgacaagagaacactgatgacagctccaggcatgtagtgctcaatac

SEQ ID NO: 29237 - DNA, 601 bp, Human
aaagtgctggaattacaagtgtgagccaccgtgcccggccccccactggacttctgattagctgcagccctggagctttttcacttataccactggcagaataagtctccatgttggttgtatttgtgtgctccaattttttttttttttttttttttttgagacaaagtctcactctgttgccaggctggagtgcagtgcacaatctcggctcactgcaagctccacctcccgggttcacgccattctcctgcctcagcctcctgagtagctgggactacaggcgcctgccaccacgccyggctaatttttttgtatttttagtagagacggggtttcaactgtgttagccaggatgatttcgatctcctgacctcgtgatccgcccgccttggcctcccaaagtgctgggattacaggcgtgagccactgcgcccggcaccgtgtgctccaattgttaaagtacaacaataacattatatttgaaaaaaaaggaagatagtgtatatggtactaccacaattagaggaggccgtgacaactgacaagagaacactgatgacagctccaggcatgtagtgctcaatacgtgcccagtggt

SEQ ID NO: 29238 - DNA, 601 bp, Human
ctccaattttttttttttttttttttttttgagacaaagtctcactctgttgccaggctggagtgcagtgcacaatctcggctcactgcaagctccacctcccgggttcacgccattctcctgcctcagcctcctgagtagctgggactacaggcgcctgccaccacgcccggctaatttttttgtatttttagtagagacggggtttcaactgtgttagccaggatgatttcgatctcctgacctcgtgatccgcccgccttggcctcccaaagtgctgggattacaggcgtgagccacygcgcccggcaccgtgtgctccaattgttaaagtacaacaataacattatatttgaaaaaaaaggaagatagtgtatatggtactaccacaattagaggaggccgtgacaactgacaagagaacactgatgacagctccaggcatgtagtgctcaatacgtgcccagtggttctaaaccaatagatctgggctcccaactcctgtcccttttccccaagaaagcatttggctgccccctcagggaggaagaatacacaggactgggacttagaactgcctccattctggactctgtcactt

SEQ ID NO: 29239 - DNA, 601 bp, Human
acaacaataacattatatttgaaaaaaaaggaagatagtgtatatggtactaccacaattagaggaggccgtgacaactgacaagagaacactgatgacagctccaggcatgtagtgctcaatacgtgcccagtggttctaaaccaatagatctgggctcccaactcctgtcccttttccccaagaaagcatttggctgccccctcagggaggaagaatacacaggactgggacttagaactgcctccattctggactctgtcacttcctggctgtgtgacctagagcaagtgaattaccttttttttttttttttgagacggagtcttgctgtctgttgcctaggctggagtgcagcggctcaatctcggctcactgcaacctccgcctcctgggttcaagcgattctcctgcttcagcctcccaagtagctgggattacaggtgtgcaccaccatgcctggctaatttttgtatttttagtacagatggggtttcaccatgttggccaggctggtttcgaactcctgacctcgtgatccgcccaccttggcctcccaaagtgctgggattacaggcgtgagctaccgcgcccaaccaat

SEQ ID NO: 29240 - DNA, 601 bp, Human
atgttggccaggctggtttcgaactcctgacctcgtgatccgcccaccttggcctcccaaagtgctgggattacaggcgtgagctaccgcgcccaaccaattaccctttttgagagttagtttctccctatgaaactgcagatactggtacaactgctcaggactttttcacagattaaatgaatcaacatacataaggtacctagcacaggcctgggcacatggaactgtgctctcggactctgggagaggagcttcaaggaaacaagtccatcccagaggctccctggatgacagggayaagactccttccactaggtggggatgatgtgtttgggaacctaagagccactccaaagctacatgacggtggagggatggactgagaaactgcttgtgtgacccaaacagaagcccttctccactgagaacaggggcgtcccttcaacaaggacagcaggagctcaccatgtccacgacatttgccatcaccaggatgaagatggcgagcatggcccaggtgttcctggcccagcgggtccggtcaatccaagttgagaaggccacaagcttcttaggaaaggcctagaaggaacagaat

SEQ ID NO: 29241 - DNA, 601 bp, Human
tgaggccagggcaggaacagttttcagggctgctcgtctctggccagctactcctgcctatcctggctccaagtgacctggcgagccacctgtcagatttatgttcctaaacactgctttacctttgtcattctgattaaaaaaaaaaaaaaactctgcttggtacctcagtgccttacaggagaaagttttaatccctttagtctggcttctaagggccttcaccatcggggccaacccaccttccagccggccctccacttcctctctacccaggttcttgtttacccagactctgccrtactcatacgtgctgcagcgccacggcccaacaaggcccaccacggcccagccgtggcccaccacagcctgccacagcctggtggcccagccagagggagtgctctgctgatggtgaatgaatggatgggcaagtgcctggaccgtcctaacagaggagtgtctgcctgtcagatttgacagaaagaataactccatcactgcccagttttacagggagtgccactcacttccagaggcttctgagctcagtagaaaagtgcctcttacccggggaaagatggcagccagggagcagatg

SEQ ID NO: 29242 - DNA, 601 bp, Human
caccacagtcctgagtgtccgctagggcaggggttgttctcctcatttcacagatgaggaaacagatgctgccggagcctgcagtggcctgcacgtggtcacacacccgcaaccttagatagtgtgacccagcccaaggctcctgacaaactgtaatcccagcagggttccagacccctcctctgtgacggggaatccccgattggccgaggggagaaagggagaacaagagagtggtcgtcaccctcagacagggcttcaccagctggggactccaggaggccacaccttgccctggagracctactgctgcgttagagagggcgtcagtctgtgcccacagcctaaaatctatctttaccaagatgagccaagagaggggccaggtcagccttggtgactgagactgacgcagtgtccccatctttgtcccaagaatcagtgtgggcccatctagccaaggtctccagccttctggaggcctctgtccctcagctctcttgatcctggccagatccccattctgacgctaggactgctccaaaacgcggggcagggaaaaggaaggatgcccagggtgccgtctagcactcctggggcc

SEQ ID NO: 29243 - DNA, 601 bp, Human
caaactgtaatcccagcagggttccagacccctcctctgtgacggggaatccccgattggccgaggggagaaagggagaacaagagagtggtcgtcaccctcagacagggcttcaccagctggggactccaggaggccacaccttgccctggagaacctactgctgcgttagagagggcgtcagtctgtgcccacagcctaaaatctatctttaccaagatgagccaagagaggggccaggtcagccttggtgactgagactgacgcagtgtccccatctttgtcccaagaatcagtgtgsgcccatctagccaaggtctccagccttctggaggcctctgtccctcagctctcttgatcctggccagatccccattctgacgctaggactgctccaaaacgcggggcagggaaaaggaaggatgcccagggtgccgtctagcactcctggggcctgtgggggccgtcccagtgggggtcagggagcagagactggcttgctccccaatatcaggctcccgctgagacacctgcccccgccccccgcccggcaccaccgcagccgaggaaactcgtggccctccccggcccctccctcacc

SEQ ID NO: 29244 - DNA, 601 bp, Human
aaagcatcaactccaaaaacaggaatcctggctgtgatgacacagccatcagtctgaatagtcactgagacgggctgagagctgtctgaacgggttcaacagtgcatctgggagccacagtcacgactccctggggccgggcacggtgactcacgcctgtcatcccagcactctgggaggctgaggtgggtggatcacttgaggtcaggagtttgagaccagactggccaacatagtgaaactccatctttactaaaaatacaaaaattagccaggcatggtggtacacgcctgtaatcayagctacttgggaggctgaggcaggagaatctcttgcacccgggaggcagaggttgcagtgagccaagatcgcgccactgcactccagcctgggtgacagcgtgactccatctcaaaaaaaaaaaaaaagactccctggtcttaagcacaggcacaggtgtgccactggttgacagtttgaccccagataatgtttccccagccacatcttccccttctgtaaaatcacgtggatggtctgtggcagcagcgggaacctgttcctgaagcagatccgggagcagcgtggccctggctgagg

SEQ ID NO: 29245 - DNA, 601 bp, Human
agctacttgggaggctgaggcaggagaatctcttgcacccgggaggcagaggttgcagtgagccaagatcgcgccactgcactccagcctgggtgacagcgtgactccatctcaaaaaaaaaaaaaaagactccctggtcttaagcacaggcacaggtgtgccactggttgacagtttgaccccagataatgtttccccagccacatcttccccttctgtaaaatcacgtggatggtctgtggcagcagcgggaacctgttcctgaagcagatccgggagcagcgtggccctggctgaggrtcagggcccgaaaaatcaggctgctaaagctgcatctgtgtcctccttgctagtgagtgccctgagtctggacccccactttctatcaagaaaactgcaacaaggaaaagttactgaatgttgggggactcaagaaaaacctaatttaccctgagccccatctaccctcttgttctacggcatctgctctaatggcaccagggccagctctcctgtccccctcacgcggtgagcccgagcagggcagacatcccatctctgcagcactgacctccatcagtgaacgtgctccagacgccc

SEQ ID NO: 29246 - DNA, 601 bp, Human
ttttgagacagagtcttgttctgtcgcccaggatggagtgcagtggcttgatcttggctcagtgcaacctctgcctcccgggttcaagcaattctcctgcctcagcctccagagtagctggaattacaggtgcacaccaccacacccgactaattctgtatttttagtagagatggggtttcgtcatgttggtcaggctggtctcaaactcttgacctcaggtgatccacccacctcggcctcccaaagtgctgggattacaggcgtgagccacaagatccaattatcccccaccttgcaygtttctcagttgcaacccctgctgccaagagataataaaacctgtttctgaggagtcaccactgaggccaagaatcctaaatgccactgaaggaagctccctggcccagatggggaaggctgggctgatcctccctcagcctcgccctgctaaaggcagggcctccattatcctgtaagggagctcaagtaagacgtgtaatcgcactgcgacctgcaaaacgctgcctgcgagcccgctagctgatgactgctcattactctccctttggggagacctgggctctggcataaggagagc

SEQ ID NO: 29247 - DNA, 601 bp, Human
ccattatcctgtaagggagctcaagtaagacgtgtaatcgcactgcgacctgcaaaacgctgcctgcgagcccgctagctgatgactgctcattactctccctttggggagacctgggctctggcataaggagagctggggcagcccccttagtgggtaaaggggaggcagccccctaagtcggtaaaggggacaggaggacaggctactgcagggtccaggaaggaaaagccacatccaatatcaggcccaaagaggcctcaccccaaggcaggtcagaacggccttagccagggccagraccagggcgagacaggaggaatgctgttccggggttgtaggggggccttctctgaggccccctgtccctcatcagggtcacagccctgggggatggaggggacggtcccctccccagtcctcaaacctgcccccttggaatggcactcacccagggatgccgccggcctccatcttgttggctacagtgacatcagtcgaccacacgtcgtactgccagcgcttctggcccaggacgccccccagcacggtgcccgtgtgcacccccacacgcatgtccaccccagtcttggtcttctcc

SEQ ID NO: 29248 - DNA, 601 bp, Human
tgcccgtgtgcacccccacacgcatgtccaccccagtcttggtcttctcccgcacatacctgccaggtacacacagaaaggagggtcagggtgtggccttcacgaggcagccagctgcccctgctcctgcaggagaaattcattgtgggcctcttcccctccacaagagggggcctggcaaggtccccacagcttggtgttgggtggggggtaaggcaggccagggccagcccagagtcaggcatcacaggccagcaggacgagggcaccaagcgactttcctccctatccccacttcccraggggcctcagtttctctctgccaattactcttttattcattcgtgcagttaatatttcactgagcatcaagtatgtgccaggcacgttcaaggtgctgcagacacagaggtgaagaaaatagccgtgaacagccccctgcctgaacgtgtctgacagggcagggagagaatgttagagttcctggactaccacccctggggtaaaggccacactgctttctttccagggcaatactagacgggctttaacctggaagatggtaaaaatgcaaagccgccccctcggagaagggggtaaa

SEQ ID NO: 29249 - DNA, 601 bp, Human
aggagagatggggagcccctgtgggggtcccagcaagtgtgaggaggcgtgagaaaattcacaactgcaacttctggcaaaaagagaatacgtggactaaggctggaaaagtgtgccccacaggctgggggagcctcgcaggtcccctgggctgtgaggaaggtaagccacatcccagcttctagagcgggagcctgcgccacccatcaaccagtgctgtgtcccagtctctgcttccagcagatcccccacccaggggccatggccagcgcggaagacctgcttctccctgggtccaggrccggggcccttgctctgggagcctccctcccagaggcatcccacttacgagatggcctccaccatggccagccccatgaggatggagcagacggcgtggtcctcccggtagtcaggcaagccgcagatgcagtagtagcagtcgcccaggatcttaatccgcagctggtggtatttctgaaaggggagggcctggcctgtgctccagcccctcctcagtgagggaggagtggccaagaaagcagaggaaggacagtgggagaaaatcatggggccggggatgggggccaggcagaggcca

SEQ ID NO: 29250 - DNA, 601 bp, Human
gccccacaggctgggggagcctcgcaggtcccctgggctgtgaggaaggtaagccacatcccagcttctagagcgggagcctgcgccacccatcaaccagtgctgtgtcccagtctctgcttccagcagatcccccacccaggggccatggccagcgcggaagacctgcttctccctgggtccagggccggggcccttgctctgggagcctccctcccagaggcatcccacttacgagatggcctccaccatggccagccccatgaggatggagcagacggcgtggtcctcccggtagtcrggcaagccgcagatgcagtagtagcagtcgcccaggatcttaatccgcagctggtggtatttctgaaaggggagggcctggcctgtgctccagcccctcctcagtgagggaggagtggccaagaaagcagaggaaggacagtgggagaaaatcatggggccggggatgggggccaggcagaggccatgagggcaggccccgctggagagccaggcggggccagggacttacagctgccagcttgtcaaagcgggcaaagagctcgttgagcagcttcacaagctcctgggcactgcaggc

SEQ ID NO: 29251 - DNA, 601 bp, Human
cccccaggaccaacgtgtgcaccacacaggagaccacggagatgatcacgatggggctgaggctgaggggcagcgtgatgaagaaggagaagacaaagaagacctgccagcccaccgtgtcactagccgcgtgggcacgcgcgaagttcaggcccaggtaggagaagatctgggcggttatgagcagccacagcacgtagggcagcactctgcgggtgacccggtccgggagcagcccctttttgcagagcacgaagaggatgatgtccaacaccagtccaattccagccacggcgagggragccagcttgtcgctggagaagaccacagcacacatgaccaccacgtagcagtcaaagagggctgcaaagaccaccagcaccagcagggtctcgtggcgctgccttttgaagtaggtctggtagaggttctccaaggactccggcacgaaagtcagccgcatgaagcgaggcaggcacaggcaggagcccgagttccggaccgagatttcatgggtccggcccaccccgcggtcagggtcggagggcaggctgacggagtactcggctgagtactcggccgagtattcgggctcggagaa

SEQ ID NO: 29252 - DNA, 601 bp, Human
gtattcagcactaagagaaagcctacgtaagtattccaaaaaccaccttcatttattcctttcctctaaactgagctccaggcagaggtgaaatgctgggcctgctgaccttcacacaatgtcagactccactgactagcttcaacaagagctgacagcagttttctgaccttcagcgggacgcgaccctaagaatcgaaagagaggaacctcaccgattcagaacaggcctcggagagctagcgcccaagccctgaccttcacccaagatcccccttctagggccgctgtcagccgaagrcaggaatcttgaggccctgtctctggacaccatcgagttaactgtctgccctgtaccattctgcctctgcgcaggtgacgagcaaaagggcacctgtgtcgcctgctctgtccagccggagaagccacgggtgcaagatggcggcatcgccacagcccctcgccctcctgcagagagcgcccgagccggcgcaccaccaccctgcagccccacccggccgcctgcatcatgccggccttcggtgctcaccagtccggcccgccgaggaagggcgcggaccacggccgcagcaacgcgcac

SEQ ID NO: 29253 - DNA, 601 bp, Human
ggagagacaatttagaaaccagcttcactgttgtcacagtgctggccacatgaaatggttctttgcacctgcaggacgttttcacggtcgtttcgtattcagcactaagagaaagcctacgtaagtattccaaaaaccaccttcatttattcctttcctctaaactgagctccaggcagaggtgaaatgctgggcctgctgaccttcacacaatgtcagactccactgactagcttcaacaagagctgacagcagttttctgaccttcagcgggacgcgaccctaagaatcgaaagagagraacctcaccgattcagaacaggcctcggagagctagcgcccaagccctgaccttcacccaagatcccccttctagggccgctgtcagccgaaggcaggaatcttgaggccctgtctctggacaccatcgagttaactgtctgccctgtaccattctgcctctgcgcaggtgacgagcaaaagggcacctgtgtcgcctgctctgtccagccggagaagccacgggtgcaagatggcggcatcgccacagcccctcgccctcctgcagagagcgcccgagccggcgcaccaccaccctgca

SEQ ID NO: 29254 - DNA, 601 bp, Human
aagtagttccaattttacttaaaaacaacaacaacaacaacgacaacaagcggccgggcacgacggctcatgcttgtaatcccagcacttcagaaggccgaggcgggcggatcacctgacgtcaggagttcaagaccagcctagccaacatggtgaaaccccgtctctacgaaaaactacaaaaagtagcagggcatgacggcgggtgcctgtaatcccagctactcgggaggctgaggtgggagaatcacttgatcctgggaggcggtggttgcagtgggcggagatcacgccattgcartccagcctgggcgactgagcgagacaccatctcaaaaaaaaaaaaaaaaaaaaaacaagcaaacaaaaactgaataaatgctagagttagattagaaaccaagagttgtggcatgtggacttattttactctctcaacaaatcctgcagccacctggaacttccttcagtttctccttcaagttgtaatactgcgactggtcactgtcaattctgaagcctctaccttccataggagctagatgaaaaccgttaaaaatgcttttttgttaacagaaacccaagatgctaccagcggttg

SEQ ID NO: 29255 - DNA, 601 bp, Human
cacttttggaggctgaggcaggcagatcacctaagggcaggagtttgagaccagcctgaccaacatggagaaccctgtctctactaaaaatacaaaattagctgggcatggtggcacatgcctgtaatcccagctactcgggaggcggaggctgaggcagaagaatcgcttgaacccaggaggcggaggttgcggtgagctgaaatcacaccattgcactcaagcctgggtaacaagggcaaaaactccatctcaaaataataataataataataataataataataataataataataataataaaaatctggtcctcggatcttttcaaagcccatttctcaacaacaaaaaactagttttgtgatcataataatccaaatatattctacagacccagcacagtggctcacgctagccacagtggtaatgctagcactttaggaggctgaggcaggcagatcacttgaggtaaggagttcgagaccagcctggccaacattgtgaaaccccgtctccactaaaaataaaaaaaaaattagctgggcacgggcatgcctgtagtcccagctactcaggaggctgagacagaagaactgct

SEQ ID NO: 29256 - DNA, 601 bp, Human
gtatcagctccaagaatacgctcttcaagaatagaggacatctcagcagtccctatggaagacaattcaattcaattaaaaaaataatctgggccaggcacagtggctcacagctgtaatcccagcacttttggaggctgaggcaggcagatcacctaagggcaggagtttgagaccagcctgaccaacatggagaaccctgtctctactaaaaatacaaaattagctgggcatggtggcacatgcctgtaatcccagctactcgggaggcggaggctgaggcagaagaatcgcttgaacmcaggaggcggaggttgcggtgagctgaaatcacaccattgcactcaagcctgggtaacaagggcaaaaactccatctcaaaataataataataataataataataataataataataataataataataaaaatctggtcctcggatcttttcaaagcccatttctcaacaacaaaaaactagttttgtgatcataataatccaaatatattctacagacccagcacagtggctcacgctagccacagtggtaatgctagcactttaggaggctgaggcaggcagatcacttgaggtaag

SEQ ID NO: 29257 - DNA, 601 bp, Human
caacagaggtatcagctccaagaatacgctcttcaagaatagaggacatctcagcagtccctatggaagacaattcaattcaattaaaaaaataatctgggccaggcacagtggctcacagctgtaatcccagcacttttggaggctgaggcaggcagatcacctaagggcaggagtttgagaccagcctgaccaacatggagaaccctgtctctactaaaaatacaaaattagctgggcatggtggcacatgcctgtaatcccagctactcgggaggcggaggctgaggcagaagaatcrcttgaacccaggaggcggaggttgcggtgagctgaaatcacaccattgcactcaagcctgggtaacaagggcaaaaactccatctcaaaataataataataataataataataataataataataataataataataaaaatctggtcctcggatcttttcaaagcccatttctcaacaacaaaaaactagttttgtgatcataataatccaaatatattctacagacccagcacagtggctcacgctagccacagtggtaatgctagcactttaggaggctgaggcaggcagatcactt

SEQ ID NO: 29258 - DNA, 601 bp, Human
ataccatcaccaatacttaagacacgcccagtttcttcaagatcaacagaggtatcagctccaagaatacgctcttcaagaatagaggacatctcagcagtccctatggaagacaattcaattcaattaaaaaaataatctgggccaggcacagtggctcacagctgtaatcccagcacttttggaggctgaggcaggcagatcacctaagggcaggagtttgagaccagcctgaccaacatggagaaccctgtctctactaaaaatacaaaattagctgggcatggtggcacatgcctgyaatcccagctactcgggaggcggaggctgaggcagaagaatcgcttgaacccaggaggcggaggttgcggtgagctgaaatcacaccattgcactcaagcctgggtaacaagggcaaaaactccatctcaaaataataataataataataataataataataataataataataataataaaaatctggtcctcggatcttttcaaagcccatttctcaacaacaaaaaactagttttgtgatcataataatccaaatatattctacagacccagcacagtggctcacgctagccacagt

SEQ ID NO: 29259 - DNA, 601 bp, Human
tgtggctatttaaatttgtcaaatttaaaagattaaaaattcagttcctgtcacactagccacattttacatgattaatagtgatagtatagtaggtaccatattaaacagcacagatgtattctcatcactgcagaatactacatatttccaatactactggacagtactgttctagacacttggatttcaaaagctaaaaggggaactcagaattaatctgtttcgacctcacctttcaaagataaatactgtacactgaagatgctaaattggccaatgtcttacagctaatgataaytttgggctctgtaattattcttccacatcaagtggctctttttccgtagtagacattaccaagagtatcaagactatcttttcccatatctgcatgcctactagacagttccactctctctagtttatccagatgtcatcctctgctttccctaactcctacaacttatttctcataccctgacagatgaggctcaacccaatacaaagtagacttacattagagagcttctgatagctacaccaaaactcgcctttgaacaatatgtctactcactagaaatacaaagtcacggacttc

SEQ ID NO: 29260 - DNA, 601 bp, Human
cttccttaattagtttatcatttccaaacacgacaacaccaacattgtcaggttccaagttcaaggacataccctgcacaaaagacacaattgaacatcaatgaagctgaatgggcactcctccccatacaccaatactacataagaaaatagtcggggggtggggggggaagcagtattgtccttttcacctggtttattcttgagtacttttccaactaacaaacaaccctctctgattaagacttttaaaattgctattttgaataatcttaggacagcacattgataagcctaataygctcactatcatatcctcaaataactattacagaagcaaagaaattggacaggttaataagcttttttccactgtattttctttggcaatgattcttgggctgggtgatcagtatgaaataaagtgatgaaggccaaatggaaatcttaagacaaatttgattatcatcttatttatgtgtgagaagctccataaacagtttcaaaaattaatcaaaacctgtactcttcgagttagtagaaagtgaaattaaaagctacctaactgtaaccaatcaaatacaaattttcataacataac

SEQ ID NO: 29261 - DNA, 601 bp, Human
gcaactatatctaacgaacattaaacctacctttccatcaatagcattaccaagggcatcaactacacgacccaacagctcctcaccaactggaacgtccacaatggctcctgtcctcttcactatatctccttccttaattagtttatcatttccaaacacgacaacaccaacattgtcaggttccaagttcaaggacataccctgcacaaaagacacaattgaacatcaatgaagctgaatgggcactcctccccatacaccaatactacataagaaaatagtcggggggtggggggggaagcagtattgtccttttcacctggtttattcttgagtacttttccaactaacaaacaaccctctctgattaagacttttaaaattgctattttgaataatcttaggacagcacattgataagcctaatatgctcactatcatatcctcaaataactattacagaagcaaagaaattggacaggttaataagcttttttccactgtattttctttggcaatgattcttgggctgggtgatcagtatgaaataaagtgatgaaggccaaatggaaatcttaagacaaatttgattatcatc

SEQ ID NO: 29262 - DNA, 601 bp, Human
tcttggaaccaattggaccctgttaaaaaataaaaagaaaaaccctaagcataatcagttttgatgtttgttagaagctgcaactatatctaacgaacattaaacctacctttccatcaatagcattaccaagggcatcaactacacgacccaacagctcctcaccaactggaacgtccacaatggctcctgtcctcttcactatatctccttccttaattagtttatcatttccaaacacgacaacaccaacattgtcaggttccaagttcaaggacataccctgcacaaaagacacaaytgaacatcaatgaagctgaatgggcactcctccccatacaccaatactacataagaaaatagtcggggggtggggggggaagcagtattgtccttttcacctggtttattcttgagtacttttccaactaacaaacaaccctctctgattaagacttttaaaattgctattttgaataatcttaggacagcacattgataagcctaatatgctcactatcatatcctcaaataactattacagaagcaaagaaattggacaggttaataagcttttttccactgtattttctttggcaat

SEQ ID NO: 29263 - DNA, 601 bp, Human
tttaaaaagagaaagtaaatataaatcttcctaaacttaaaaggacttccctgtgggggaaagaaagagagatcagactgttactgtgtctatgcagaaagaagaagacataagaaactccattttgttctgtactaagaaaaattcttctgccttgagatgctgttagtctgtaaccatagccccaaccctgtgctcgcagaaacatgtgctgtgttgacttaaggtttaacggatttagggctgtgcaggatgtgctttggtaaaaatgtgtttgcaggcagtatacttcgtaaaagtyatcgccattctccagtctcgagtacccagggacacaatgcactgtggaaggctgcagggccctctgcccaataaagcctgggtattgtgcaaggtttctccccactgagacagcctgagatatggcctcgtgggaagggaaagacctgaccatcccccagcccgatactcgtaaagggtctgtgctgaggaggattagtgaaagaggaaagcctctttgcagttgagataagatgaaggcatctgtctcctgcttgtcccggggaatggaatgtcttggtgtaaaacccaatcgtacatt

SEQ ID NO: 29264 - DNA, 601 bp, Human
tcagcagcaatgggacttaagataatagcaatgggactaaatttcttttaatacctgcatctgtaagtctcttcaccaactgggcaacagtggatctcttttgaccaatagcaacataaatacagtacagcttcttcttttcatcagatccatcattgaaacgtttctggttaatgattgtgtcaatagcaattgaggttttcctttaaaaagagaaagtaaatataaatcttcctaaacttaaaaggacttccctgtgggggaaagaaagagagatcagactgttactgtgtctatgcakaaagaagaagacataagaaactccattttgttctgtactaagaaaaattcttctgccttgagatgctgttagtctgtaaccatagccccaaccctgtgctcgcagaaacatgtgctgtgttgacttaaggtttaacggatttagggctgtgcaggatgtgctttggtaaaaatgtgtttgcaggcagtatacttcgtaaaagtcatcgccattctccagtctcgagtacccagggacacaatgcactgtggaaggctgcagggccctctgcccaataaagcctgggtattgtgcaaggtt

SEQ ID NO: 29265 - DNA, 601 bp, Human
acctattaaatagaagttgcatatgtgaacttttacttcagtacaaataaatggattctaaaaatttatttcctttgacctgtttggataagtcgtcatagatgatcaaagcatgtttgccattgtctctaaaatactctcccatggaacagccagagtaaggagccaggtactgaagtggggcagcatccgaggccgtagccgacaccacaatggtgtacttcatggcatctgagaaaatatattttacaattttatcaatattgtggttttaaattggaggctactataaaaattaccyaagtgctaaaaatatttaccattaagagttaatcaggccaggcgcagtggctcatgcctgtaatcccagcactttgggaggccctaggcgggtgatcacctgaggtcaggagttcgagaccagcctgaccaatatgaggaaactccgtctctactaaaaatacaaaaattagccggacgtggtggcatgcacctgtaatcccagctactcgggaggctgagacaggagaatcgcttgaacccaggaggcagaggttgcagtgagctgagatcgtgccatcgcactccagcctgggcaaca

SEQ ID NO: 29266 - DNA, 601 bp, Human
aacataataggcaacatatttatactgaaatacatacaaatgaagtgatataatttctatttgattcaaaattatctagaagggagaacagtagtggttaaaaatgaaactagaacgaaacatgctactctatgcaataactgggtgacagatacatggggtttcactatgccattctcctaacttttctatgtatttgaaattttccataataaaaagtaaaatgcatttagcaaatcagtcaatataccattagtctcaaccaatgccttagaattatccaaatcttttttaacatttmttttaatcattaaaataatacctgtccgtcagtgatggaaatgacatttgttggaatgtaagcagacacatcaccagcctgtgtttctatgactggcaaagcagtcaaggagccaccaccaaaagcatcgttcattttggctgctctctccagcaaccgggagtgtaggtagaacacatcaccaggataggcctcacgaccagggggtcggcggagcaacagagacatctgacggtaagcaacagcctatggtacagaataggtttgtgaagttaacctattaaatagaagttgcatatg

SEQ ID NO: 29267 - DNA, 601 bp, Human
acaatgcaaagcatcagtaccccaaatctttcacgacctgacctgtatattttattgctgcaattaggagatgtgcatgagatgagaaaaaaacataataggcaacatatttatactgaaatacatacaaatgaagtgatataatttctatttgattcaaaattatctagaagggagaacagtagtggttaaaaatgaaactagaacgaaacatgctactctatgcaataactgggtgacagatacatggggtttcactatgccattctcctaacttttctatgtatttgaaattttccayaataaaaagtaaaatgcatttagcaaatcagtcaatataccattagtctcaaccaatgccttagaattatccaaatcttttttaacatttcttttaatcattaaaataatacctgtccgtcagtgatggaaatgacatttgttggaatgtaagcagacacatcaccagcctgtgtttctatgactggcaaagcagtcaaggagccaccaccaaaagcatcgttcattttggctgctctctccagcaaccgggagtgtaggtagaacacatcaccaggataggcctcacgaccagggggtc

SEQ ID NO: 29268 - DNA, 601 bp, Human
tagcaagcttaaagtaagaaatcaactatcttcaaatttaagtcattatgccaaaaagctgaaactcaaaacctaacaatgcaaagcatcagtaccccaaatctttcacgacctgacctgtatattttattgctgcaattaggagatgtgcatgagatgagaaaaaaacataataggcaacatatttatactgaaatacatacaaatgaagtgatataatttctatttgattcaaaattatctagaagggagaacagtagtggttaaaaatgaaactagaacgaaacatgctactctatgyaataactgggtgacagatacatggggtttcactatgccattctcctaacttttctatgtatttgaaattttccataataaaaagtaaaatgcatttagcaaatcagtcaatataccattagtctcaaccaatgccttagaattatccaaatcttttttaacatttcttttaatcattaaaataatacctgtccgtcagtgatggaaatgacatttgttggaatgtaagcagacacatcaccagcctgtgtttctatgactggcaaagcagtcaaggagccaccaccaaaagcatcgttca

SEQ ID NO: 29269 - DNA, 601 bp, Human
aaatacgcacgctagcaagcttaaagtaagaaatcaactatcttcaaatttaagtcattatgccaaaaagctgaaactcaaaacctaacaatgcaaagcatcagtaccccaaatctttcacgacctgacctgtatattttattgctgcaattaggagatgtgcatgagatgagaaaaaaacataataggcaacatatttatactgaaatacatacaaatgaagtgatataatttctatttgattcaaaattatctagaagggagaacagtagtggttaaaaatgaaactagaacgaaacaygctactctatgcaataactgggtgacagatacatggggtttcactatgccattctcctaacttttctatgtatttgaaattttccataataaaaagtaaaatgcatttagcaaatcagtcaatataccattagtctcaaccaatgccttagaattatccaaatcttttttaacatttcttttaatcattaaaataatacctgtccgtcagtgatggaaatgacatttgttggaatgtaagcagacacatcaccagcctgtgtttctatgactggcaaagcagtcaaggagccaccaccaa

SEQ ID NO: 29270 - DNA, 601 bp, Human
ggtggtgggcacctgtaatcccagctacgtgggaggctgaggcaagagaattgcttgaacccggagacggaggttgcagtgggccgacagggtgccactgcactccagcctcagtgacagagtgagaatcagtctcaaaaaaaaaaacaaaaaaaaaacttacaaagagctcagccttgaattatctagcccagttgactgtaccaatattcaagtaaaatagatcaagaagcatttgcttaccaatttctcaatttgatcttggttttaaagaataacacaaatgacagaaaacaactaygcattatggaacctttatttttcatgtgatttctgtacataaggagtatgagagtaacccttttacaaatggaactaatttactagaacaatgacaaaactgaactggtatttgatgtgaatccacaggagtttaagcttcaaatccagccaagaaatttgttacaatctctttcagctttgcatctgattgttctgagatctttccatcagccctatttggaaataaaagcaggtcgtaagttctgacctggaaaaagttttaatgactagcctaactacagatttgaaaataatttta

SEQ ID NO: 29271 - DNA, 601 bp, Human
caaacatggaatggaagcttcatccttcttggtgcaatctactgcagtattttctgtcctgtcctatcctactctattctttccaaatactagttgagaccccctgtacagattgcatgactcctccttggattcgtcaacaccacagttaaacgctctgctcatatagccttcacaatggcctgtgaggcacgtcttgttcctggaccactgtggggataaggagtggagtgacttgcctaaagcctcccagctagtacaaggcacagccagccagcctttctacttccatctcaagcacagtttgatgctcttgaccctactctgggcagaacagggccccaccagcccaggcacacatcatctctggacccataatcctctgttctggccctgcctgggggccacctctccaggtgggagaaaggctgggaagctggatgaagaggctggtatgtggtttggggctagtttggagcagagtgaagacctggctgagttgaatttgcataccaataaatatgtctaaaatgtgtcatttttggctgggcccggtggcttatgcctgtattccccagcactttggaaggccgaggagggc

SEQ ID NO: 29272 - DNA, 601 bp, Human
attatttacttagttgtttgtttatttttcagacaggatctcactatgttgcactggcctcaaactcctgggctcaaacaatcttcctgcctcagactcccaagtagctgggattataggcacacactgtttcttaacaatatccacctattgtatttataaatatttatagtctttcttttgctagttttacctccaggaatttatcttagagaaatacatatgtatacaaagatgtccacacagggatatttgctgtggcattgcttatgatattgagatagcagaagcagtccatcastgcagaactgcttaaataaattatggcacatccaggcaacagaacagtatgcagccattaaaaagaacgagtgcggtcgggtgcggtggctcacgcctgtaatcccagcactctgggaggctgaggtgggtggatcacgaggtcaagagatcgagaccaaccggactaacatggtgaaacccagtatccactaaaaatacaaaaaatggccaggtgcggtggctcacgcctgtaatcccagcactttgggaggccgaggcaggcgaatcacgaggtcgggagtttgagaccagcctggcc

SEQ ID NO: 29273 - DNA, 601 bp, Human
tgggacctctggagtcttggtcctcagtgctcattgtgtgtggccctcccacacacaaacgaagaaacggaggccccacagcagcaactcagtaacagtgcaggagacatgaccaggtccgcagggggccagggaaggaggtccctccagtaccttgcccagggggttgttgggggtgttgaggaccagggctttggtgcgtgatgtgaatttgccggccagctccatggggtccagctgccagttgctgctggaacccagttctccattctggatgggaccctgcaagagcaggtggcayggggtggtaccacttaaccacctgacatgcaggtcttccccagcatctatccccaccttctctcccctgggatcccaacacacacacctcccctctgccctcccagcttagaggaactggcttccttcacttctttcctccttttccaactcccagggtccaactcagcccacgccttggatccctctgcccatccatcctctacctagcatccttaccggcttcagggacacaaacacaggacgaccccctgccatcattgtcatgggctcgtagcagtcaaaaaagggttcgatgatg

SEQ ID NO: 29274 - DNA, 601 bp, Human
gctgggactacaggcacgtgccaccatgcccagctaatttttgtacttttagtacagacggggtttcaccatgttggccaggctggtctcaaactcctgacctcaagtgatctgccagcctcagcctcccaaagtgctgggattacaggtgtgacccaccatgctcggcataggatttctttgacctcaacctttcgacaaccagggaggcaggtgctactgtgacactgtgtactctgggaggcaaaggtcacaggatctgcagggctccataaccctgggttctaactaccaggcctgygctgactctcaggtggggtcaaggccctcccaccaatgtgcaggggaggggccccaggctggcttggctcaccaatgctgatgtgctggtgcccgtcgtagaccatccactggtagacttcatcagtgatacacaccacgtcatgctgctggcaaaggctggccaccagctccagctcttccctggagaacacctgcagatgcccaaggagagcacagacctgcagctgggaccgtccccaaacacagaggcctactcagagaggttaaagaacacagctgcggccaggtgcggtggctc

SEQ ID NO: 29275 - DNA, 601 bp, Human
agatggagtctcgctctgttgcccaggcaggaatgcaatggcgccatcttgcctcactgcaacctccgcctcccaggttccagtgatcctcctacctcagcttcctgagtagctgggactacaggcacgtgccaccatgcccagctaatttttgtacttttagtacagacggggtttcaccatgttggccaggctggtctcaaactcctgacctcaagtgatctgccagcctcagcctcccaaagtgctgggattacaggtgtgacccaccatgctcggcataggatttctttgacctcawcctttcgacaaccagggaggcaggtgctactgtgacactgtgtactctgggaggcaaaggtcacaggatctgcagggctccataaccctgggttctaactaccaggcctgtgctgactctcaggtggggtcaaggccctcccaccaatgtgcaggggaggggccccaggctggcttggctcaccaatgctgatgtgctggtgcccgtcgtagaccatccactggtagacttcatcagtgatacacaccacgtcatgctgctggcaaaggctggccaccagctccagctcttccctggaga

SEQ ID NO: 29276 - DNA, 601 bp, Human
ctaagttatttgcacaattttttttctttctttcttcctttcctttccttccttccttccttctttctctctctctctctctccctccctccctccaccccccatttctttctttgtttttttttttttgagatggagtctcgctctgttgcccaggcaggaatgcaatggcgccatcttgcctcactgcaacctccgcctcccaggttccagtgatcctcctacctcagcttcctgagtagctgggactacaggcacgtgccaccatgcccagctaatttttgtacttttagtacagacrgggtttcaccatgttggccaggctggtctcaaactcctgacctcaagtgatctgccagcctcagcctcccaaagtgctgggattacaggtgtgacccaccatgctcggcataggatttctttgacctcaacctttcgacaaccagggaggcaggtgctactgtgacactgtgtactctgggaggcaaaggtcacaggatctgcagggctccataaccctgggttctaactaccaggcctgtgctgactctcaggtggggtcaaggccctcccaccaatgtgcaggggaggggccccaggc

SEQ ID NO: 29277 - DNA, 601 bp, Human
ccaaggatcttgcagggggtggtgacctcccaccctcagcaactcaccttccagccagtggcgctgaaggtcttgccggcgctgccgatggtcagggtccgttcccacatgccagggaggctggctgcccaaggccgaacagaacagctgctgagactggggtgagggggacgggggaggatggtggtctgggccccaggggacacgcataggcttttgacaccctggattcctctacatactaagttatttgcacaattttttttctttctttcttcctttcctttccttccttccttccttctttctctctctctctctctccctccctccctccaccccccatttctttctttgtttttttttttttgagatggagtctcgctctgttgcccaggcaggaatgcaatggcgccatcttgcctcactgcaacctccgcctcccaggttccagtgatcctcctacctcagcttcctgagtagctgggactacaggcacgtgccaccatgcccagctaatttttgtacttttagtacagacggggtttcaccatgttggccaggctggtctcaaactcctgacctcaagtgatctgccagc

SEQ ID NO: 29278 - DNA, 601 bp, Human
gaggttgcaatgagccaagatcatgccactgcactccagcctgggggacagagcgagactctgtttcaaaaacaacaacaacaacaacaacaacaacaacaacaacaacaaagattaatagtgaggaattcatttgagggccttgggtgctaggcctggttgtgccactatgtgactacagtaaccatttgtacaaagttgtgggggtgtctgaggttcttctgggcattcttcacaagttagatcagccatcagcatgagtgtgaagcagagagaagccgtcaataaggatcttaataayttaaacattttattatggacgaaaaggagaggcttgaggactcaagcctaaaggcaactccccaaggccaagatgagccagggaaggtgaggttatacctgagccttagcaggggccatgcagagctgggatgtgatcggtacatggtggaagtctaccgtccgtctcagccaagcctggagagaccagaagcaacacaagaccctacaaacccacctatggaggggcagggagaggcccaggtcaggccaccctcacctttcagacaggaggcacttggttctctaagatgaagaaggg

SEQ ID NO: 29279 - DNA, 601 bp, Human
tttcttgaagatttgcattttatttttctaaaaagcatggttccgaccgggcgcggtggctcacgcctgtaatcccggcactttggaaggccgaggcgggcagatcacaaggccaggagaccgagaccatcctggccaacatggtgaaaccccgtctctactaaaaatataaaaattagctgggcgcggtggcgcatgcctgtaatcccagctcctcgggaggctgaggcaggagaatcgcttgaaccagggagtcggaggttgcagtgagccaagatcgtgccactgtactccagcctggcaacagagcgagactccttctcaaaaaaaaaaaaaaaaagcatggttccttccctctaggaactcaatttaggatgtgaccaacttgtagaagggaaataaataacagatggcactttgcaatgacttagatgcactagccgcattgggggatgggaggcttataaatcatttcttggcccagtgcaaagatggccaaggaaagcaggaaggactactcttacactccttgctggtctttttttctatatatagatgatagaggtactgacaacaactgactctcagaaactgctacacc

SEQ ID NO: 29280 - DNA, 601 bp, Human
gttccgaccgggcgcggtggctcacgcctgtaatcccggcactttggaaggccgaggcgggcagatcacaaggccaggagaccgagaccatcctggccaacatggtgaaaccccgtctctactaaaaatataaaaattagctgggcgcggtggcgcatgcctgtaatcccagctcctcgggaggctgaggcaggagaatcgcttgaaccagggagtcggaggttgcagtgagccaagatcgtgccactgtactccagcctggcaacagagcgagactccttctcaaaaaaaaaaaaaaaaagcatggttccttccctctaggaactcaatttaggatgtgaccaacttgtagaagggaaataaataacagatggcactttgcaatgacttagatgcactagccgcattgggggatgggaggcttataaatcatttcttggcccagtgcaaagatggccaaggaaagcaggaaggactactcttacactccttgctggtctttttttctatatatagatgatagaggtactgacaacaactgactctcagaaactgctacaccagctgaatgccctgttggaacaggagtctagatgtcagc

SEQ ID NO: 29281 - DNA, 601 bp, Human
tttttctatatatagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtatgtttgaagctacattttygtaattttgctcagtgtgttttggagatggaattgttaccttttggctggtattcataaacttgaccttttttttttcagcacgtagccaaaacattaattttgtctactacagcattaatatttcttatcataatcaagagtagtacatcaggtattagacttaaattctgaaatgaaaaatagtctaatatcaagtaacaaattgcagtttcctagtaagaaaattggctgtttttaaaaaacccttcttgataggttggatttgtccatttatttactatttttagatataaacaaa

SEQ ID NO: 29282 - DNA, 601 bp, Human
ttaagatatatttgttaatcactacccatatataaaattgtaaatgttttagccttagacctagtcaagacttgcttatgcttggcatttccagcttcagtgtacatgcagtagggaggagagtgtgtctgaaggaggagcaactattttcctatactagataaacaagactgtcactttcagagcttaactgttacaaatgcatctgcctttcctgtacacccatggtcactggaggaaaataagatgatgtgacaattggaaggaaactcatattttagtcctcggtatctaacacagygcatcataaaaaaggacttcaatatttgttgaagattcaagaaatttgcttcaacagactaattaagctctttagacatttcacatgtagtcattacctttgaatctgtaaatgttgcacaaatgaataatatacagctattcctcaggtataattcagtcttatgtgagaataagatcgttgctcttatgtacaagtcataataagaaaaataactacattatgcctttaaagaggcataagtgtactgctgaagagtttacaagaagagagagagcacagagatattaatactggtaa

SEQ ID NO: 29283 - DNA, 601 bp, Human
gtggatgttgaaatatttattaaaactaaaagaaaataaatcttgtatttgtggcatagtactattcattttaattttttggcccaaatcatctaaaactcccatatggtgcctttagaagttagtatctctgatggaaggggaattcctttcaatagttcatttgctatgttaagtgtgcataagctttactttaaaaattgacttcaatgtttttctaaaaacatcttttgactagatgtagtattacctaataaaagtaataccattttctttttaaaggagaaatagcattaatttkgaaagactagaagctcaactgaaggcatgtcattgcaggatcatattttctaaagcaaaggtaaatattttataaagattatgcctattgatatgatctgtttttatatttggcatttactttaaatttatctcttttagccttctgtgttggcattgtctatcattgcattagagatccaagcacagaagtgtgtagagttaacagaaggaatagaatgtcttcagaaacattccaaggtatgtgaaggacatagcctaaatcctattaacagctgtaaaagaaactaaaccccttcta

SEQ ID NO: 29284 - DNA, 601 bp, Human
acaaagggccctgaagtttgagtgcgccctccatttgccctgtgctgaacttgcagagacatctgttgatctggaggcaggacagcttctgggacacacaaaaatgtggttccctttgtcacttctttggtggtcttaaattatcttgcttcatatatcattccttaaattccagtcattgttccagcataatgagatggaatctgccagtagatttgcctagcctgtccacttagctgaataccagtttgaaggaaaacagggtggccacttacaaacttacggagctcaggacagatawtcttataaagaatagacttgcttgggtggtagtacgttgtgcaattttgactattcactggctttatacctgcaaatgattcttcgttcatgtgtaaattgtccaccatgggtttatctagggctagtatgtatacctgggctacagaataaaaataaaatctaatactggcccaagcaaagtataatttgcttaagaggttacgctaacaaacgattttgagtaaatatttacaaatgtaggatcttagtttaggaaattataacaaataccttaatataacattttaagctacttata

SEQ ID NO: 29285 - DNA, 601 bp, Human
tagtcctgtctttttcttttcttttttgttttcagacagtctcactctgttgcctaggctggagtgcagtggcactgtctcggttcactgcaacctctacctccaggttcaagcgattctcctgcctcagcctcctaagtacctgggattacaggcgcatgccaccatgcccggctaatttttgtatttttagtagagacagggtttcaccatgttggtcaggctggtctcgaactcctgaccttgtgatctgcctgcctcagcctcccaaagtgctggggttacaggcgcgagtcactgygcccagcctttttttttttttttttttgagacagagtctcactctgtcgcctaggccagtggcacaatctcggctcactgcagcctctgcctcccgggttcaagcgattctcctgcctcagcctcccaagtagctgggattacaggcatccaccaccacacctggcttatttttgtatttttagtagagacggggtctcaccacgttggccaggctggtctcgaactcctgaccttatgtgatccgcctgcctcagcctcccaaagtgctgggattacaggcatgagtcaccgccccagc

SEQ ID NO: 29286 - DNA, 601 bp, Human
gagggacaggcatggtggctcacgcctgtaatcccagcactttgggaggccaaggcgggtggatcacttgagatcaggaggtcaagaccagtctgaccaacatggtgaaaccccatctctactaaaaatacaaaaattagccaggcgtggtggcgagcacctgtaatcccagctcctagggaggctgaggcagagaatagcttgaaccctggaggaggttgcagtgagccaagattgcccccattgcactccagcctgggtgactgagacagactccatttcagaaaaaaaaaaaaaaaaaggcaaaaaaggccaggcgcagtggctcatgcctgtaatcccagcactttggaaggccgaggagggtggattacaaggtcaggagttcgagaccagcctggccaacatggtgaaacctcgtctctaccaaaaatacaaaattagcctggtgttgtggtgcacgcctgtaatcccagctatttgggaggctgaggcaggagaattgcttgaacctgggaggtggaggttgcagtgagctgagatcatgccactgcactccagcctgggtgacagagtaagactctgtctcaaaaaaagtaat

SEQ ID NO: 29287 - DNA, 601 bp, Human
catagcaataccccatctctacgaaaaatttaaaaattagccaggcgtggtcactcatggctgtaatcctaggactttgggaagctgcggtgggcggatcgctggagctcaggagttcgagaccagcctgggcaacatggcgaaaccctgtctctaccaaaaatacaaaaattagtacggcattggtggcacatgccaatggtcccagctactcgggaggctgaggtgggagaattgcttgaccccgagaggcagaggttgcagtgagctgagatcgcaccactgcactctagcctaggtracagagtgagaacccacctgaaaagaaaaaaaaatttaaaaattagatgggcatggaggtgcatgcctgtagtcccagccacttggcaagctgaggtgggaggcttgcttgagcctgggagggtacagtgagctgtaattgcaccactgtactctagcctgggagacagagcaagaccgtgtctctaaaaaacaccaaaaaacaaaaacaacctttcttttttttttgagaggagtcttgttctgttgcccaggctggagtgcaatggcacgatctcggctcactgcaacctctgcctcc

SEQ ID NO: 29288 - DNA, 601 bp, Human
caggctgggtcaggtgccctcccccagccaggctcctcgatcccagccctgcctactgtggttgtcactgtctaggacaggcttgtgttccttcctgggctatgagtcccaaagcagcacaaggctgtctcagtgctgctgtgaacctagcactgggctgatcacagaggaggcacacagaaacattaggtgaatacatgcacaaaggaacaactgaatgaatgggcgggcctggatcctggaggcatggaggaactcaagacctgagggtcagcctcctctgtaacattctcatttgcccagccggactttccggctgcccctgtatcattgggcctcactgacccctcccgcgccccagccctcagcacaggaccagccactacattagcagcaaggtgcccacacagccagaacacccgacacccagttcctctcccccttcccacctgctgctcttggtgacaccaccagtgacctcctcctggagaggtaagtccaaccctgtccccctcctggctgctgggacacccaatctcttggttctcctctccctcatctctctgcctgcagacgtggccctctggtgctctcctcggtc

SEQ ID NO: 29289 - DNA, 601 bp, Human
aatcctggatggttcaggcgggaccaatgtcctcactgggctgctaataaaggaaagcgggaggcgggacagtgcgagtcagacagagattggacgacggccaggtgccgggcctcatgcctatcatcccagcactttgggaggccaaggcttgatctcaggagttcaagagcagtttaggcaacatatcaagacccatctctataaaacatacaaaaaattagttgggcgtggtggcaggtccctgtagtcccagctactcaggagtctgaggtgggaggatcccttgagcctgggaggyggaggctgcagtgagctatgattgcaccactgcactccggcctggggcacagagtgagaccctgtctcaaataataataataataacaagagggatagcccgcatcttccagttgcctactcctccctttgatcttcactcacaagtcccctccaggaagccctccagacccccaggctgggtcaggtgccctcccccagccaggctcctcgatcccagccctgcctactgtggttgtcactgtctaggacaggcttgtgttccttcctgggctatgagtcccaaagcagcacaaggctg

SEQ ID NO: 29290 - DNA, 601 bp, Human
agcatagcggcggtaaatgatcttaaagttccggaactgcagaacagagaggctgtcagcaacggagcttgccaggacctaacgtgccagacagagtggggccaaaacattcactccttcactccatacgtggtcccgaggcccagctctgtgcctggccctgtgctggggtcacagcagtgaccgagacagccctaaccctgctcacagtgcagcgggggcaggcatccccagaatggacaggatgggctgtgagagcccaaagagggtgcctaaccccctctgatcctggagagtcaggagggcttcctggaggagggggtatcggagctgagagctggaggataggcaggaatgttctaagcagatagcaaaagcccggggctgggcgggagcctgacgtgttcaatagtgtccatgcaaccttgccactcccttctgtgacttcctgctacctctggagacagtcacatcccttagcctggaattaattaactcaattatttaacaaatacttcctgagcagctactctatgccaggcctgtgataggcagtgtggggaggagggttaccactgccaccaagacgatcctgggtcct

SEQ ID NO: 29291 - DNA, 601 bp, Human
cagaagtagaggccagcatagcggcggtaaatgatcttaaagttccggaactgcagaacagagaggctgtcagcaacggagcttgccaggacctaacgtgccagacagagtggggccaaaacattcactccttcactccatacgtggtcccgaggcccagctctgtgcctggccctgtgctggggtcacagcagtgaccgagacagccctaaccctgctcacagtgcagcgggggcaggcatccccagaatggacaggatgggctgtgagagcccaaagagggtgcctaaccccctctgaycctggagagtcaggagggcttcctggaggagggggtatcggagctgagagctggaggataggcaggaatgttctaagcagatagcaaaagcccggggctgggcgggagcctgacgtgttcaatagtgtccatgcaaccttgccactcccttctgtgacttcctgctacctctggagacagtcacatcccttagcctggaattaattaactcaattatttaacaaatacttcctgagcagctactctatgccaggcctgtgataggcagtgtggggaggagggttaccactgccaccaaga

SEQ ID NO: 29292 - DNA, 601 bp, Human
agatgcagaagtagaggccagcatagcggcggtaaatgatcttaaagttccggaactgcagaacagagaggctgtcagcaacggagcttgccaggacctaacgtgccagacagagtggggccaaaacattcactccttcactccatacgtggtcccgaggcccagctctgtgcctggccctgtgctggggtcacagcagtgaccgagacagccctaaccctgctcacagtgcagcgggggcaggcatccccagaatggacaggatgggctgtgagagcccaaagagggtgcctaacccccwctgatcctggagagtcaggagggcttcctggaggagggggtatcggagctgagagctggaggataggcaggaatgttctaagcagatagcaaaagcccggggctgggcgggagcctgacgtgttcaatagtgtccatgcaaccttgccactcccttctgtgacttcctgctacctctggagacagtcacatcccttagcctggaattaattaactcaattatttaacaaatacttcctgagcagctactctatgccaggcctgtgataggcagtgtggggaggagggttaccactgccac

SEQ ID NO: 29293 - DNA, 601 bp, Human
cagatgcagaagtagaggccagcatagcggcggtaaatgatcttaaagttccggaactgcagaacagagaggctgtcagcaacggagcttgccaggacctaacgtgccagacagagtggggccaaaacattcactccttcactccatacgtggtcccgaggcccagctctgtgcctggccctgtgctggggtcacagcagtgaccgagacagccctaaccctgctcacagtgcagcgggggcaggcatccccagaatggacaggatgggctgtgagagcccaaagagggtgcctaaccccmtctgatcctggagagtcaggagggcttcctggaggagggggtatcggagctgagagctggaggataggcaggaatgttctaagcagatagcaaaagcccggggctgggcgggagcctgacgtgttcaatagtgtccatgcaaccttgccactcccttctgtgacttcctgctacctctggagacagtcacatcccttagcctggaattaattaactcaattatttaacaaatacttcctgagcagctactctatgccaggcctgtgataggcagtgtggggaggagggttaccactgcca

SEQ ID NO: 29294 - DNA, 601 bp, Human
acagatgcagaagtagaggccagcatagcggcggtaaatgatcttaaagttccggaactgcagaacagagaggctgtcagcaacggagcttgccaggacctaacgtgccagacagagtggggccaaaacattcactccttcactccatacgtggtcccgaggcccagctctgtgcctggccctgtgctggggtcacagcagtgaccgagacagccctaaccctgctcacagtgcagcgggggcaggcatccccagaatggacaggatgggctgtgagagcccaaagagggtgcctaacccyctctgatcctggagagtcaggagggcttcctggaggagggggtatcggagctgagagctggaggataggcaggaatgttctaagcagatagcaaaagcccggggctgggcgggagcctgacgtgttcaatagtgtccatgcaaccttgccactcccttctgtgacttcctgctacctctggagacagtcacatcccttagcctggaattaattaactcaattatttaacaaatacttcctgagcagctactctatgccaggcctgtgataggcagtgtggggaggagggttaccactgcc

SEQ ID NO: 29295 - DNA, 601 bp, Human
aaaaaaaagaaaaagaaaaaaaagaaatggagagggagagtcccagtcactgcagagggagggctcaggagggaccagggagggttcccaggccttgggggccactccagggctgcccacccgcctccccaccttacatccctctcccgccgtacctccacgaagttgtgaatggcctccaggtaagccaggttgttgtcattgacatccacacagatgcagaagtagaggccagcatagcggcggtaaatgatcttaaagttccggaactgcagaacagagaggctgtcagcaacggagmttgccaggacctaacgtgccagacagagtggggccaaaacattcactccttcactccatacgtggtcccgaggcccagctctgtgcctggccctgtgctggggtcacagcagtgaccgagacagccctaaccctgctcacagtgcagcgggggcaggcatccccagaatggacaggatgggctgtgagagcccaaagagggtgcctaaccccctctgatcctggagagtcaggagggcttcctggaggagggggtatcggagctgagagctggaggataggcaggaatgttctaagcaga

SEQ ID NO: 29296 - DNA, 601 bp, Human
tgcctgtaatcccagctactcaagaggctgaggcaggagaatcacttgaacctgggaggtggaggctgcaatgagccaagattgcaccactgcactccagcctgggcgacagaacaagactccgtctcaaaaaaaaaaaaaaaaaaaaaaaaaaaaaagaaaaagaaaaaaaagaaatggagagggagagtcccagtcactgcagagggagggctcaggagggaccagggagggttcccaggccttgggggccactccagggctgcccacccgcctccccaccttacatccctctcccgcygtacctccacgaagttgtgaatggcctccaggtaagccaggttgttgtcattgacatccacacagatgcagaagtagaggccagcatagcggcggtaaatgatcttaaagttccggaactgcagaacagagaggctgtcagcaacggagcttgccaggacctaacgtgccagacagagtggggccaaaacattcactccttcactccatacgtggtcccgaggcccagctctgtgcctggccctgtgctggggtcacagcagtgaccgagacagccctaaccctgctcacagtgcagcgg

SEQ ID NO: 29297 - DNA, 601 bp, Human
attagctgagtattgttattttagtagcaagtgcctggaatctaaacccatcaccccttccagcctgggggcccttggtgagcaggagcaggtctgaagagcacctgggtgtctcaccttgctcagcacaatgaggggcgtttgttgactgactgactgatggactgaaggcaaggcatcctaggtatctggttcccaggggagacaggcaagggctcaaagacggcaaggccaggcaggaccacaggtttattggggactccacgcacagacgcttatggcatcacacgacaacggcacrgttactcgggacacacacggtggcctctgcccacagccagggcccagaggcagtggggtgcagtctcctcccttgtggcccagacccagctgggtcccttcctcctaggcagctgagggaaggactgctgggttggccacgggcctgggaaggggaagcgagcaggcgagtccaggaggggccggggccggggtggggctcgcctgccctcactccagggactgtagcatcagcagctgtttcagcaccttcgtctggctggtctctcggatttcgccagccaggaacatctcgtccacg

SEQ ID NO: 29298 - DNA, 601 bp, Human
tagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggrtccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgggtgcgcgcccctcacgaccccggccccttgctccgctgggtggaggctggagccagccctcacgcttctctcttcgcaggtgtgtgtctgctgctgctgccggggcccgcgggcagcgagggagccggtgagtgggggagctggggtgcgtccaggc

SEQ ID NO: 29299 - DNA, 601 bp, Human
atctaagcatctttttgttggcttccttaatgtgtgagtttaaggatctgcatttgtaggctaactaggataaatggtcctatgaaggaaaggatggctttgatttgtgcacatgtctatgaaaatgttccacaaaggctcaatccagatttactatctttacctcaagcaactgtgtacatagcgtcatcaaagttgagatttaaaaatttttttttttcttctggagacaagatcttattctgtaacccaggatggagtgcagtgatgcaatcatagctcattgcaagcttgaactccygggctcaagcaatcctcccacctcagcctctccagtggcggagagtacaggcatgcaccaccacgtgtggccatttaaaaaaaattttttttttttagaagagatgaggtcttgctatgttgtccagactggtcttgacctcctggactcaagcaaatcctcttgtcttggcctgctaaagtgctgggattataggcatgagtcaccacgcccagccaagattttttatatttctataattaatattaaatgacttttattttctagttcagatatagttccaattatgtatttccaacc

SEQ ID NO: 29300 - DNA, 601 bp, Human
tggcctgctaaagtgctgggattataggcatgagtcaccacgcccagccaagattttttatatttctataattaatattaaatgacttttattttctagttcagatatagttccaattatgtatttccaacctggttaagaactgagaagccaggcacagtggcacacctgtaatcccagctactagggagttggaggtggatcacttgagctcgggaatttgagcctagcttgggcaacttggcgagtccccatttcaaaaacaaaaacgaaataaaaacccagaactttcacattagasttttatagtggctggggactatattaaattggaaaacaaccttgtggcttgccaaaatctggaatggtatggaagggtatataagtcaatagtcataactagaagtgtagaaattagggaagtaaaacttaaatctcacactgtagtctccccaccactatgccccaagaagtcctaagaatgcttacaatattatctcctttttcttcagctcccattgctatcacatgttttaccagaggcttggacatcaggaaagagaaagcagatgtcctctgcccagggggctgccctcttgag

SEQ ID NO: 29301 - DNA, 601 bp, Human
tgtagctaaagtgagtatcttaggaaaattgtttggtgctctgaatttctaagttgtgggtaatgggatattacaaatgtgttcttatcaacacttaagaagttcaacagcacaaaaccatttttttccaggcaaattttgttcttgtgtaagcaagtttttaaaaggctagcagcagctgggagtggtggctcacacctgtaatcccaccactttgggaggctgaggcggatggaccacttgaggtcaggagttcgagacctagccaacatggtgaaaccctgtctctactaaaaatacraaaattagccaggtatggtggtgcatgcctgtaatcccagctacttgggaggctgaggcaggagaatcacttgaatcctggaggtggaggttgcagtgagccgagatcgcgccactgcactccatcctgggctacagagcgagacgccatcaaataaataaataaataaagcagaatctttagatgacttccctgatgagctattttcttgattaatcaaagcaatagatacaacatggcactataagtcagtgggatgccctgaaaaagtgtggatagcatctcagctgctattcttgt

SEQ ID NO: 29302 - DNA, 601 bp, Human
agtagtacacaggaggccacaggacaagcagtgtccacagcacatccaccaacaggtatgaactatgaaacctatctcctagttgcccggcacagcatttggaagttatgaataaacgtgttgttggtagaagcttttcttaaagaaatttgatattaaagagaaacaaagcaaataccttaagtttactggtatattacatatggaaacattcattatgtgtatattttaaagacagggtctcactctgttgctcaggctggagtacagtggtgcaatcatagctcactgcagccttaamctcctaggctcaagcaatcttctcaccttggcctcctgagtaggtggtactacaggcacatgccaccacacccagccaatttttttgatttttaattttttttatttttatttttttagacaggtctagctatgatgcccaggctggttttgaactcctgacctcaggcagtcctcccacttcagcctcccaaagttcagggattacaggcatgagccactgcacccagcctaataattctctaaaagtcctattttctcccagatttgataaaccacgcctaagaactggtcaaagtac

SEQ ID NO: 29303 - DNA, 601 bp, Human
tacattcaaaatcaaatgaggccgggtgcagtggctcacgcctgtaattccagcactttggaggccaagtgggtgtgtggatcacctgaggtcaggagttcaaaaccagtctggccaacatgtgaaacaccgtctctactaaaaatacaaaaattagccagatgtggtggcatgcacctgtaatcctagctacttgggaggctgaggcaggagaatcacttggactcgggaggcagaggttacaatgagccgagattgcaccactgcactccagcctgggcaacagtgagactatgtctcaaaaaaaaaaaaaaaaaagaaaaaaatcaaatgagaggagatttgaatgagtcttgaatgatgacaaatgatcagttcttttagtgggtacatgtcagttcagtataaacatttgagttatggacacactgggttcccaaactgtaagttcaggatctaagactgcctgggcagactgagtagatctgagtgcctcctttttggaataaaagaatttagaaaactgtgtgctatctatataagaaccagaaggtagactggagagtcctgttgcttacacaagtcacctctgcttatctac

SEQ ID NO: 29304 - DNA, 601 bp, Human
taaatcatatgccctagagataatcactataaaatggtttttttttttttttttttttttttttgagacggagttttgctctgtcaccgaggctggaatgcaatggcacgatctttgttcactacaacctctgcctcctggatttaagtgattctcctgcctcagcctcctgagtagctgggatcacaggtgtgcactactacgcctggctaatttttgtatttttagtagagacaaggtttcaccatgttggccagcctggtctcgagctcctgacctcaggtgatccacctgcctcggmctcccaaagtgctaggattacaggtgtgagctaccacgcctggccccttcagtattttaaggaaatatttgactgtattatttttaaaaaactcagactattaaaaatgccctgcatcctgtttttttcatcctttagtatttttagcattttctcatatcacaaatattcatcaaaaatatttcataatattccgctgcatgattagtcattcttattatttcttcactacattacacactacactgtgatgaacatccttatatcatctttgtgcccatctctgattatttcatcagg

SEQ ID NO: 29305 - DNA, 601 bp, Human
actactacgcctggctaatttttgtatttttagtagagacaaggtttcaccatgttggccagcctggtctcgagctcctgacctcaggtgatccacctgcctcggactcccaaagtgctaggattacaggtgtgagctaccacgcctggccccttcagtattttaaggaaatatttgactgtattatttttaaaaaactcagactattaaaaatgccctgcatcctgtttttttcatcctttagtatttttagcattttctcatatcacaaatattcatcaaaaatatttcataatattcygctgcatgattagtcattcttattatttcttcactacattacacactacactgtgatgaacatccttatatcatctttgtgcccatctctgattatttcatcaggttagatttctaaaagtgaggttctgacttaaagcctctgatataaatagtgaaattgagccatgcacagtggctcatgcctgtagtgccagctgctcaggaggctgaggtgtgaggatctctcaagcccaggagttcaaagctgcagtgagctatgatggcaccactctactccagcctggacaacagagaaaga

SEQ ID NO: 29306 - DNA, 601 bp, Human
ccaggagttcaaagctgcagtgagctatgatggcaccactctactccagcctggacaacagagaaagaccccatctctaaaaaaacaaataaatagcgaaattgcttcctagaaaggtgaagtagtttaaactactatcagcagtgtgtaaggttgtataaacagtgctattacaaatattaatttccatttcatttctgttattttttacaagtggctctgctcttagattagatagaatttttttggcatgagaagaaaatttaactgttttaacataatttaaccatttgtctctcamccttaaaaaaaatgtgttccttgtttcattgacttatggtatcacatttatacctgagtttgagcaagtctatttctttgattcatatgctaatccttacatatttttttctacgctgctttgattatcacagttttattgcacattttaacatcccatgaggcaaattcccctgcagtactttttgtcttgtacttttttctgactactttgacccaattctttttgaagatgaattcttcattaccttgtagactcatacaaagttttgtagtttttctgttttagaaagaccattag

SEQ ID NO: 29307 - DNA, 601 bp, Human
caaaacggtctctgctgaacacagagtagttatataaaagtgagctgaaattcctttaatattaaatataggaaatgagatctcaaaactcttacaatacacataattttaaggtgcacaaatgtcattgtcattataagaaaaactcaatattgtaactttataattcatttcacctttgtccctttaaaaaaatgttgacggtcacatcaatgaaattgtttctcctgaacagagagctctgagttaatagatccacactacttagagcctctggggtcccacactggaacagaccctmgtctcatacccagccacttcctcatttagtttagctacctggtgcccaactctgcggacttctgttaaacccgaggctctgagccaagcccgatttcaagttctccgtatagtttaggcatggactttgcagccagacaacttgaacttaaaatgcagctgtgtttcatcaggcaaactccctaaatgctctgagactcagtttcttcatttacataattgggataattccaaccttatagagctatgatgaaatgaggttttacatgtgttatgcttttggcttattacccagaatata

SEQ ID NO: 29308 - DNA, 601 bp, Human
aaagcatggtgatttagaattctcatacattggattgactagatataacattggagaagtatctctttgtaatgctaaaaagaagtgaaaatcaacagacttatctaatgaatgcagatgtggcagaaagaatgagtagcactaccgttgactctgaagagagacttcttagaggtactaatcagtcaccaaagggctacatagagagcacatgcatggaagtgggaatcagttttgtgtttctaactggcgattgatgtggggtaaacaaatgtgaggcttctaggaggtggagggggawctaatatggcttgtgaagataaataggcctggtagataattaaactttcccagctgatgcatctgttacagaactgggttctatataattcttttttgtgtgccccgccccactgccagttctatatataattcttaaactttgcagcatcaaatgctacagggaaacagaaatgtggtttgagcagtggtaaaggctatttgtttgcttctttttcaaatttaggaaaagccttgaagcatactgctcagaaattcttcacggtagatgctggagtaagaaaagggatccccaaagtgg

SEQ ID NO: 29309 - DNA, 601 bp, Human
gatggttcaggatgtcacatttgttgacaaggtaaagtggtgagggttatcttctgttacagtgatgggtattccattttggacctctaagtgcagtgctgactgcctcttatctagattaacttgaaacattcaggattttccagtttttaagaagaaacaacttttgatccttttggatatcttttatgtgtctcccccattaggctgtctgtcggaataatggcttcttctcttaccacatgcccaactggtttggcaccacaaaatacgtaaagcctctggtacagaagctgtgcastcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttcctt

SEQ ID NO: 29310 - DNA, 601 bp, Human
gtcacattaaggaaatatgcttatacatatacaattaaggtgctcatatttagctcaaacttggactatatctccaaatagccagcttataacctaccatgaatctgccattcagtaatttatcctaactttcttgtgtatgaaacaggtaattgctctgtcaccaggctggagtgcagtggcatgtagtgagctacaacctccaactattgggctcaagcaatcctcctgtgtcagccttccaaatagctaggacgacaggcacatgccactgcccctggctaatttttaaatttttttkgggagagacgggggtctcactttgttgcccaggctgatctcaaactcctgggctcaagcgatcctcacaccttggcctcccaaagtgctgggattacaggcataagccaccacacccaaccctaacttttattttagtcaagttttgtctggcatgagtttcctaagataaggtctcccatagactttacctatcccatcaaaatttccttggccaggtgcagtggctcacatctgtaattcagcactttgggaggctgaggtgggcgggatcacctgaggtcaggagttcaagaccagc

SEQ ID NO: 29311 - DNA, 601 bp, Human
tccttggccaggtgcagtggctcacatctgtaattcagcactttgggaggctgaggtgggcgggatcacctgaggtcaggagttcaagaccagccgggccaacatggtaaaacccagtctctattaaaaatacaaaaattagctgggtgtggtaacatacacctgtaatcccagctactcaggaggctgaggcacgagaatcacttgaacccaggaggcagaggttgcaatgaactgagatcgtgccattgtactccagcctgggcgacagagtgagactctgtctcaaaaagaaaaaaamaaaaaacaaaaaactttttcccccccgcttaagataataaaaacacactctggtgttataaaagggtataagaagggtttctttcttcctcaccccagccttaatattacttttggcacaggcctcgttcctgaagacattaacgtaatgtgttagagatcaaataggccaacaaaaagctaagattccctttctgaggatataactgagtgacaggagggaagaatcaatggacttgttttttttaacactcttctgtacctcattttccctacttaattcctaatgacataacctttt

SEQ ID NO: 29312 - DNA, 601 bp, Human
aggaaaaaaatattttgactttttttttttttaaccagggagtgagagtcaggaaaaggagactggaacaattggacattgttccaagtagcttttacatcatctaaacctgctgcatatcttaggtatttaccactctgagcactgtataccactagaaggggaatgaaaccttagatctgtagaggaaaactattacagaaactccaaaagttatagaaaattgcacccagcattagatagatggtactctacactaagaatctgctaaatgaggccaggtgtggtggcttatgcctgttaatcccagcactttgggaggccgaggcagatggatcgcttgagccctggagttcgagatgagaccagcctgaacaacatggtgaaaccccatctctacaaagaaatttaaaaattagctgggcttagtggcatgcgcttgtagtcccagctacttgaggatgggggtgctgaggaggatagtttgagcccaggaagttgaggctgcagtgagccttgattgtaccactgcactccagcatgggcaaaagagccagaccctgtctgagaaaaaaaaaaaaaaaagattaaatgaaaactt

SEQ ID NO: 29313 - DNA, 601 bp, Human
acaatatctagctttaggagctgcatatatatttcaacaggcatgaatagcaatgaacataagagtctttatgcaaagtactgtgaaatacaagaatataatttttcttttaaaacaaaatggttatactagttatttcagaggtttagaacgtgaggccatctgtggaaactatagggattcttgcatttggcaggcaaagcattgcagatgacatttcaatttaactgagcaagttgattgactactataccaatttttaattagaagaataattatttctttctgcacaataggttayctatattggaaaagtcacaatgaacaaaactcttctgtagtcaagattcagaaatgagcaaaactgcacaagcttttagttttcattctggatattttgattttgaaccaaagtgttttgctttttaaaaagaaatatctatctatctatctatctatctattatctatctatctatctatctatctatggcaatagacattctaccttgctgatcttaactcttagatctccaataaaagcttagtacattgacttgaggaaatctgtcagtggctcaaagtgcagaagggtttgcttt

SEQ ID NO: 29314 - DNA, 601 bp, Human
ttttgtcagggacctgtttaatattttcttttacatggaaaatgtgaaacaaaataacgataaccacctgaaaaaatactattatgcaatatttaaaaatgttaccatttaaaatttagaagaggatcaattaaaccctctgtggcttagatataattagatgagggattagcacattaattacatatacattaacatcagctttaagctggagttgacaaccagcttgataaaatgtcagccaatgaaacctttggcctgacagagtagttctaataactggcacttacagctcatgaaytctactcctttgaatatatgactttcattggaatgagttattttgttcttattgagtgtaattaataatgactcactgacagcaaagattcctgatcactgtaacttccagctaatcctaactggttagaagtctttagactctgccctaccttttaagatactactaagaatgtggtacccacagacctccatacacacagatcatgctgttatacctggatttggttttacaaagggacttgttgtcgaacttcttccatttgtaccagcttctagttctggacgtcttgttggatct

SEQ ID NO: 29315 - DNA, 601 bp, Human
gccttctaaagaagagccctgcctcctggcagaacagaacagctcgggaacgcggaaggagtgagggggcctgggaaaatgttcagctcgtaactcgtctgtattatttgatttacacttaaaatatatttggaaggcagcagaaactctcacaccgaacagactgccagcccaaatgttaagcactaaaaaactgcctggcatcattatattatccatttatcagtttgtcacaagaatttgacacatcttgtcattgaaagttagaaataacaacttccctccttgactcttggaaagrgatggaatattgctgcagacgataaatttgcacaacgaccaagcaagcacacaacaatcctaatacaaaactgctgatgtctgctcaacagctactctataaaaccttcattagcatggtaacaaatacagaactatttgttccaagactgttaagaaaacgaaggtcaacgacggacaattttatctggtattctacacttttgtcagggacctgtttaatattttcttttacatggaaaatgtgaaacaaaataacgataaccacctgaaaaaatactattatgcaatatttaaaaat

SEQ ID NO: 29316 - DNA, 601 bp, Human
cagccagcctggggcagcggcagggaagaaaaagggaagtggccaattctccaggtcagcggtgagcgtttatgtggtattgctcttccgcctcctttgagaaagggagtttcatgcaaaccttcaaagggcctgccttctaaagaagagccctgcctcctggcagaacagaacagctcgggaacgcggaaggagtgagggggcctgggaaaatgttcagctcgtaactcgtctgtattatttgatttacacttaaaatatatttggaaggcagcagaaactctcacaccgaacagactgycagcccaaatgttaagcactaaaaaactgcctggcatcattatattatccatttatcagtttgtcacaagaatttgacacatcttgtcattgaaagttagaaataacaacttccctccttgactcttggaaagagatggaatattgctgcagacgataaatttgcacaacgaccaagcaagcacacaacaatcctaatacaaaactgctgatgtctgctcaacagctactctataaaaccttcattagcatggtaacaaatacagaactatttgttccaagactgttaagaaaacgaagg

SEQ ID NO: 29317 - DNA, 601 bp, Human
gtacttcagcaagaggaccaccagcgtgatgatgatgacgatgaagatgatgcatcctgaagcaatccctgcaaataaggccacttcggaaccgaggatgttgttccccgaatgtccggcgctgttgccgtctgtgctagaacctgcagacgcggagacagaaaaggtcagagatagttactgctgtcccagtgcagacggactgcttttatgacccttaaaaatgtgaaaaataagccaggcttattaactaactagaagctggactttgcctcgccaatacctcgtctaagagctcaaygcaaaaggaaatgagaggtatctctaggagggacttccctaccctcccaagccacagggtttcctttgtatcattatccagcaagagcacagactgtcggtgacagccagcccttgatcttgcttcatcttctaacccgtgtcagccagcctggggcagcggcagggaagaaaaagggaagtggccaattctccaggtcagcggtgagcgtttatgtggtattgctcttccgcctcctttgagaaagggagtttcatgcaaaccttcaaagggcctgccttctaaagaagagccctgcct

SEQ ID NO: 29318 - DNA, 601 bp, Human
tgcggcgagtgcttcctgtgtctcctccggtacttcagcaagaggaccaccagcgtgatgatgatgacgatgaagatgatgcatcctgaagcaatccctgcaaataaggccacttcggaaccgaggatgttgttccccgaatgtccggcgctgttgccgtctgtgctagaacctgcagacgcggagacagaaaaggtcagagatagttactgctgtcccagtgcagacggactgcttttatgacccttaaaaatgtgaaaaataagccaggcttattaactaactagaagctggactttgyctcgccaatacctcgtctaagagctcaacgcaaaaggaaatgagaggtatctctaggagggacttccctaccctcccaagccacagggtttcctttgtatcattatccagcaagagcacagactgtcggtgacagccagcccttgatcttgcttcatcttctaacccgtgtcagccagcctggggcagcggcagggaagaaaaagggaagtggccaattctccaggtcagcggtgagcgtttatgtggtattgctcttccgcctcctttgagaaagggagtttcatgcaaaccttcaaag

SEQ ID NO: 29319 - DNA, 601 bp, Human
actgggctctgagccgttgttgttgccgctgcgcttgggtgtggccagtgtgctgagcgacagcgtggtcgtgtgctgcggcgagtgcttcctgtgtctcctccggtacttcagcaagaggaccaccagcgtgatgatgatgacgatgaagatgatgcatcctgaagcaatccctgcaaataaggccacttcggaaccgaggatgttgttccccgaatgtccggcgctgttgccgtctgtgctagaacctgcagacgcggagacagaaaaggtcagagatagttactgctgtcccagtgcwgacggactgcttttatgacccttaaaaatgtgaaaaataagccaggcttattaactaactagaagctggactttgcctcgccaatacctcgtctaagagctcaacgcaaaaggaaatgagaggtatctctaggagggacttccctaccctcccaagccacagggtttcctttgtatcattatccagcaagagcacagactgtcggtgacagccagcccttgatcttgcttcatcttctaacccgtgtcagccagcctggggcagcggcagggaagaaaaagggaagtggccaattctcca

SEQ ID NO: 29320 - DNA, 601 bp, Human
ggcacccggacagcaccgcataaaccaaagtgtcgtaaggctcaatcgggaggggaaggaggaacctggggggagggggatctgacctaccttttatagataaggattctttaataacaacgatgatgatggaattacagcctgtttgacctttggcttttcaacttttaggtcagatttggctctctgctattctcctaaatgctttccctgtgtttaataaaatgtgataagtatagcagctgagtctgcttaaaaaatcatccaaagcagaccgactctcctacagctcggagctgtrtatcttattgccagtaccacaacagtcctgcccgaatatatcatcagcggcctactttctcccttccctccaagcctgttcctttcccaacaatacccgtctttgttccccggaatgaagaggggcttttcttcctgcacatcgctatttgataacagcgagtgcctccccatgcactggaatccactgtgtgtgctgtcgtgtctcctactggcctcttcgatctcagcaaaaccaaagtgctgtgctacctaattgcttttttcttttttcctttccaactttctgtttcagaggcag

SEQ ID NO: 29321 - DNA, 601 bp, Human
tccttcttcatcagggggatgatggtgcagctcggcttcaggccacgcttcaggacagcctgggggcggcagggcaggtgggctctcttggtgctcagctgaggcgcccatcccaggctcccggcgcctgctgcccccaggctgggcctacctgcagcagggcgtggggcgcgatctccagcaccaccgcgtgctcaggcacgtgccacagggcctcctggaacagcacagggctcaccaggttgttgacattgtactcggcggaggacgtgcgtgccaggctgctgtgccactgggcctyggggatagaggtgctgagccagcgggctgaacgtggcttcggctcccggatcacctgcatgaggggccaggtcagtgctgggttgtgggtcccctggcccgccccgcaccccccaggccgtattagtccaccttcttgagctcctgcagcagtgggggtgcgatggcctccatgaagtaggagtggaaggccataccgccggtccgcacctccttggcaaacacaccctccttcctcagctgctccacgaactcaaacaccggggcctggacatcgtgggagcctggataagcatcctgg

SEQ ID NO: 29322 - DNA, 601 bp, Human
ggctgggggctgggggagggagggagggcccgccatcgtgagctccggccggagggttgggctagggttgctgaccccaaagggggccccgtggagaagcaagtctggggtcaacgtgaggggaggcgatcgctcctcatcgccagaggtgtccgaagccagcagggctgggacctcacccttgcacagttgcagctcctcctgcagggcagcgcgctcagacaggcacccctcctccgtgtggggagtgaagcaaaacttctccaggatgggcacctgctgctcctgctgccgccgcggsgccgactcagtgtggagcccggagatgtggacgcctcccgccactgtgaccctcagccacctgctcaccaccacgtcagccactgtggggacaggctgggtgagtgcggcatacttgggtgggggcactgggctggggctggggcggggctaccttgggccttgtcctgcagtgtgtacagcttctgcctgtgggtggcagggtcgatgtggatggcggtgacacgggtgggcaggtacaggccgtgcttggccgagcccaggatggacatctgcagcatggtgtccatgaagctcaccc

SEQ ID NO: 29323 - DNA, 601 bp, Human
catactgcggctcagtggaggtgaggaaggccacgatgtccccgagggggtgcccccggagcagtgtgtgcaggagcagaaagcccccttctctcagggcagccaccatgttgctgagagctgaggccgggtccccgagggcagccacagcacagttgcacaccaggaggtcggcgctgcccagggcgctgggggcagggtctgcgggatcccactggccctgggcaacgtcgtgctgctgcagctcggcctgggcagcctccagggcctgggggtggcggtcggtggccgtgtagctcakctgcagcaggggatgggggctgagcaggcctgggatgcgggaatacaggtgaccgtggccagccagcacctgtagggggtgaattctggaatcagccccacaccaggcaggtgcccctgacctggggctgggcaaaatgtccatgaggcctcagtctggcagaaaggcttccccgtcaacctgatgacggtgccagccatgggcacgcatggatgccactggtcttgtccctggggtcctgcctaggctgcacctcttggagcccacgggcggaccctccacggtggctgtgtggaccgc

SEQ ID NO: 29324 - DNA, 601 bp, Human
cagcactccctgcagctccagggcctcacccgtccacccagggtcccccccttggtcttggggcttttgagggccccatttggggccttccctcaccacggccaggttgaagacgccgcccacgggcccaagctgcgccgcctcggcaatgaggccccgggccccctccagtgagctgatgttgctggtggacacctgcacctgtacgccctggcgcctccaccggcggacctgcttggcctggtagcctgcgggacacaggactgtgggctggactgggccagggtacggtctcttcccyacacgccgggctggggaagtggggagcagccgcagagccccatccagcaagccccccacaagatggagggggacagaccccaggcaccgtgacagcccacaatggtgggctgcagagaagggctcaggggcccggggctgtgcctggcccaggctggtccacaagcacccctgccgactcacctgtccggatcccggagcgagaagtcaacacgagcttctgcaccccacgctgtatcagccactgcgccaactccaggccgaagccacccagaccaccagcgatgatgtagctcttgtg

SEQ ID NO: 29325 - DNA, 601 bp, Human
cagggagcgcaggttcagctgagtctgctgctgggccagaccatcctccttgggcgtggggcatgccagctctgtgaagacaggggcagatgccaggctggtctgggtgcagagccctggcacccacgcaaggacacacagacacgcacgcaggtccccacggtgctacgtcaggtgggagtcggggtgggaacgctcagaatggcacccgtgacgaagggcggtatgcctgccgggacacggtccagacaacaaggaggaagggctggggaggcccggggaccccactcccgcctggccrcccacacgcaccgctggcctcatccgcctttgaggacagctcctgcagtttccggagcgtgagttgccgcacctcgcgcacggacagcaccaggttgagctcacgctccagcgtctggcgcacctccacgctcatgagcgagtccaggcccaggtccgccagtgagctgtccaggttgacagcagccaagtcgcggatgcctggaagggatgcgccgggtcggcaactccagagggggcatggggacggcctgtatgcggcagggctgacacccaggggtgcgtgggctgtgcatctccc

SEQ ID NO: 29326 - DNA, 601 bp, Human
gcaccaggaacaggggccgctccgagctctgcacggagttgagccgcatcagggtggggccctccgggttcaccagcagggagcgcaggttcagctgagtctgctgctgggccagaccatcctccttgggcgtggggcatgccagctctgtgaagacaggggcagatgccaggctggtctgggtgcagagccctggcacccacgcaaggacacacagacacgcacgcaggtccccacggtgctacgtcaggtgggagtcggggtgggaacgctcagaatggcacccgtgacgaagggcggkatgcctgccgggacacggtccagacaacaaggaggaagggctggggaggcccggggaccccactcccgcctggccacccacacgcaccgctggcctcatccgcctttgaggacagctcctgcagtttccggagcgtgagttgccgcacctcgcgcacggacagcaccaggttgagctcacgctccagcgtctggcgcacctccacgctcatgagcgagtccaggcccaggtccgccagtgagctgtccaggttgacagcagccaagtcgcggatgcctggaagggatgcgccgggtcggc

SEQ ID NO: 29327 - DNA, 601 bp, Human
gggcagtggcactgggccggacagggtcccaccggcaggacccttcaatcccgttgcatggcgggggtggggtggggtggggtggggatggtggagtgacctccggtggcaggcgggggcacggggccctagccctcccgcacgctcacgcgtggctcagccagggagctgtggatgatgctgatgatggactccaggccgctgccctccagcagcgtgcggtggtcaccctcgatgacgtggacggatactttcccgtcgcatacctgcaggggatgcgatcagctgccgtcccaccccrctcctgtccctgtccccgttcccgtcaggccccttgcgcacctgggagaggttgtagtccgcgcccaggtcctcgccgtaggcgccacccgtcttggcgcgcagtagcatcacgttgccatggtacttggccttgggtgtgtactgctcagcggcacgcagcttgtagtagaaggaccgggccgcaaagctcagctcctggcggtccaggccctggtggctcttgatgatcaggtccacggcggctgccacacgctcctctaggcccttcagcggcagcagcgcctccagcacctgtggg

SEQ ID NO: 29328 - DNA, 601 bp, Human
ccagctcctgatcgccctttgactcccatctccagggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatacaccagtggttcctcctccctgttaaagactaatgctcagatgctgtttacggatatttatattcyagtctcactctcttgtcccacccttcttctcttccccattcccaactccagctaaaatatgggaagggagaacccccaataaaactgccatggactggactctattcattcattcattcatttatcatagatttattcagtctctgctaagcactagatacagcttttcagttccagaactcacagtctaatggacttcagagctattttgctcgactgagggataaatgctgactatggctgggggagggataaaaacctttgacctgtaggtgctctgaggatggagctggagcaggg

SEQ ID NO: 29329 - DNA, 601 bp, Human
gcgcggtgtgggtcagaccccgaggggtcctcgcatctccgtctggaactcccctcaacgctctcaccattttgccccgcgaaggctaatccgccgctccgccaccggaagaacacgtcggcaggagcaggcgcctagcacaaccggaaaaggaagtgcctccggcgcaagtggcattgagggacttgtagtcctgcgatttcgggtgtagagggagcaggggcctgcggggacctggtgtgggtggagtggggacaagcggtggagaagggtacgccagggtcgctgagagactctgttytccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccaggtgagaccccatgggaagcgcctccgggagcgacggggtccgcttggcgctgggggccgtg

SEQ ID NO: 29330 - DNA, 601 bp, Human
gagaaaataaacctcagtggcttggtaatgtcacacggatggtaaatgccgcgcctagattcaaggccagagcttttgccgctgcagttcacaggggaattattcatattaatcaaatgaataattcattgtcaattaattattaattgattaataatccagggatggacctggaaggacgcgtgagaggatggcgagaggagggcacagctaaggaaaagtgggaaaaggcgggccttattccagctttctgttgagatcccagaatgtagggttaggttgggaaccagaacatgaaagrtcgtgatgccatgctgaagtgtttggactgaattagaaggaagaattgaacagtcattgatgctctagaaagaaccctgtgaagaaagagtgggaacaatgaaaaggcctgatggagtctttcgtttcttctttctcttttcttttgtcttcttttcttttcttgacagggtcttgctctgttgcccaggctggagtgtggtggcacaatcatagctcactgtagcctggaactcctgggctcatgtgatcctcccaccacggcctcccaaagtgctgggattactgcccagagcctctg

SEQ ID NO: 29331 - DNA, 601 bp, Human
tggaactcctgggctcatgtgatcctcccaccacggcctcccaaagtgctgggattactgcccagagcctctgtgcctggccccagtagaatatttcttggagtattggacacataccaacagtgggcacaagatgagttttttatttttttgagacggagtctcactctcttgctaggctggagtgcagcggcacaatctcggctcactgcattctctgcctcctgggttcaagcgattctcctgcctcagcctcccgagtagctgggattacaggtgcacaccaccacacccagctaattttttttttttttgtatttttagtagagacagggtttcaccgtgttggccaggatggcaagatgattttaaattgcaccccctaaaaatcctttttaatagttatacatttaatacatattaaaatataactaatagaacacaaatattattgcttatgagttttccagtttagttttttaaaaaaaattctaagtgaatgaaagtacgggttttagttggaagtagcaaaaatcgtgagggtgatttgggaaacactgctatctgggaaacactgaactctgaagtgcaatactctttt

SEQ ID NO: 29332 - DNA, 601 bp, Human
attgcttcagtttgtattctatgccaaagtatgcccccagttctaaatatggcaggcttggtcactctgctgtttcttacttcagcagcacctctggaaccaaccttcccctctctccacaaacttaactgcccttttctcaccctctaaggagacctcctggcatgtgtgttcacaggagcccagggagctccttgggaagaaggcaggggtctctgtggagtgtttccaggagggtgtgggctgttttctgctcctcaccttccccaacagtgagcagctgtcagcacgaagtcgtctygtatcaggaagccaccgcacctcttcagagacttctgatcccagatcataagataagccatgtaggggcgggagtggggcttggcctcatgtcccccgatgatctcccctgaaggaaaagtctgtctgcttgtgggcacccatggaatctgctgggtgggcacctgcttagtggctccagaactcctgggcatttgggagcctgggatagcctggagttgggagtggcctggaggaaggggcttcaatttcctgctctgaaaaagggaagaacagcagactttggtctgtaaatctttct

SEQ ID NO: 29333 - DNA, 601 bp, Human
cctctcctctgaggcataggaactaaccaagaggccaggatggaaaggagggaagggccggcattccagggggagtggaaccaactggaccaagaagagcaagagtggcaggagtgtgcctcacctgcagtagcatgatgtcgttggagaagttcttaggattataggctggatgggggatgggtcttttcacagggataaactgctgggtcggctcctgttctttgatattgtgggcccccaaggtgacatttatggagctgcacagagagcagagtgaggatgggggtggagtcacagkgtatacagcccagagacagtgaagagcaggtgacagctggggcagggctgcagctgaggggaaattaaggggacagtcggtccccaggaattggaattctggtaattgcaccaggtttctcagggttcggttccccctagaaacacaggtggaattgcttcagtttgtattctatgccaaagtatgcccccagttctaaatatggcaggcttggtcactctgctgtttcttacttcagcagcacctctggaaccaaccttcccctctctccacaaacttaactgcccttttctcaccctc

SEQ ID NO: 29334 - DNA, 601 bp, Human
tcccccagatcctgagatcggaggtatgtgggaccgttggctgtttaaggacccagaagtgggcaaggagggctgatgtccaccatggaggaccagcccattaaccacgttgggtaccagcctctgaagacacacctggttataattactgcacccccagtgggcacagtttcctaatatctgtgacctggagtgggtggagtgttgcaaattcatccttccaaagaagcaccatccaccataagcctcctggtaagtttgcagaggccctaatttctccccagctcagtctagtcccctyttctctttccagagagaaatatcacagtctagtgggtgaaggagtcccccactacttgagtctccaggtctcagatattccccaaacatctttctcccaagagccaatccaggcaggtgcatagtcttaccttaaaggaagtctttttaatctctgggtcccccacgcacaactcaatggtactgtcgtaataatggcgtaagtcagattcgcactttcgatcttcctgcactgtcatcttcacctcttgtagtgtgtgtgagtgttttcccaggggggccgtctgcccccagccggcca

SEQ ID NO: 29335 - DNA, 601 bp, Human
cctggacattgttactgcttcacctcatcccaggggccagcctccgtcatgtcccccagatcctgagatcggaggtatgtgggaccgttggctgtttaaggacccagaagtgggcaaggagggctgatgtccaccatggaggaccagcccattaaccacgttgggtaccagcctctgaagacacacctggttataattactgcacccccagtgggcacagtttcctaatatctgtgacctggagtgggtggagtgttgcaaattcatccttccaaagaagcaccatccaccataagcctcytggtaagtttgcagaggccctaatttctccccagctcagtctagtcccctcttctctttccagagagaaatatcacagtctagtgggtgaaggagtcccccactacttgagtctccaggtctcagatattccccaaacatctttctcccaagagccaatccaggcaggtgcatagtcttaccttaaaggaagtctttttaatctctgggtcccccacgcacaactcaatggtactgtcgtaataatggcgtaagtcagattcgcactttcgatcttcctgcactgtcatcttcacctctt

SEQ ID NO: 29336 - DNA, 601 bp, Human
ggcttcacctgatcttttatcctgaggctgggatgctagtcacgctgtcaggcttcctgctcggaacacccagcagctgtcatgtgcaccgtggagccagggggctatgtcagctactttctttggagagtttctccccagaagagaaaccacttcatgactcagcccagccccaaagttgccatttgtttaatcaagatagttagtttgcaaaacattaaacattaaacagtatttgatgcctagttaataatttgcatcctcttcatttgttcctgaatccttggagactgacattttycccccctaaaggcatagacaacaaaagaaattttattgagaggaaaacacaagtccttaaactgcaaagatgtttgccaggatgtctgatctccatgttctgctgttaatggctctggtgggaaagacagcctgtggggtaagtgttcttttctaatatttgtagttgagagactccgaagtttactaggaggaccaagctaggctgggagtgatgagaaactttagagtgaaaggctggagttgccaagttggagatgttctaactacaagaaccaatgcaggcctgtggcttggtttc

SEQ ID NO: 29337 - DNA, 601 bp, Human
actgcctacgtacttaaaacccttgattttataaagaactgaggcctagaggggaagcaatttactcctggccacacagcgaattggaggctgagatgaggtgaaaggctgaggcaaagtgagggcgagatgaaaaatgcatggctccaggcaggccgctccacctttttctgtgcgagggcggcctccgggctgacctgccctggtgataccctcacaccagcacctctgctgttgtcttctctgcccaaatggtttgcttcctcaggctcgacgcgtctaccaccaggtgggtcctgtrtcttcacaagggctctctgtctcacagactcgctctcttattgtctccctttcctgtgtcctcggccttgtgcccacagcgtgcgcaagctaagcagggccaccccttccacatcatgcactcctagtcctttggctctgggttcgagtctccctttgcagctctgagccgcagtggagaaaattctgctcgccactccatctggccagaggccaacaaccccactggtagagatctatgctggtcacccacagagcgccatagccaggcagacaacacatggagactgtggccacatct

SEQ ID NO: 29338 - DNA, 601 bp, Human
aaagaagtgcggaagactcaagggcccttgactttactgccagctgccagaaagttgtaagagacatctacagtgagttcatgacaccctggaattgtgcagtgaacaacttgagcaactgtaagcagtggccctactgaacagagaccatggaaagggagtggagttagccaatgtgcccatagatttatagctttaatcaaacagactgggagctacagggtcagatttgatctgcaaacaggaagaactttctcactatcagagttgttcaaaaatctgaatgggccactgggctctyaggaggtaatgagtttcccatcactggaggctttttaagcacaggctgaaaaacctcttatagggagtgaagagtatttaatttaaccctcaagaaactaccttcagacagtttggtatataaatgaagggaccctgaagcagacttctcctgggatccagagtccatctcgaggtgtcatagcctccagggagtgggctgagttgtagagattgggcctttttgcaaagagtagattcagtttaaaaacatccctgttcagtgtccgacttaacctctcacaggggttgtgctttgatg

SEQ ID NO: 29339 - DNA, 601 bp, Human
tccagagtccatctcgaggtgtcatagcctccagggagtgggctgagttgtagagattgggcctttttgcaaagagtagattcagtttaaaaacatccctgttcagtgtccgacttaacctctcacaggggttgtgctttgatggtatttgtcagctccctgctggctctagacaacagcatggcgaaagagaccccgtgctcgtgcccgtgggcaagttgcttctttggttgatcttgctggagacagcgcacggtgagggccttgctggagcagaaggtgcgcattccacagtccccartgggtggtggaggaggtagccagcaaacagcacagactctgccaatctccccaaagcaggtgccacgacagccagcaggcctgtggaaatgcctcttcaaagctggcttggctctgcccagcaatgcaggctgagcccatccatcagctgtcctactgcctgccagcgagagtgtctgctgggcttgccccgccagccagattggaagtgtcaaatgcaggccgacagggctggggtttggaggaggccctcagaggagccgtctgtgccacagtgatggatgacaccaacagggacgac

SEQ ID NO: 29340 - DNA, 601 bp, Human
aaagctaaaacccaaggactttcatgaaacccaaacctataagagattccaggatcgtaaaaaggcaaataaaacttggagttaggtagacctgggttatgatgtcatctcatttggccttcatttttccttatctgcaaaataggaataataatacctatgctatagggttgctttaaggtgaagtaagattgtgggcaaccacatttatttagtttagtgtctgatacatagaaaatactcaacacattataacctattattaggataatttggcttaactcaggatactctcatgatycttcctgataatttctagaaacagactgaaaactagacaaactcacaagaatttctttttattcctgatagaaaattcttgaacagctgcccctttctttcccaaagctcctcccttttctatagcctagagaaagtcacaaataatctatgtttaaacctgaactgtttttctacaatctaccagtggaaccaaaatttatggcaggctactgtgcctctctacccaggaaaatatgtggacgagtttctagatcgctacagagctcatcaggtattttctttgccaagtacatttgac

SEQ ID NO: 29341 - DNA, 601 bp, Human
cctatgctatagggttgctttaaggtgaagtaagattgtgggcaaccacatttatttagtttagtgtctgatacatagaaaatactcaacacattataacctattattaggataatttggcttaactcaggatactctcatgatccttcctgataatttctagaaacagactgaaaactagacaaactcacaagaatttctttttattcctgatagaaaattcttgaacagctgcccctttctttcccaaagctcctcccttttctatagcctagagaaagtcacaaataatctatgtttmaacctgaactgtttttctacaatctaccagtggaaccaaaatttatggcaggctactgtgcctctctacccaggaaaatatgtggacgagtttctagatcgctacagagctcatcaggtattttctttgccaagtacatttgacccatttcttacacagtttcttactgaaattccctatttgctctgctttaagcagacaccatttttttagccagcaaagctgcatgcaggccaatcagaaagcagaaaggcttagccactaagggaaaaataaatccgtcaatcacatacattaact

SEQ ID NO: 29342 - DNA, 601 bp, Human
ctattattaggataatttggcttaactcaggatactctcatgatccttcctgataatttctagaaacagactgaaaactagacaaactcacaagaatttctttttattcctgatagaaaattcttgaacagctgcccctttctttcccaaagctcctcccttttctatagcctagagaaagtcacaaataatctatgtttaaacctgaactgtttttctacaatctaccagtggaaccaaaatttatggcaggctactgtgcctctctacccaggaaaatatgtggacgagtttctagatygctacagagctcatcaggtattttctttgccaagtacatttgacccatttcttacacagtttcttactgaaattccctatttgctctgctttaagcagacaccatttttttagccagcaaagctgcatgcaggccaatcagaaagcagaaaggcttagccactaagggaaaaataaatccgtcaatcacatacattaactacaggtagggctttgtgctgggcactctggggttaaaagaggaatggaaatggcccttcctcttaagaaactaactatcaagttggaggaaacaaataag

SEQ ID NO: 29343 - DNA, 601 bp, Human
tcaagccctgtgtgtcggtttgttattattgcataatacgctaccccaaacttagtagcttaaaccactgaccatgtatttaggtcacaattctttgggttgacaattttggctgggttcagctgggcagttcttctgggctgcatcgggctcagttgatcttgactgggcttgctcatgtgtctgcagaagctggcagattggctggcctcttatcttgctgaatattggctgggctttcttatatgtctgaggcctcagctaggaccactaggccagccgttgtccacatgttctcatwtgctcttgcagaataggccaaactgttcacatggcagtcatgtgggtccaggagtgggagagatacagagtcgagagagaacaagacttcttaaggcccaggctctgagctggcacaccgtccttccatcacacatgctattggccaaagcatgtcctaaggccaacccagaaccaaggggcagggaaactgactccatctcttggtgggagaaactgaaaagtcacattgcaaagggtgtgggtgcagggaggggtggagaatcaagggctatttttgtcatcagattggctcatactg

SEQ ID NO: 29344 - DNA, 601 bp, Human
cttggtgggagaaactgaaaagtcacattgcaaagggtgtgggtgcagggaggggtggagaatcaagggctatttttgtcatcagattggctcatactgaagcagagtttcactgtggaacttgagggcgccaggcctagacttggtcacttctagctccctcacctcttcactactctttaatctccttccttagctggctttcatcccccacccaaccttggctggaggcttccttgaggacaaggccacatcctactcttatttgtataactctgcaccattcccaatgccatcctgmacctggcataacacttggtccattgtaggttcacaagacaagttacatatgcagacaataggattaagtgccaacataatgggaaagacaaaataaggtttaatcctagaagtggagaaaccctcccagatgatactcctgtaaagcaccttcaaatcacatggcagcccatcccaaatggaaaggatctttgtgactttccttgcacagccaccagctggatggcttcttccaccctggctacctggggccactgagctctgctcgttctatccatcttgactgaggcccatgggccct

SEQ ID NO: 29345 - DNA, 601 bp, Human
ttagctggctttcatcccccacccaaccttggctggaggcttccttgaggacaaggccacatcctactcttatttgtataactctgcaccattcccaatgccatcctgcacctggcataacacttggtccattgtaggttcacaagacaagttacatatgcagacaataggattaagtgccaacataatgggaaagacaaaataaggtttaatcctagaagtggagaaaccctcccagatgatactcctgtaaagcaccttcaaatcacatggcagcccatcccaaatggaaaggatcttkgtgactttccttgcacagccaccagctggatggcttcttccaccctggctacctggggccactgagctctgctcgttctatccatcttgactgaggcccatgggccctagagaataggaagcctttcttagcagcaatatgattcaaagcctatgtattttatttcttctttggcttcactgagaggtaagcagaccttgttaataggtctggattcaagtcaaaatcctctaacagacatttcattcatccctcgtcacctggaaaagtcacaccataccatctacatcagaatcttcc

SEQ ID NO: 29346 - DNA, 601 bp, Human
aggttcacaagacaagttacatatgcagacaataggattaagtgccaacataatgggaaagacaaaataaggtttaatcctagaagtggagaaaccctcccagatgatactcctgtaaagcaccttcaaatcacatggcagcccatcccaaatggaaaggatctttgtgactttccttgcacagccaccagctggatggcttcttccaccctggctacctggggccactgagctctgctcgttctatccatcttgactgaggcccatgggccctagagaataggaagcctttcttagcagsaatatgattcaaagcctatgtattttatttcttctttggcttcactgagaggtaagcagaccttgttaataggtctggattcaagtcaaaatcctctaacagacatttcattcatccctcgtcacctggaaaagtcacaccataccatctacatcagaatcttccccatttctaaatatctgcaaaagaagtaattcttaatggccttgccaagattagctggtctgactgccaacctgtgggagagatgggagaaattacagaagcaacctgaagggcatttatctataaacatctgtt

SEQ ID NO: 29347 - DNA, 601 bp, Human
ggaaaggatctttgtgactttccttgcacagccaccagctggatggcttcttccaccctggctacctggggccactgagctctgctcgttctatccatcttgactgaggcccatgggccctagagaataggaagcctttcttagcagcaatatgattcaaagcctatgtattttatttcttctttggcttcactgagaggtaagcagaccttgttaataggtctggattcaagtcaaaatcctctaacagacatttcattcatccctcgtcacctggaaaagtcacaccataccatctacmtcagaatcttccccatttctaaatatctgcaaaagaagtaattcttaatggccttgccaagattagctggtctgactgccaacctgtgggagagatgggagaaattacagaagcaacctgaagggcatttatctataaacatctgttggaaaaacaaaaataaattcttcaaagaacaagaaataactaagcaatgcaatcagctccttatcaaaccccattgtctctcctaaatgtcagtttgaaatctttcatgtcaaactcagaaaaacatttttttcctcattttctccctctctt

SEQ ID NO: 29348 - DNA, 601 bp, Human
caagccaagggagtcttgacttgacactgtgataaatgaggtgaaactttggcaagaaaccagagttggcgtattcaaaaaagaaataaaaagctagttccattttaatgggaaatataaaacagccattgtgcaaaagtcgatttttcaaaagccagagagataaagactctaacagaatgactgagagacgagtaagataatgtggttgataatcaggcttaggtaaagtgccatcctccaagccatcagctggctccgtaggagtgccttttcaagtcagctatctgcatttgctcgygcctcattatcatatgcatctctggacagcttccttgcagcttcaacttgccgacttgccatactccagccggctggagagagcaaagtcaacctgactttcttcaaatcccaaacttccacagacctaccagccacagagctaccaggatctccccgccaaggccccagagagcaaagagcttgagtccagccaaccttacacatacctgttttttttcccaatgaccagtctagtgtgaggtttacaactgtaggcaagatccatgaacttttataaggttatccttgggaaattcct

SEQ ID NO: 29349 - DNA, 601 bp, Human
gataatcaggcttaggtaaagtgccatcctccaagccatcagctggctccgtaggagtgccttttcaagtcagctatctgcatttgctcgcgcctcattatcatatgcatctctggacagcttccttgcagcttcaacttgccgacttgccatactccagccggctggagagagcaaagtcaacctgactttcttcaaatcccaaacttccacagacctaccagccacagagctaccaggatctccccgccaaggccccagagagcaaagagcttgagtccagccaaccttacacataccwgttttttttcccaatgaccagtctagtgtgaggtttacaactgtaggcaagatccatgaacttttataaggttatccttgggaaattcctaatgagcaggctggatagtcaatggggatggtgggacacattttcccaagggtaagtgtgggagtacccaaggcaatgtaagaccccagttgaaacagttgagtgctacagttgagctagtgagatttaggggttgtacggagacaaactgccatagttcatatcctgccctttagtaactatgtgtccttggccaagttactcaatctc

SEQ ID NO: 29350 - DNA, 601 bp, Human
actcaatctctgtcagcctcaggtttctcaacttagagtgaacaatacacctcctagatttttatgaagatgaagttagatggtgcatgtaaagtgcttagcacagggcatggtacataataaaggctcaaaaaatgttatctgttaaaatgactctgtagataatgcttgaccatgaccaaaagaaaaatgatgagttttctttgatttcattcagcttggtgactaatgaagtcccatcaagaaatattatccacaggatgaggcaaccaggcactcaagtatagtgtgatctgacccygggcagaccccatgtaggaccctgtagacgtgctaggtcccaatcctcttcctgctgttcaaagatgagaaaatcaagacttgataatacagttggctttcctaagttcaagggagtagaaagctggacttcgcttcatctcttcacttccaatcaggtgctcatgaccctgctaaatgtcaacactaccttgccgggtcatagcgtcccccaagtgaaaagatgcaaagcctgagccctcctttccactcccctcactgtgcagagctggagagacacatgattcctcctgcaggactt

SEQ ID NO: 29351 - DNA, 601 bp, Human
gcacagggcatggtacataataaaggctcaaaaaatgttatctgttaaaatgactctgtagataatgcttgaccatgaccaaaagaaaaatgatgagttttctttgatttcattcagcttggtgactaatgaagtcccatcaagaaatattatccacaggatgaggcaaccaggcactcaagtatagtgtgatctgaccccgggcagaccccatgtaggaccctgtagacgtgctaggtcccaatcctcttcctgctgttcaaagatgagaaaatcaagacttgataatacagttggcttwcctaagttcaagggagtagaaagctggacttcgcttcatctcttcacttccaatcaggtgctcatgaccctgctaaatgtcaacactaccttgccgggtcatagcgtcccccaagtgaaaagatgcaaagcctgagccctcctttccactcccctcactgtgcagagctggagagacacatgattcctcctgcaggactttgaattctttggggaaaaggtgtccaactaaataaaatgctggcctatttgagtgtaatgattaggatttcttctgtcctgttaccatccctgcagactg

SEQ ID NO: 29352 - DNA, 601 bp, Human
ctaaatgtcaacactaccttgccgggtcatagcgtcccccaagtgaaaagatgcaaagcctgagccctcctttccactcccctcactgtgcagagctggagagacacatgattcctcctgcaggactttgaattctttggggaaaaggtgtccaactaaataaaatgctggcctatttgagtgtaatgattaggatttcttctgtcctgttaccatccctgcagactggacccctgaccagtatgattacagctacgaggattataatcaggaagagaacaccagtagcacacttacccaygctgagaatcctgactggtactacactgaggaccaagctggtaggtaccaaatctctttcagggactctcctgggagaaggtcagagcggagtgtatgtgggaccacatgcaagggcctctctctccgcctctctggccagtattgtgaaatagctatggaagaaattatttggactggcttttttttctgttagattcatatgctatgaggactggggaagttcttagagaccatctcccctaccctcaaatgacagatgaggtaagtgaggctaagagaggagctgacttggccaagg

SEQ ID NO: 29353 - DNA, 601 bp, Human
gtaatgattaggatttcttctgtcctgttaccatccctgcagactggacccctgaccagtatgattacagctacgaggattataatcaggaagagaacaccagtagcacacttacccacgctgagaatcctgactggtactacactgaggaccaagctggtaggtaccaaatctctttcagggactctcctgggagaaggtcagagcggagtgtatgtgggaccacatgcaagggcctctctctccgcctctctggccagtattgtgaaatagctatggaagaaattatttggactggctyttttttctgttagattcatatgctatgaggactggggaagttcttagagaccatctcccctaccctcaaatgacagatgaggtaagtgaggctaagagaggagctgacttggccaaggtcatgcagcaagttaatgcagcattgtccaggtttcctgatgctgtgaatagcagctgtattcaaaatcactcccatagcttagattacaggtcagaccctaaggatgcaggaagtccatgtcagccttgagtaccagactgtagcatgtacacattcagctttgggactttccttccctca

SEQ ID NO: 29354 - DNA, 601 bp, Human
ctaagagaggagctgacttggccaaggtcatgcagcaagttaatgcagcattgtccaggtttcctgatgctgtgaatagcagctgtattcaaaatcactcccatagcttagattacaggtcagaccctaaggatgcaggaagtccatgtcagccttgagtaccagactgtagcatgtacacattcagctttgggactttccttccctcatgcctttgccagaacttttccttcccttccactttttctttctcccttcactctttagaagctttccacaattgttagattgtgtgtgtgtrtgtgtgcatatgtgtgtgtgtgtattcatacacatgtgctcctaccacacttgtttttgtttttgtggcttcttaacccaagcagtgggacagaaaagaaaataagaagctgggtccaagcaatgccatgtgactaaaccaggagaaggaatggaaagcacttagcagctggaataaaagctgtgtaactgtgcaaagtggcctggaaggcagggccaagatacagggcatgggggaacatcagaagggaccatcaaaacaagagcagggcccagggatcctagttcctgaaccaaagaa

SEQ ID NO: 29355 - DNA, 601 bp, Human
gcaacagagccatgttgtcctcaaatgggagagcagggaggatctcagggcacatgagacccaacccagttagagaaagggaacccagagagtgggggcatttgatcaaggtcacacagctagctagatgtagagcagaaattagagccctcgtgcctgacttctggcccatgctcattcattctaccatactcactgtgtctgctgccagtgaactcttgtgggcataacatgaggcagtggaataaagcatcaggaataggactcctaggggctaattttacccctagagaaaagctgkattcgggctgctctagcaaccatcttacttcgtggagggaagtggggccttaggtatatgtacagctttgtggttgacttcttccctcggtgccctcttcacttattcttttcattttcaatcctgcaatttcttcagtaaatttttcaggatggttgagaatatcgagtataaacacagtgtctgggctcactcctcaacttctcagaaaagtgacaaaactgtaaatgcattctgaagttagctagaaaatggagagactaaaattgcagctctgtttggtgaaggtgtaacaattat

SEQ ID NO: 29356 - DNA, 601 bp, Human
tggaaggccagatgcatctgatgtttttgtggcaggcacccaagatggtccttttccctaggctttctaaagattcattatccctggattgactccacccagtgggaattgactggtctgtgtcccttcccacccaaaaagaatcatcttgaaactcacttcttccaggaagtagaccctgatctattcctgagagggaccaagtaggggaatgaatacatatcgagtccctgctgtgaggcaggcattgtctcaggaaatttacgttctcttttgctttctccaaagacacctcaaggargagctttacagatgaagaacctgaaatgtagacagattaactcatttgctcatggccacatgggtatcagcaggcagagctctacctagctcagacagggcccaccactcctgctccgtccatgcttctttgtttccttactgagtgacccatctacttatgcacttaggcatggcctccagccagattgcttcatccacatttgcttatgttcttaaggcttctgtgtacacttactagagtgtcagtggatctgtctttcccatctggtgacccatctttcgcgaaaggatggacacc

SEQ ID NO: 29357 - DNA, 601 bp, Human
atcttgaaactcacttcttccaggaagtagaccctgatctattcctgagagggaccaagtaggggaatgaatacatatcgagtccctgctgtgaggcaggcattgtctcaggaaatttacgttctcttttgctttctccaaagacacctcaaggaagagctttacagatgaagaacctgaaatgtagacagattaactcatttgctcatggccacatgggtatcagcaggcagagctctacctagctcagacagggcccaccactcctgctccgtccatgcttctttgtttccttactgastgacccatctacttatgcacttaggcatggcctccagccagattgcttcatccacatttgcttatgttcttaaggcttctgtgtacacttactagagtgtcagtggatctgtctttcccatctggtgacccatctttcgcgaaaggatggacaccagtagaatgccaccaatgtctccttgtcatctcagacatgggctgcaactccttctgaagagccttcctggccccattcctgtgttcacagtggttcctgtatgcaggccaaacccctgccagaatggggctacctgctcccggc

SEQ ID NO: 29358 - DNA, 601 bp, Human
tcacttattttaaaacagatcattgaaattcatcagcctcctttctaggaagattttcttactcagcaaggcaatgttatgctgctgtagtaaacaactgccaaatgtcagtggctcaaatacatcaaagtctatttctgggctggttgctgtggttcatgcctgtaatcctagcactttcagaggctgatgcaggcagattgcttgagcccaggagtttgaggccagcctgagcaaaatggcaaaaccccgtctctaccaaaaaaaaaaaaaaaatagctgaatgtggtggtcagcacckgtagccccagctaatcaggaggctgagatgggaggatcatctgaacccaggaggtcgaggctgtagtgagccactgcactccagcctgggtgacagagtgagaccctgtctcaaaaaaagaaaaaaaaaaaagaaaaaatgtctatttcttactaatgttccatgtgtcatgtgggttggtggtgatgatggcaggggattcagctccacaggcttactcaaatattcaggatcagcaagaagagactgggaaatgaagcatgagtttttctctacctcaacctagaagggacacatcct

SEQ ID NO: 29359 - DNA, 601 bp, Human
cagagatggagaagagcaagtggaaggtctgttgaaggtgatggtctctggcccaaggatgttcaggctttcccatgtgaggctaatgccaccaccctccctggtggtgatctagtttccttcttccttttctgctgcctccaggccactctgttggcttcctgccactaccctttgtctggccaaggccaatgagtcagatgagttgcaggtgagggggtctttgtatggctttgaactggcttcataaatgaggattttttcttgttttttttttttgtttgtttgtttttgtttttgkttttttgagatggagtctcactctgtcacccaggctagagtgcagtggcaccatctcagctcactgcaacctctgcctctcaggttcaagcaattctcctgcctcagccttccaagtagctgggattacaggtgcgcaccaccacacccggctaatttttgtatttttagtagagatgggtttcaccatcttggccagcctggtctcgaactcttgacctcatgatccacctgccttggcctcccaaagtgctgggattacaggcatgagccactgcacccggccatgaagatttttttt

SEQ ID NO: 29360 - DNA, 601 bp, Human
gtttttgtttttttgagatggagtctcactctgtcacccaggctagagtgcagtggcaccatctcagctcactgcaacctctgcctctcaggttcaagcaattctcctgcctcagccttccaagtagctgggattacaggtgcgcaccaccacacccggctaatttttgtatttttagtagagatgggtttcaccatcttggccagcctggtctcgaactcttgacctcatgatccacctgccttggcctcccaaagtgctgggattacaggcatgagccactgcacccggccatgaagatttttttttttcacaaaacactagtactttccacttgcactcaccttgagctgttccctttgtggagctgtcttcgggggcggggggagggggggcctcttggcagcctttctcagaggattcccatgcatagaattcaaagcctcaggcagaggaacccaactctcaccatgtttatgtgatgattttactctcctgatatagaaaggtcttcatcagggatctcatttcttttcctacaaataatttggtatgtcctgtggatctggcatgagacttgggaccgctttcttgtccttga

SEQ ID NO: 29361 - DNA, 601 bp, Human
acacccttctgttctaaggttttgtaacctgatggaggattcaaagaaatgtggtcccagggggagcacaagagtctagcaccttcttatccaaaggttctttaataagatccagtgtgttcatcaagccttgactctgagttgttttgttttgtattttagaaacccagatgcggacgaaaagccctggtgctttattaaagttaccaatgacaaggtgaaatgggaatactgtgatgtctcagcctgctcagcccagggtaaaggccatggctgttcagaagcccagggggtggggggratggagatttgtagggagatgtccctggcacctggtccctccctcaccctgttcttcctccacacctgctttaccaattcccatcccagtgccagcccaactgcccaactgtctgcacccaccaggatgccaagcaggtctggatacctttgtgggtttaggtcaggtagtccaactctaaactcatggtttctgactccaaatcagtgccctcaacagatatttacccatctcttgctgtttgccagccactatgctgggcactgggtgtgcaatggtgatcaaactggctgggctccc

SEQ ID NO: 29362 - DNA, 601 bp, Human
aagatccagtgtgttcatcaagccttgactctgagttgttttgttttgtattttagaaacccagatgcggacgaaaagccctggtgctttattaaagttaccaatgacaaggtgaaatgggaatactgtgatgtctcagcctgctcagcccagggtaaaggccatggctgttcagaagcccagggggtgggggggatggagatttgtagggagatgtccctggcacctggtccctccctcaccctgttcttcctccacacctgctttaccaattcccatcccagtgccagcccaactgccyaactgtctgcacccaccaggatgccaagcaggtctggatacctttgtgggtttaggtcaggtagtccaactctaaactcatggtttctgactccaaatcagtgccctcaacagatatttacccatctcttgctgtttgccagccactatgctgggcactgggtgtgcaatggtgatcaaactggctgggctcccatagcctcttaggatgcaaagcattcaaattccagcctcacagtcttcctggccatctgtcctggccccgctctgtgcccacatctagaatgatgtgcccttccac

SEQ ID NO: 29363 - DNA, 601 bp, Human
tgtcctggccccgctctgtgcccacatctagaatgatgtgcccttccaccctgaccagtgggattccttccctgagcagtttcacatatgtgcctttgatcttatggttacttctgtctataacataccatcccatatctgttcttgtccatatacaactattctttgagaaccaactcaaatatcccctcctccaggaagtcctccttgatttctcaagtaaaatgttatctctgcctccttacaaaccctaaggaacaggacaaggcaccacctatacaacatttactgctctctcctyttgtgtcacagtcatctgtgcaaatgtcttatctcacctattctagttcatctgaatatcctcccctctaccctgaaaaagcctccacaattgtaagtgtgcactaataatgaaaggtgcattgatgatgcacatttataattgtgggggctttgtcaaggtgaagtacatacccagtgagggatttgtatatttacataaacataatgtgtgtgtgtacatgtcaatcttaggagtcacatactttgaaatggacaagaaaaaactacattgttaattctatagacttgctttatgtta

SEQ ID NO: 29364 - DNA, 601 bp, Human
tggtcaaggctggtccaacaaagtctgggttttggaggtggccatgaaggtcttccagttcaccttatagtaaatgatttctctgggattctaggaggtgctcctcaagagaggtcaagcaggcaaacattagcacctgccaatggattttagaagattggttcaagatggcaatggctgtttctttggaaggcctagggagaatgggaggtctcccatgagaagtgggtaaaagttatagcttatatttggagcttgcttctgttaataaagcacttcccttacataatcttatttggaycctaccacagcagagttctgtgagtgagacgagggttacaaatgaggaggctgagtctgcagaaggtcagatttgccaaaggccacacagctgagcagaaacagtgccttcctgaccatctcattttcccttgcagcataaaaaccagacatctaaaggtggtgctaggggaccaggacctgaagaaagaagaatttcatgagcagagctttagggtggagaagatattcaagtacagccactacaatgaaagagatgagattccccacaatgatattggcaagttcctctttcatggct

SEQ ID NO: 29365 - DNA, 601 bp, Human
acatctaaaggtggtgctaggggaccaggacctgaagaaagaagaatttcatgagcagagctttagggtggagaagatattcaagtacagccactacaatgaaagagatgagattccccacaatgatattggcaagttcctctttcatggctttcctgagggtcttgtcctgggtggatttctctatgaccagaaagctgaagtttggttctagaaggtgctcttgattgtttttggtccctgtggaccctgtgcggtagggaatgtattccagggatttttagtttttgagggtatgtgyaaatgtagataaatgggcatatgctcttaaactgaggggaagcaatgctaggaacattgtgctatggaataggcttggcctggaatcccagcttcccaactttatcaccaggagacagctcacctcctgagccctcttttctcttctatgaaatggaaacactgatgcacaactctcagcttcctatgtgtcaggagacacaatgtgcttgcaggcatgcctggcccctagcccctggcaggtgctccagtgcaaatgcaatgacgttcctagctaccagctgctcagttctgtatcccg

SEQ ID NO: 29366 - DNA, 601 bp, Human
agacagctcacctcctgagccctcttttctcttctatgaaatggaaacactgatgcacaactctcagcttcctatgtgtcaggagacacaatgtgcttgcaggcatgcctggcccctagcccctggcaggtgctccagtgcaaatgcaatgacgttcctagctaccagctgctcagttctgtatcccgtttcccttttcatgagacacccccccacctctctctccttcctcaatagcttttttcccctctaatggcctgtttcttaaaaaatggattagaaatgatttcaaagtcaattrtcatttcttgacatgactctcgccctgaagtgttactccttcctgggtggaagttcaaaatatgaaatgaccacggaagaagattttcaggcatggtgggggcaggtggggctttgctgtggccaccttcatgagcaagttggagctggtgcttctctgacaaagaggtgacatcgcatccattttctacctctctctccacctagcattgctcaagttaaagccagtggatggtcactgtgctctagaatccaaatacgtgaagactgtgtgcttgcctgatgggtcctttccctctgg

SEQ ID NO: 29367 - DNA, 601 bp, Human
catgcctggcccctagcccctggcaggtgctccagtgcaaatgcaatgacgttcctagctaccagctgctcagttctgtatcccgtttcccttttcatgagacacccccccacctctctctccttcctcaatagcttttttcccctctaatggcctgtttcttaaaaaatggattagaaatgatttcaaagtcaattgtcatttcttgacatgactctcgccctgaagtgttactccttcctgggtggaagttcaaaatatgaaatgaccacggaagaagattttcaggcatggtgggggyaggtggggctttgctgtggccaccttcatgagcaagttggagctggtgcttctctgacaaagaggtgacatcgcatccattttctacctctctctccacctagcattgctcaagttaaagccagtggatggtcactgtgctctagaatccaaatacgtgaagactgtgtgcttgcctgatgggtcctttccctctgggagtgagtgccacatctctggctggggtgttacagaaacaggtgagtcggccatgcactctcccatgacttaggtgaactacatcaaccagagaagaaaggcc

SEQ ID NO: 29368 - DNA, 601 bp, Human
gctccagtgcaaatgcaatgacgttcctagctaccagctgctcagttctgtatcccgtttcccttttcatgagacacccccccacctctctctccttcctcaatagcttttttcccctctaatggcctgtttcttaaaaaatggattagaaatgatttcaaagtcaattgtcatttcttgacatgactctcgccctgaagtgttactccttcctgggtggaagttcaaaatatgaaatgaccacggaagaagattttcaggcatggtgggggcaggtggggctttgctgtggccaccttcwtgagcaagttggagctggtgcttctctgacaaagaggtgacatcgcatccattttctacctctctctccacctagcattgctcaagttaaagccagtggatggtcactgtgctctagaatccaaatacgtgaagactgtgtgcttgcctgatgggtcctttccctctgggagtgagtgccacatctctggctggggtgttacagaaacaggtgagtcggccatgcactctcccatgacttaggtgaactacatcaaccagagaagaaaggccaaactcaactgcccttttgaagttgaaa

SEQ ID NO: 29369 - DNA, 601 bp, Human
cgttcctagctaccagctgctcagttctgtatcccgtttcccttttcatgagacacccccccacctctctctccttcctcaatagcttttttcccctctaatggcctgtttcttaaaaaatggattagaaatgatttcaaagtcaattgtcatttcttgacatgactctcgccctgaagtgttactccttcctgggtggaagttcaaaatatgaaatgaccacggaagaagattttcaggcatggtgggggcaggtggggctttgctgtggccaccttcatgagcaagttggagctggtgsttctctgacaaagaggtgacatcgcatccattttctacctctctctccacctagcattgctcaagttaaagccagtggatggtcactgtgctctagaatccaaatacgtgaagactgtgtgcttgcctgatgggtcctttccctctgggagtgagtgccacatctctggctggggtgttacagaaacaggtgagtcggccatgcactctcccatgacttaggtgaactacatcaaccagagaagaaaggccaaactcaactgcccttttgaagttgaaatgagtgtcatattcaaaatgc

SEQ ID NO: 29370 - DNA, 601 bp, Human
gcactctcccatgacttaggtgaactacatcaaccagagaagaaaggccaaactcaactgcccttttgaagttgaaatgagtgtcatattcaaaatgcatcaaccaaagaaagcatccacctcattgatcaagctctggttaaattcctccacctgcagggagccttccctgagtttctctgatctccatatctgtccctggccctacccctaaatacttgaattttaccaagcattgaccctgcatttatggagctcttgctcccttcctagttagattggaaagaggaaagatcatggrtttttgagtcagacagactggtattcaattcttgactttgtcacttgaacaactgagttttagtttctcaataatcatacttacttcccgggtttgcaagcatgatcacaggggatgatagaattctacagagacattcattaagtcagcccttagaagatgggggtcaggtcccattcatctctgtctgtctcacagtactttgctcggggttctccacacagtagacattctataaaattgtgttaaatccagctgttgatttgtctttaggatttggtctaatttttaaaagtaacc

SEQ ID NO: 29371 - DNA, 601 bp, Human
aaatacttgaattttaccaagcattgaccctgcatttatggagctcttgctcccttcctagttagattggaaagaggaaagatcatggatttttgagtcagacagactggtattcaattcttgactttgtcacttgaacaactgagttttagtttctcaataatcatacttacttcccgggtttgcaagcatgatcacaggggatgatagaattctacagagacattcattaagtcagcccttagaagatgggggtcaggtcccattcatctctgtctgtctcacagtactttgctcgggkttctccacacagtagacattctataaaattgtgttaaatccagctgttgatttgtctttaggatttggtctaatttttaaaagtaaccaaaggattactttcctcatagtactggcaacattatacccactactacaaaaaaaattcagaaaggtatttcatgtcttttccaaatactcaaaatatatttctcttccttcgcaaatcctgtccttaataatgaatagcgagaatcacgataaataagtctgcagaaattccacatatctgaacaaagtgaaatgtaatatacaactttga

SEQ ID NO: 29372 - DNA, 601 bp, Human
tttctcaataatcatacttacttcccgggtttgcaagcatgatcacaggggatgatagaattctacagagacattcattaagtcagcccttagaagatgggggtcaggtcccattcatctctgtctgtctcacagtactttgctcggggttctccacacagtagacattctataaaattgtgttaaatccagctgttgatttgtctttaggatttggtctaatttttaaaagtaaccaaaggattactttcctcatagtactggcaacattatacccactactacaaaaaaaattcagaarggtatttcatgtcttttccaaatactcaaaatatatttctcttccttcgcaaatcctgtccttaataatgaatagcgagaatcacgataaataagtctgcagaaattccacatatctgaacaaagtgaaatgtaatatacaactttgagtcttttgagaaagatgtctggctaattggatttagggtcagccagtaaactcattttacagccattttcattgtagtccatctgaacttgtcaacctctattctgctcaatatggtctggtcagcatggtgatgtctcagttgggaatctt

SEQ ID NO: 29373 - DNA, 601 bp, Human
aggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccaggtcagagactccaagtggtgcttgtggtaggagaggctagcaggatgtttcactaggcagaggacccttagagccctgggctgggagctaggttcagaggtccacctgtggtaaagctaagacacaggtgagctgtgtctgccccctggcccyctggtgcatctgcatccgcatcaacccaggatgactcagcataatgaccacagaggtcacattgcctgcactgtctaatttaactctcacaacacactggtgaaggtgatgtcatgatcaccattttacagatgcttagagaagttatcttggcctatagcaattgggtggccagtggcagggctgggatttgaacaatacagtctgcaggacaccaaaggggcttgtggcctcagtgtagggcagcctttctgagaatcccagtaaacagggaactgtccagaagaccagtggctagaa

SEQ ID NO: 29374 - DNA, 601 bp, Human
ctcacaacacactggtgaaggtgatgtcatgatcaccattttacagatgcttagagaagttatcttggcctatagcaattgggtggccagtggcagggctgggatttgaacaatacagtctgcaggacaccaaaggggcttgtggcctcagtgtagggcagcctttctgagaatcccagtaaacagggaactgtccagaagaccagtggctagaaggagaaagaagaaggcctagagctagagatttcacagtaatattaactcatgattaggactcatgtgtgcgtgtgtgtgtgtgtgkggggggggggggtgttttagccctagaaaactaagtatatctgtagcctagggcctttcagaactccaagttgctgaggcttgtgactcagagacactgttgcagagagagaaggtggtggctccatcaaccaatgctaaagtgacttcaggccctgccccaagtcaaagcccattccccatagtccctttatctgtagggatcacatcacacagggtcctttctagaatcccaggaacacctccatttagaattttctgactgttgtccccataagccttctaaatgtcctggaaaaca

SEQ ID NO: 29375 - DNA, 601 bp, Human
gttgtccccataagccttctaaatgtcctggaaaacagcatgccaacattcaaatcccaactccttcagggagcctccccgtacaaaggaacccacaatgatttgctggccttgaactcactttgggatgggacatcaaggttcctctctccagggtttgtggctctcctgtgactatctgtctcttcccagtgagccaaggatgttcacctactcagaggaggggcagatgggtgcaatttgccctaaactccttcccagaagatggttaagaaaacagctcattcaggctgggcatgcrtggtggctcaagcctgtaatcccagcactttgggaggctgaggcgggcagatcacctgaggtcaggagttcaagatcagcctagccaacatggtgaaaccctgtctctactaaaagaaaaatacaaaaattaggtggacatggtggcacatgcctgtagtcccagctactggggctgaggcaggagaatcgcttggacgtgggaaacggaggttgcagtgagccaagagggtgccactgcactccagcctgggcaacaaagcgagaccctgtctcaaaaaaacaaaaacaaacaaacaaa

SEQ ID NO: 29376 - DNA, 601 bp, Human
aggatgttcacctactcagaggaggggcagatgggtgcaatttgccctaaactccttcccagaagatggttaagaaaacagctcattcaggctgggcatgcgtggtggctcaagcctgtaatcccagcactttgggaggctgaggcgggcagatcacctgaggtcaggagttcaagatcagcctagccaacatggtgaaaccctgtctctactaaaagaaaaatacaaaaattaggtggacatggtggcacatgcctgtagtcccagctactggggctgaggcaggagaatcgcttggacstgggaaacggaggttgcagtgagccaagagggtgccactgcactccagcctgggcaacaaagcgagaccctgtctcaaaaaaacaaaaacaaacaaacaaaaaaaaacctcattcaattccctagataattgaaggctttcacttgcaggctttggaaacaaatagttgtgaattgaaacctgtttctgtctcttactgtatggcttttatcagtgatgaaagcaattcttcaatctcagatgcctaaactataaaatggaaatctatctataagatcacaaggtcgtggctaagtttaa

SEQ ID NO: 29377 - DNA, 601 bp, Human
gctcaagcctgtaatcccagcactttgggaggctgaggcgggcagatcacctgaggtcaggagttcaagatcagcctagccaacatggtgaaaccctgtctctactaaaagaaaaatacaaaaattaggtggacatggtggcacatgcctgtagtcccagctactggggctgaggcaggagaatcgcttggacgtgggaaacggaggttgcagtgagccaagagggtgccactgcactccagcctgggcaacaaagcgagaccctgtctcaaaaaaacaaaaacaaacaaacaaaaaaaamcctcattcaattccctagataattgaaggctttcacttgcaggctttggaaacaaatagttgtgaattgaaacctgtttctgtctcttactgtatggcttttatcagtgatgaaagcaattcttcaatctcagatgcctaaactataaaatggaaatctatctataagatcacaaggtcgtggctaagtttaaaatagagaattcattttttaaaaacctgtcagttgtagtgtttaagcagtattaagtttttgagagctatcaccctcaatgtcttcttctcctcaccatcatcatcc

SEQ ID NO: 29378 - DNA, 601 bp, Human
acctgtcagttgtagtgtttaagcagtattaagtttttgagagctatcaccctcaatgtcttcttctcctcaccatcatcatcctcgccaccttccgtgagggtttaatatgaaccaggcactgttctatatactttacaaacaatcttcacaagaaccctgggggatggggatctattgctatctatggtttacagtgtgagaaactgaggcctaaggtcacatgcctggcaggtggtagggcctggcttaaaacccaggagatctaaccccatagaccatgctgagcacctaggccacrctgccttggagtccccaacctcctcccctatgtgtgctgagggcccccgagaactcacagtcataacatctgcatcactgagagttgggaagtgcagctgtgcggctcctctgttaagcccgcgtggactcagggacggaggacactgttatcttctctcccttagagtcttgtatcatgtgagatgtggggagagccttgtcactgctttccagagaagcccacggaggctggcaagggactccaccccatccctccctgacaccccctggagagaggtgggggcatctccagatgtct

SEQ ID NO: 29379 - DNA, 601 bp, Human
gtattaagtttttgagagctatcaccctcaatgtcttcttctcctcaccatcatcatcctcgccaccttccgtgagggtttaatatgaaccaggcactgttctatatactttacaaacaatcttcacaagaaccctgggggatggggatctattgctatctatggtttacagtgtgagaaactgaggcctaaggtcacatgcctggcaggtggtagggcctggcttaaaacccaggagatctaaccccatagaccatgctgagcacctaggccacgctgccttggagtccccaacctcctmccctatgtgtgctgagggcccccgagaactcacagtcataacatctgcatcactgagagttgggaagtgcagctgtgcggctcctctgttaagcccgcgtggactcagggacggaggacactgttatcttctctcccttagagtcttgtatcatgtgagatgtggggagagccttgtcactgctttccagagaagcccacggaggctggcaagggactccaccccatccctccctgacaccccctggagagaggtgggggcatctccagatgtctctggttcacgaggatgagcttatgc

SEQ ID NO: 29380 - DNA, 601 bp, Human
ttgcattgaaactgtaaatcagggaagtttctcttttgttcctttgcactgtgcacacacaccatgtttatgtaaccagtcctctgaggttggacattttggtcctttccatattttttttttttttgaaacggagtctcactctgttgccaggctggagtgcaatggcacaatctcagctcactgcaacctccgactccctggttcaagtgattctcctgcctcagcctcccgagtagctgggattacaggcacatgctaccacgcccagctaatttttgtatttttagtagagacaggrtttcactatgttggccaggatggtctcgatgatccacccgcctcggcctcccaaagtgctgggattacaggcgtgagccactgcgcccgacccctttccatatttttaataatataaaccctatttgctgttccaggcatttactgagtgcctgctgtgtgtcaggcaccaagctaggagtgcttgttatcctcacagcccccttcttgctttgcagtttcaatggcatgccaatgaggaaagtttagtttagtttagtttagtttagtttagtttagtttagttttgttttgttttgtt

SEQ ID NO: 29381 - DNA, 601 bp, Human
tagtagagacagggtttcactatgttggccaggatggtctcgatgatccacccgcctcggcctcccaaagtgctgggattacaggcgtgagccactgcgcccgacccctttccatatttttaataatataaaccctatttgctgttccaggcatttactgagtgcctgctgtgtgtcaggcaccaagctaggagtgcttgttatcctcacagcccccttcttgctttgcagtttcaatggcatgccaatgaggaaagtttagtttagtttagtttagtttagtttagtttagtttagtttwgttttgttttgttttgttttgtttgagacagagtctgactctgtcgcccaggctagagtgcggtagtgcgatctcggctcactgcaatctctgcctcccgggttcaagtgattctcctgcctcagcctcctgagtagctgagactacaggtgcctgccaccatgcccggctaatttttgtattttttagcagagatgaagtttcaccatattggccaggctggtctcgaactcctgacctcaggtgatctgccctcctcggcctcccaaagtgctgggattacaggcgtgagccaccacg

SEQ ID NO: 29382 - DNA, 601 bp, Human
cagaaggaaattctgggaaggaattgagctcctccactcagtcacgcagcaaatattaaggaagacctactggctgtgtgatctgagccttgatttccttatctgtaaaatggagttgatctacttcctccttcagagtgctcatccaagatccaatctggccactagatatagtttggaagagaagatagaccttacactttaaatgtagtagcccaacggttagagctgaagtttgtacttgggggagtcagggaaggcttccaggagaaggtggcatttgagccaagtcttcaaaagwttactagacttgagcagctgatgctttaaaagagcgtgaactgctttttgagggatgggcagtgaagaaacgacaatcagactcgtagcacattgtacccctccctgctcactgctgttgggcgtttccttcattcctgccttcttttattcagtccatcagcaaaaatctattgggcacctactatgtgcccggcaaataaaatagaacttgaccgttcttttcccactgtgacaaccttgctgacttttttggggtcttatcttaaggctgccaccatcttccctgaatctgtttccc

SEQ ID NO: 29383 - DNA, 601 bp, Human
gtcctggctcttggatgagtgtctttctgtctctgagtctctacttcctcatctcccaaaggggacgggcctgcttccttgatggagtcatgggagggctaagtgcggtaatatcatgtctccttggtttgcttcccacagaagcagactttagggcaagaattccagtgcaatactttatcttggaagcgatctgaggaaacccacaggggagtggggaagtgaggaagggaagggaagggaaggaagtcagcctggtgggcaagtgaagctctgtctagctggggaactcagggacagyggagaacacgcctctgagttactccagccccacgctgtcaccccgtcctcctgcttgccattggccaagggctgcttccaggggctctggctctcaggcactttgaacagttctctgacctcagaggcacttggatggaaggggtattcatgtgctagggctgccataacaagcatagactgggtggcttaagcagaaatgtgttttctcacagttctggaggctgagggccaaggtcaaggttttggcaggcctggtttcttctgaggccactctctttggcttgcagatggctgccct

SEQ ID NO: 29384 - DNA, 601 bp, Human
tcctcatctcccaaaggggacgggcctgcttccttgatggagtcatgggagggctaagtgcggtaatatcatgtctccttggtttgcttcccacagaagcagactttagggcaagaattccagtgcaatactttatcttggaagcgatctgaggaaacccacaggggagtggggaagtgaggaagggaagggaagggaaggaagtcagcctggtgggcaagtgaagctctgtctagctggggaactcagggacagcggagaacacgcctctgagttactccagccccacgctgtcaccccrtcctcctgcttgccattggccaagggctgcttccaggggctctggctctcaggcactttgaacagttctctgacctcagaggcacttggatggaaggggtattcatgtgctagggctgccataacaagcatagactgggtggcttaagcagaaatgtgttttctcacagttctggaggctgagggccaaggtcaaggttttggcaggcctggtttcttctgaggccactctctttggcttgcagatggctgccctttggcaatgtcctcacgtggtctttcctctgtgctcaagaaatcc

SEQ ID NO: 29385 - DNA, 601 bp, Human
gagtacttgaaaagtgcctggtacaagttgagatctactctaagtatgcaacactggatttgaagatttaggattaaaaaacaaacaaacaaacaaaaaaacagcagctgagcacggtggctcatgcctgtaatcccagcactttgggaggctgaggcaggtggatcatttgaggtcaggagttcaagaccagcttggtcaacatggtgaaaccccatctctactaaaaatacaaaaattagctgggcgtagtggcgcatgcctgtaatctcagctacttaggaggatgagacaggagaaycgctgtagcctgggaggcggaggttgcggtgagccaagatcacgccactgcactccagtctgggcaagagagtgagaccctatctcaaaataattaattcattagttaattaaataaaataaattagccaccacacctggctaatttttaaaattatttattataaataaataaatctcattaatattttttatattgattacatgttgaaatcatactatgtattactaaaattaatttcagctctttctttttatctttttaatgtatcttctggaaaatttaaaattacatgtgtgg

SEQ ID NO: 29386 - DNA, 601 bp, Human
acagcagctgagcacggtggctcatgcctgtaatcccagcactttgggaggctgaggcaggtggatcatttgaggtcaggagttcaagaccagcttggtcaacatggtgaaaccccatctctactaaaaatacaaaaattagctgggcgtagtggcgcatgcctgtaatctcagctacttaggaggatgagacaggagaaccgctgtagcctgggaggcggaggttgcggtgagccaagatcacgccactgcactccagtctgggcaagagagtgagaccctatctcaaaataattaattmattagttaattaaataaaataaattagccaccacacctggctaatttttaaaattatttattataaataaataaatctcattaatattttttatattgattacatgttgaaatcatactatgtattactaaaattaatttcagctctttctttttatctttttaatgtatcttctggaaaatttaaaattacatgtgtggctctcattctattgctttagaaagacggctggtttatatgttacctacatatgcacatttgttctagttccatgaaaggaactggccacactctcttacc

SEQ ID NO: 29387 - DNA, 601 bp, Human
caggagttcaagaccagcttggtcaacatggtgaaaccccatctctactaaaaatacaaaaattagctgggcgtagtggcgcatgcctgtaatctcagctacttaggaggatgagacaggagaaccgctgtagcctgggaggcggaggttgcggtgagccaagatcacgccactgcactccagtctgggcaagagagtgagaccctatctcaaaataattaattcattagttaattaaataaaataaattagccaccacacctggctaatttttaaaattatttattataaataaataaaactcattaatattttttatattgattacatgttgaaatcatactatgtattactaaaattaatttcagctctttctttttatctttttaatgtatcttctggaaaatttaaaattacatgtgtggctctcattctattgctttagaaagacggctggtttatatgttacctacatatgcacatttgttctagttccatgaaaggaactggccacactctcttaccctggcttttgtcactgaagtatcttaaatatctctttctatgggcatatgactatctacctcattttttttcactt

SEQ ID NO: 29388 - DNA, 601 bp, Human
aaagtatacattcagtggcatgtagtacattcacaattttgtgccatgtccacccctatctgactccaaaacattttcatcatcccaagagaaaattccttacccattaaacaatcattccccatttcccttcccccagctccagacaaccaccactggggttggagactcctggaatagaccacattttgccccattgttctcaaaggctgcataacattgggtgcccacagcttattcaacctgtcgctgctagcggacatgtaggctgcttcctttttttttttttttttttttttttgctactgcctatgatgcttcagtgagctgccccacaccacgcgtatatcttggcaggaagagctacgggataaaggcttagaagttaaattactgggccaaagagtatgtatgttagaacgaggagagatctcactgatttgtgtttcagaaagcttgtgccaatgtgcactctcccagccacagtgtctgggacttctgtttactcgtacattcaatagcattgagtactaaaacttcaaaagttttttttgaatctgataggcgagaactggtgtcattgttattttcatttttaatg

SEQ ID NO: 29389 - DNA, 601 bp, Human
caatcattccccatttcccttcccccagctccagacaaccaccactggggttggagactcctggaatagaccacattttgccccattgttctcaaaggctgcataacattgggtgcccacagcttattcaacctgtcgctgctagcggacatgtaggctgcttcctttttttttttttttttttttttttgctactgcctatgatgcttcagtgagctgccccacaccacgcgtatatcttggcaggaagagctacgggataaaggcttagaagttaaattactgggccaaagagtatgtrtgttagaacgaggagagatctcactgatttgtgtttcagaaagcttgtgccaatgtgcactctcccagccacagtgtctgggacttctgtttactcgtacattcaatagcattgagtactaaaacttcaaaagttttttttgaatctgataggcgagaactggtgtcattgttattttcatttttaatgacttttacatgcttattttgtactgcatttcctgttcatatctttttttttcttttgagttgttctttctttccttgttaatttatattggcttgttctttgtatattagg

SEQ ID NO: 29390 - DNA, 601 bp, Human
agcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtaggtctccatcggggcactgccagctggactcctggttgcagctcccggccaatccagcgctcagcctggcctccgataattgcaatgatccaggtggcttgcacaggcacttgaagatcattctctggggaaccctgttragatgaacagacttaagccaggaatattggtgcatcattttcattaaaaaaataaactttcattcacctgacaaggggacccttgtcaggtgaatgaaatctggctatttggaggaacacagaaactttggttgaaggagagtttgcgaaaaacatacaagtccttggacaagtcatttcatctcttctagtctcagtttccttgattagaaaagtgtgaccgggtgtggtggctcacgcctgtaatcctaacaatttgagacgccaaggcagaaaatcgcttgagctcaggagttcaag

SEQ ID NO: 29391 - DNA, 601 bp, Human
ctgcaacctccacctcccaggttcaagcaattcttctgcctcagcctcccgagtatatgagaccacaggcacgtgccaccatgcccagttaattttttgtatttttagtagagacggggtttcaccatattggccaggctggtcttgaactcctgacctcatgatctgctcacctcagtgtcccaaagtgctgagattacaggcgtaagccaccacacccagccagtcccattggatcttaacctcgaccttggaaggaggtgccattttccacatggacagaggaggctgaggggtggaktagctttcccagtgtcaccttgctggtgagaggctgaatcaggattggagcttcctagaatgtggagcagcttgtaccaaagcccttctagggctaggtgtcttgggaaagatggagatctcacctgacccctgatccttagagatcttcgaattatcttccagaaaaactaagagcctgacgcaggcctttctaattccccactcagggtgggatgtggtacctggaccagcaaggctaaggagaagaataagcactcacgaatgcttgctctctgggcgatatatactcactatctct

SEQ ID NO: 29392 - DNA, 601 bp, Human
gctattctttgaaaatggtctcttgattgacattgcccttggtctttcctgcataaaacattaaactgctacaaattccatcccaggtttctttaactgcaatgagaatttaaagacatttgcaaagccatcccagtgtagaatccttcttgatctttatgattttttttcctcctaagattttctgttgtctgttccaaatttaatcttgcttttagaggggtttttttgtttttcgtttttttggttttttggttttttttgcacctcacctttccagagtatttatcttaggttttcrtagaaagaacccttatagctggggccgggcatggtggctcatgcctgtaatcccagcactttgggaggccgatgggggtggaccatttgaggtcagaagttctagaccagcttagccaacatggtgagaccccagtctctactaaaattacaaaaattagcagggtgtggtggcacatgcctgtaatcccagctacttaggaagctgaggtaggagagtcacttgaacctgggaggcagaagttgcagtgagctgagattgtgccattgcactctagcctagataacagagcaagactgt

SEQ ID NO: 29393 - DNA, 601 bp, Human
gcactccagcctggccaacagggcgagactccatctcaaaaaaaaaaaaaacaaaaaaactatctacattaactgtatgtttatttgtgtttatttctagttagtgtctagttctgctattaaactctaaattctgagaggccaggacctcccaaaggaaaactttgtaatggtggagtttcaggcactgtctccagccagtgccccctcctcaggctatgtcagtgactccctagctcaggtgtccagccctgggacagactgaaaagtccaactggaccctagtggagtccacatgggkgcccacatagttttattgtttgtatttccttggtacctggctcatgacaagcacttataaatatttgtaaatcagtgatcactgagcacatgtgtggaataatgtgactgcagtgatcagcacggggccagaccagagctggggaactcactcagtcattctcttcccatgtttttcagatttgcgaaatgatccagaaatcagtgtcctccgatctacagccttatctccaaactctgccaggtaggacaccccatccatcccgggacacttttatttctgttaatttctataagagca

SEQ ID NO: 29394 - DNA, 601 bp, Human
tatttctagttagtgtctagttctgctattaaactctaaattctgagaggccaggacctcccaaaggaaaactttgtaatggtggagtttcaggcactgtctccagccagtgccccctcctcaggctatgtcagtgactccctagctcaggtgtccagccctgggacagactgaaaagtccaactggaccctagtggagtccacatgggggcccacatagttttattgtttgtatttccttggtacctggctcatgacaagcacttataaatatttgtaaatcagtgatcactgagcacaygtgtggaataatgtgactgcagtgatcagcacggggccagaccagagctggggaactcactcagtcattctcttcccatgtttttcagatttgcgaaatgatccagaaatcagtgtcctccgatctacagccttatctccaaactctgccaggtaggacaccccatccatcccgggacacttttatttctgttaatttctataagagcatatatatatcttataaaatagtaaatggggcaaaaatatagaaagtaaaaattaagggccaggcgcagcggctcacacctgtaatctcagc

SEQ ID NO: 29395 - DNA, 601 bp, Human
ggaaaactttgtaatggtggagtttcaggcactgtctccagccagtgccccctcctcaggctatgtcagtgactccctagctcaggtgtccagccctgggacagactgaaaagtccaactggaccctagtggagtccacatgggggcccacatagttttattgtttgtatttccttggtacctggctcatgacaagcacttataaatatttgtaaatcagtgatcactgagcacatgtgtggaataatgtgactgcagtgatcagcacggggccagaccagagctggggaactcactcagkcattctcttcccatgtttttcagatttgcgaaatgatccagaaatcagtgtcctccgatctacagccttatctccaaactctgccaggtaggacaccccatccatcccgggacacttttatttctgttaatttctataagagcatatatatatcttataaaatagtaaatggggcaaaaatatagaaagtaaaaattaagggccaggcgcagcggctcacacctgtaatctcagcagtctgggaggccgaggcgggtggatcacctgaggtcaggagttcgagaccagcctggccaacat

SEQ ID NO: 29396 - DNA, 601 bp, Human
tcgtcatatcatgtgatatgcccagattcagcattataagatcctgccaaacagttttccaaagtggttgtaacagaccttatttgttaacagccgtgtagtgttccatcacatggatgtgtcttcatttatttaataagtcccccactgatggacatttaggtgctttgctgtcccttgctattgccaacagggctgcaaggagccatctacaagtggagtctctggatccagggtgcacacattaagctcggagggggagaccctggcaaattatctgagatgttctctgatgccttakctcctaagcccctatgcggttatttgctgacatcacctttaccagaggtccaggtcggcaacccggtactgggacttggaacattcatccattcagggttttggaggggagtgtctgggccctctggacatgccatgcctgaccttcctggttattggctcagcattaagctccaggtgtggctggagaggtgaagcctggactcatggtgtgtgtgtatgtgtgtgtgtgtgtgtgcttgtctggaaactgcttaggccctaggctgagcatacacccccaccattgttaactcatcca

SEQ ID NO: 29397 - DNA, 601 bp, Human
tgcacacattaagctcggagggggagaccctggcaaattatctgagatgttctctgatgccttagctcctaagcccctatgcggttatttgctgacatcacctttaccagaggtccaggtcggcaacccggtactgggacttggaacattcatccattcagggttttggaggggagtgtctgggccctctggacatgccatgcctgaccttcctggttattggctcagcattaagctccaggtgtggctggagaggtgaagcctggactcatggtgtgtgtgtatgtgtgtgtgtgtgtgygcttgtctggaaactgcttaggccctaggctgagcatacacccccaccattgttaactcatccaagggaatccatgtagtgtctttcttgaagaagcaattctttgcctcagggccgggctagtagggggattctgaagaaagtcacagggaatgtgagtcagccagagcccttgcccctcctccagcagctgaaagtgtcatctggcccctaattctgccctgtcctcattcacagttacaacagagattgacagtttcgccgacattgattatagcttagtggaagcccctcgggcaa

SEQ ID NO: 29398 - DNA, 601 bp, Human
aaaagttgaggcctcatgaataatgtcaggatggtgggagaaacagtgtggttcggctcagacggtccagcttaccctggtataagtcaggggccgtctggtagatcgagggtcattttgtccttctgatggcctcctacacctgcacaggccttcgcttctggcatcgtgtttggtttacccatcctactgcggcacgggcctctctttcaatgggatgataatagctacgttttatggagcactcaccatgtgctgggccttgtgctaggatgttcgtttaggcctcacagtgactcgraggtggggactattgttatccccattttatggataaggaagttgaggttcagggagatggaagggctggcctgagatcacaaagtcaggacacaaaccgaagtctgtgtgaccgcaaacctcaccctcgcagaccctctgagtgggagccacacatcagctgccccccggggagagcgggcaggatgctgaagtcccatgtgctctccttgggtgaatgcaggacaggcatctcctccctgccagggtaacccaggctgtggagaagcgacagtcttgcacatccccctgtctccccaat

SEQ ID NO: 29399 - DNA, 601 bp, Human
agtgactcgaaggtggggactattgttatccccattttatggataaggaagttgaggttcagggagatggaagggctggcctgagatcacaaagtcaggacacaaaccgaagtctgtgtgaccgcaaacctcaccctcgcagaccctctgagtgggagccacacatcagctgccccccggggagagcgggcaggatgctgaagtcccatgtgctctccttgggtgaatgcaggacaggcatctcctccctgccagggtaacccaggctgtggagaagcgacagtcttgcacatccccctgyctccccaatcttctttagaccttcagctccagcgggagcaccctaaaacttcttcatgtctctttgctgcagataccgcctgactctaatatccgactgaccaccaagtccttccgacccttcgtcccacgggtaaggagtcccttagttccccatgagtgcagaccgagcctactagactccagaggtttctctttaaaacctctgcatctctcagcttgaccaagagtgagaaggccgggatgagactcccactgaaggctggggtgctgctcctttcaaagcctaaataacagaggc

SEQ ID NO: 29400 - DNA, 601 bp, Human
ttcaaagcctaaataacagaggccacgccccatatcttgtgggaccacagcttgtccaatcttttattggtgttatctaagaatcccaaggaatgctggcatagtccataaaatgtaccctaatgaacagcagctaacaattacagggggcttcctaggtgccaggcatgttcttggttctttaaaaaattattttttggccaggcatggtggctcatgcctgtaatcccagcattgtgggtggccaaggtgggtggattgcttgagtccaggagttcaagaccagcctgggcaacatgaygaaaccccatctctacaaaaaatacaaaaattagccaagcgtagcggcacatagctgtagtcccagccactggggaggctgaggtgggaagatcacctgaggctgcgaggttgaggctgcagtgagctgtgattgcaccactgcactccagcctgggcaacagagtgagaccctgtctcaaaaaaaattattaaaaatgttagtttttgaatgggaaataaattctcaaggttcaacattcaaaagatctagaaggttatagagtggaaagtctcacatccactcctattccctaaccac

SEQ ID NO: 29401 - DNA, 601 bp, Human
tttctgatgatattctatgtatatacaggttcactatctcttatctgaaatgcttggaaaagcaactctgcctaccttcttagtgaagcattttaccccctcagccttccaaatgtctcccttctagaagaggatgtaggttttacatatacataaccaaaaggttcatgggagtgctgtttttccacgaatagcctcctaaaaaggaagagtcttgccccaaattaaactctgtacctatctctagtacacagaaaattaagagcacttttgaaatggtggaatctagggctggtcgtgktggctcacacctataatcctagcactctgggaggccaaagtgggggggtagcttgaggccaggagttcaagaccaacctggacaacatagcaaaaccctgtctctattttagaaagaaaagttaaaaaagaaagaaagaaagaaagaaatgttctgtggaatatcatattaaaagagtaatacgagaaaattaaatattttttttaaaaaagaaatggtgggatccagctgtgtcatatttcgaaaacactggcatctgacctcagcatgcccaattagcagaatgtgatgaggggatgg

SEQ ID NO: 29402 - DNA, 601 bp, Human
ataatggcaaaaccctggagacaacttgatgcccaatagagtttaatccatcgcaggacccatacataacgaaatacaacacagccgtgaaatagatggtgcagactctgtgtctgacatggagagatggccagttttgccactaggagaaaaaggcacagagaattttgttggaaataaaatcaatcgaaagcaacttccagctttatctgactccctcaggcctctcctggcagacttgtatattttcttctcttgatgtaatctcctaattctgctcccagttagccaggctctaccycaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggtaaggttcagagcctttgcaaatgctgtttccttttccccacatgcttttcccttttccccacatgcttttctccccactcaccacctgggtaattcctccaggtctcaacttaaatattacttcccgagagagggctttcttgctgg

SEQ ID NO: 29403 - DNA, 601 bp, Human
tgccactttttcttgtaacaccccattatctttcttctcagcgtttactacaaagatactttgtagctgtctgcaggtgtatttgtttaatgcatgtatctctcactatgtgagtctgggctattgtggggagaaaggtatactggtgtttgtctatttgtctattttgaccttggaagactacatttcccaagcttctttgcactttgatttccacccaggtcaaccaatgggaggtactgtcaggagaatgatggcggggaggaaggatgaagccagagtactatttcctctttctttrccacggcagaggctctggctgtgactatgtctcctcatggtgacttccataattccacctccactctttgttcctctagtcctggggtggatacagcctcctgtctctggataatctctgggtggcctcaccaactctttactagcttctcaacaattccatcacttgtataaccaattccccgtattaaattccctctgcgttaaacattgagagtcagttttccttttttgatggactctgtctaatagggaagggatgttgggtcctttgggggccttgctccctggatggagaact

SEQ ID NO: 29404 - DNA, 601 bp, Human
tatctttcttctcagcgtttactacaaagatactttgtagctgtctgcaggtgtatttgtttaatgcatgtatctctcactatgtgagtctgggctattgtggggagaaaggtatactggtgtttgtctatttgtctattttgaccttggaagactacatttcccaagcttctttgcactttgatttccacccaggtcaaccaatgggaggtactgtcaggagaatgatggcggggaggaaggatgaagccagagtactatttcctctttctttaccacggcagaggctctggctgtgacwatgtctcctcatggtgacttccataattccacctccactctttgttcctctagtcctggggtggatacagcctcctgtctctggataatctctgggtggcctcaccaactctttactagcttctcaacaattccatcacttgtataaccaattccccgtattaaattccctctgcgttaaacattgagagtcagttttccttttttgatggactctgtctaatagggaagggatgttgggtcctttgggggccttgctccctggatggagaactctgctctcttgtttcttgacttttga

SEQ ID NO: 29405 - DNA, 601 bp, Human
tttccacccaggtcaaccaatgggaggtactgtcaggagaatgatggcggggaggaaggatgaagccagagtactatttcctctttctttaccacggcagaggctctggctgtgactatgtctcctcatggtgacttccataattccacctccactctttgttcctctagtcctggggtggatacagcctcctgtctctggataatctctgggtggcctcaccaactctttactagcttctcaacaattccatcacttgtataaccaattccccgtattaaattccctctgcgttaaacaytgagagtcagttttccttttttgatggactctgtctaatagggaagggatgttgggtcctttgggggccttgctccctggatggagaactctgctctcttgtttcttgacttttgaaatcaacaagtcaaatctctaccagggtaattcttcctagaggctatatctgcaatttaatattgttgttattgttatcaaaagtgtcattattaatatattttaaattaaaatataatttactgtctgggtgtggtggctcacatctgtaatctcagcactttgggaggtcaaggcaggagaa

SEQ ID NO: 29406 - DNA, 601 bp, Human
tgtggtggctcacatctgtaatctcagcactttgggaggtcaaggcaggagaatcacacaaggccaggagtttgagagcagcctgggcaacacagcaagactccattgctacaaaaaagaaaaaacaaatagccaggcctggtggcatgcacctgtagtcctatctactcagggggttgatgtgggaggatcgcttgagcccaggagattgaggctgcagtgagccatgattgcaccactgcactccagctgggcgacagacagagactccatctctaaaacaataataataatttattawtgttgttactagggctgaatcttgacctgagataactagaaatgatcctttttagagctttccaagggtaggtactctataccttctcttagtagtctgttcaaagtttaactgctaacataaacaacaatttcaagtaaaaatgttcaagtccaagttcaaatattgtttgagcacctacagtgagccttctgggagtctatgatctagtgggcaaatttcctgctttagctcattgagctgtttgttgagaggagacagttggtccctcgtcatcatccttcctatacatacaacctt

SEQ ID NO: 29407 - DNA, 601 bp, Human
aatccatcctgtcgggttttcagagcatgaaatgtaaaaacaaaaactacagactcagatacatttagattcgaatcctgatgctgctgcccagtttgtagtaagtccctttcattctgtaggcctcagtttcccgatatatggaatagggacattaatatgaactttgaggggttgttgtgaagattgaatcagacatgcacgtaaagctctgagctctctgcttggcatatagtgggggttagaagttgtgtttcatgattttggtagagaagcttattttgtttttattaaatttttwaaattatgtaggtagttcaggaaaaacattctcactgtaaataaaaccgatactaaagataaggctaaggacatgtcaaatgttgatgttcttcctttagaggaaagactgtcgggtgtgtaactttccaaaatttttctattcacttgcataccaaatgttcatctcaaaagagttttatcttataaaatagtagcatgatgtaatactagtttgcttttcccaagcgttttgctatgttggcacacacagaaccaccatgtggccctgtggcgatgtaaatatatctctcctgttctc

SEQ ID NO: 29408 - DNA, 601 bp, Human
aagcgttttgctatgttggcacacacagaaccaccatgtggccctgtggcgatgtaaatatatctctcctgttctcttccaggcagagctgttggaagcgctcctcaactattacatccttaacaccttctaccccaagttcaatggtaagaatcactgtggatttttccaagtcaaaagtgaacactgctgtctggaggaaagagagttggacttggaaaacagggctctcctgggggctgtatgaccgtgggcaagtcacttctctctgagcttagtgacctgcctgtgacatgggatygttgaagttggcctcatctccctccagggctctaatgagggttgggggctgggacagctctttggagcacgggaaacctccttataagcgggacagagggacacatggaagtgccccacatcctgaagaggcaggtcaaagactgaggaccaagttaatatagaaggcacaaggcagccgcctctgaactcacatctcccagtcaattgcccaactgcctagtcaaaaaagaaagcaaaaaacttaaatcctgtttccatgaagctttgcttcttttggctgcaacagagaacaggacgg

SEQ ID NO: 29409 - DNA, 601 bp, Human
gccaacactatatatgtttacaaaaattattcataaacctattgctccactacaagcacagtttgaattttggtgtacttctagtgctttttgttttaagggtttttttttttaagtttgtttgttttgcacagttgcattactagtgctcatacctgttttctttctttccctttttttttaaaacttaaaacaaatttttttttaggccaggagcggtggttcatgcctgtaaccccagcactttgggaggccaaggcgggcagatcatgaggtcaaaagtttgagaccagcctggccracatggtgaaaccccatctctactaaaaatacaaaaattagctgggcatggtggtgcgcacctgtaatcccagctacttaggaggctgaggcaggagaatggcttgaacacgggaggcagaggttgcagtgagctgagatcatgccactgcactccagcctgggcgacagagcaagactccatctcaaaagaaaaaaaaaattaacttaaggttctttttaaagcttaacttaaaaactattttaatatcaagtgaaatagtgaaaaactattttcattattcaaactattattctgacc

SEQ ID NO: 29410 - DNA, 601 bp, Human
tttggtgtacttctagtgctttttgttttaagggtttttttttttaagtttgtttgttttgcacagttgcattactagtgctcatacctgttttctttctttccctttttttttaaaacttaaaacaaatttttttttaggccaggagcggtggttcatgcctgtaaccccagcactttgggaggccaaggcgggcagatcatgaggtcaaaagtttgagaccagcctggccaacatggtgaaaccccatctctactaaaaatacaaaaattagctgggcatggtggtgcgcacctgtaaycccagctacttaggaggctgaggcaggagaatggcttgaacacgggaggcagaggttgcagtgagctgagatcatgccactgcactccagcctgggcgacagagcaagactccatctcaaaagaaaaaaaaaattaacttaaggttctttttaaagcttaacttaaaaactattttaatatcaagtgaaatagtgaaaaactattttcattattcaaactattattctgaccaagcattttgtggtctatctgtgcttccaattttcaggttatcttttgaggtgagatgaactgggttg

SEQ ID NO: 29411 - DNA, 601 bp, Human
tctagtgctttttgttttaagggtttttttttttaagtttgtttgttttgcacagttgcattactagtgctcatacctgttttctttctttccctttttttttaaaacttaaaacaaatttttttttaggccaggagcggtggttcatgcctgtaaccccagcactttgggaggccaaggcgggcagatcatgaggtcaaaagtttgagaccagcctggccaacatggtgaaaccccatctctactaaaaatacaaaaattagctgggcatggtggtgcgcacctgtaatcccagctactyaggaggctgaggcaggagaatggcttgaacacgggaggcagaggttgcagtgagctgagatcatgccactgcactccagcctgggcgacagagcaagactccatctcaaaagaaaaaaaaaattaacttaaggttctttttaaagcttaacttaaaaactattttaatatcaagtgaaatagtgaaaaactattttcattattcaaactattattctgaccaagcattttgtggtctatctgtgcttccaattttcaggttatcttttgaggtgagatgaactgggttggcggactcatt

SEQ ID NO: 29412 - DNA, 601 bp, Human
gccgggcagggcaagttctggagggccggtgggggcatacactgaaggctgtgtgacgtttctatttctcaaggcaggtgagtggaatagggaccacagcgggccccaagttcccccatcaaggcacgcatcagattgtgtggtcagcgtggggtgacgtaactgtctgcatgcagctggtctggagcccggaggctgtgactcccctccgcccgcctccgggcaaagtgcgcggaggagccggcacggcgaggctgaagttagagaggcccgcgcgagagtgggggggaggtcgggaaarccgggcgccggcagtccttagcccgaggagctgcgccgaggccccctccgccgtgcagccaagcgcgggcgctgcttagtggggctggggacgccagcccgccctgcgcccccacgccccctcgtcccgcccacttgccgggggtggctggagctcccgggggcatcgttctgaccctgatggggcgggaaggacttggcctagagcgggacgtcccccaacactctgcagtgcggacgcggcgcacacaggtgcccggggagccgcggcgccccgaaaggacagggcctggcaagatca

SEQ ID NO: 29413 - DNA, 601 bp, Human
gaacatgtcctgtccccacagcaccggcctaggactgttcaccagcgagtgggcagagtgtctttgccccagtctggtccacgccatggagaggcctggaaaaacccaacaggctgctgttccctgcccccatccctgagggggttagaaaaggaaagaatgttcaaagtaaacaagtcaccagagggccatgccaggaccttgcaacaaacacaaggtgctcagtaagtgctgagtcctgggatgaagaattctgaagcgggaccactaccagggcctgccccctgcccacagccctccyaggccgggcagggcaagttctggagggccggtgggggcatacactgaaggctgtgtgacgtttctatttctcaaggcaggtgagtggaatagggaccacagcgggccccaagttcccccatcaaggcacgcatcagattgtgtggtcagcgtggggtgacgtaactgtctgcatgcagctggtctggagcccggaggctgtgactcccctccgcccgcctccgggcaaagtgcgcggaggagccggcacggcgaggctgaagttagagaggcccgcgcgagagtgggggggaggtcggga

SEQ ID NO: 29414 - DNA, 601 bp, Human
agggccatcctatcccgtggctcatggggccccgcctccccgaacatgtcctgtccccacagcaccggcctaggactgttcaccagcgagtgggcagagtgtctttgccccagtctggtccacgccatggagaggcctggaaaaacccaacaggctgctgttccctgcccccatccctgagggggttagaaaaggaaagaatgttcaaagtaaacaagtcaccagagggccatgccaggaccttgcaacaaacacaaggtgctcagtaagtgctgagtcctgggatgaagaattctgaagygggaccactaccagggcctgccccctgcccacagccctcccaggccgggcagggcaagttctggagggccggtgggggcatacactgaaggctgtgtgacgtttctatttctcaaggcaggtgagtggaatagggaccacagcgggccccaagttcccccatcaaggcacgcatcagattgtgtggtcagcgtggggtgacgtaactgtctgcatgcagctggtctggagcccggaggctgtgactcccctccgcccgcctccgggcaaagtgcgcggaggagccggcacggcgaggctg

SEQ ID NO: 29415 - DNA, 601 bp, Human
gagtggagggcattgcccgggcaaggtcagggttgggggaggagcagtatcccttcctttccaaggcgcttccaagccactgacctgtttattacctgacttgctttccccacttccctgaaggcaggagagaccctttgttctctctttataagaccatgtctaaaaggcccagcgaggtgtggcaacttcccaaggacacacagccggaggagccccctgcctattgctccaaagtgctcacacactggggcagggccaggtcgctggggtcccgcacaccggtcaagtcctgcagtgygacagctcctctctaacctaggaacaagtgtccatgcagccccagggccatcctatcccgtggctcatggggccccgcctccccgaacatgtcctgtccccacagcaccggcctaggactgttcaccagcgagtgggcagagtgtctttgccccagtctggtccacgccatggagaggcctggaaaaacccaacaggctgctgttccctgcccccatccctgagggggttagaaaaggaaagaatgttcaaagtaaacaagtcaccagagggccatgccaggaccttgcaacaaacacaa

SEQ ID NO: 29416 - DNA, 601 bp, Human
tgccattgtcccttaggggctgaactctcaatggctccctgcttcaggctccagctgtgtccggacaactagccccactttgtgcctcagtcttccatgtgtaccacgaggctgtggagcagatgccccaggatggcctctgagccccgagtggccagcaaatgccctgaccatgcacccctgctggtgaagggcacttccagcccatccggccatctgcttcctgtccaacctgcagctagggaagcttctgcatgcaggtcaagccctggctcaccacagcccagcccgtggccctgaygcaagctccccctccgttggcctcagtctccccctccgtatatctagggttgcacctgggaaactcctgcttaccaagggagaggctgtgttcctctcccattctacagaccagcagattgcagctcagaggaggttttcccagagccacctcccaggactgtgtgtcccaaagcatagggctgccccaggatacagcatagctggcaaccaccccaggcagcaggccacattgggagcatcatgtggaggggagggcagcagggacagtctgcttccctgtccctaaccttggtactct

SEQ ID NO: 29417 - DNA, 601 bp, Human
cacctgcttggaggcagctgtgagaacccactgctggcagccaacctcctggggccctctctgggagatcctgtttccagactcatgaaagatgcaggccgggaggccggggtgccgcagggccacagggaggggtggacatggtatccatccaggcctcgactttctgcaggctggaaaaatacacgaggcagccaatacagaaccagcagagggcaggggccttgctttcatgctgcgtgtttttcagtttcatctaaaattatgtgcccaggaggaagagagtgggcgtcaggggacrctggtgggctctgctgcttacacctgggcctgggaattccaacaacctgccttcagcatcagctgctctctaagtagcaagttcacgtggacacatgtgcgcacagggacagccgcctttacctgggccacccagcagcgctgtccctggggccctggtgtgctctcgggtcactccatgcataccccgaagcctctatggggtgtctactttgcctctcccaccctgggcctgacgctgcactccctgggattcccccaggccccagcacagccagggcactcaccaagtgagaggctg

SEQ ID NO: 29418 - DNA, 601 bp, Human
accaaacttcctctttctctggagcaagagtctgcccctctcaagctgccctggtggggccctcttcagtcactcaggacaaacctgccagccccttggcccggccctttgtccacaggcgcccctgagttgccaggccctagaccacagcctcccaggactggtcacctgcttggaggcagctgtgagaacccactgctggcagccaacctcctggggccctctctgggagatcctgtttccagactcatgaaagatgcaggccgggaggccggggtgccgcagggccacagggaggggyggacatggtatccatccaggcctcgactttctgcaggctggaaaaatacacgaggcagccaatacagaaccagcagagggcaggggccttgctttcatgctgcgtgtttttcagtttcatctaaaattatgtgcccaggaggaagagagtgggcgtcaggggacactggtgggctctgctgcttacacctgggcctgggaattccaacaacctgccttcagcatcagctgctctctaagtagcaagttcacgtggacacatgtgcgcacagggacagccgcctttacctgggccacccag

SEQ ID NO: 29419 - DNA, 601 bp, Human
cggggctgctcctccctgcctgcccctaccggtctgtgcccccggcctcctctccccctcccctcagagtctgagctcctgatgccaggaaaggaagtgacgtgtgggcggacagatctgtgcacaccggcccaggcaagaagcaagtcctcctgggccggacctaagggcagagatcgcccctgccacctcccaacctcccagccttggggcccaacaggccactcgcctccaggcctcagcacaggccttgcagaactattcggccattagcagcaagacttcactgaggtgggccacycagagcccggccccgacacagcagaggctcaacagatgcctcagcatacgacatacagtggagcttagcttccacattacttcccagagtaataaaatgggaatgcgagttctgatggaatcctctttgccttaggggcctatctggtcagggccccctgcagttctctcgaagcccccaatgcctttccctggtgccagacactctcaagctccaaggccccacacagaggccactgcttccaggaagcctcccaggacttcccctggcaggacatggccctctctcctgccacaggaa

SEQ ID NO: 29420 - DNA, 601 bp, Human
catgcctgtaatcccagtattttgggagactgaggctgttggatcacttgagctcaaaaattcgactgggcaacatggcgtaacctcatctctacaaaaaatacaaaaattagccgggcatggtgatgagcgcctgtaatcccagttactttgggggctgaggtgggaggatcgcttgagcccaggagatgcagcttgcagtgagccgagactgcgccactgcattccagcctgggtgacagagggggaccttgtttcaaaaaacaaaacaaaacaaaacaaaaaccaaagtgcagggtgkggggagggggggtgccacttcctggactgcatgtctgggtgatgagggccaggaactcggcagctccttgagagccaagtgtgcaaggtggtgggcacctgtcccaggcgatgcgagcagatgccagcaaggtgagcaggtggcctggctgcccccacctggggacctaccaaggaagatgagcagcacccccacgccgatctgcagcacaagggagatggagatgaggaccaccaggggcacatagaaggcgaagctggggccctgttccacgacggccttcagctgggacgcgttggc

SEQ ID NO: 29421 - DNA, 601 bp, Human
aaagtgcagggtggggccaggcacagtggttcatacctgtaatcccagcactttgggaggccgagacaggaggatcacgtgagcccaggagtttgagaccagcctgggcagcatagcaagaccccgtgtctaccaaaaataaaaaaattagctggcatgatggcatatagctgtggtccagcctacctgggaggctgaggcagaaggctcgcttgagcctgggaggttgagactgcagtgagctgtgatcaagacacagcaagacccggtttcaaaaacaaaacaaaacaaaacaaaacaaggctgagcgtggtgactcatgcctgtaatcccagtattttgggagactgaggctgttggatcacttgagctcaaaaattcgactgggcaacatggcgtaacctcatctctacaaaaaatacaaaaattagccgggcatggtgatgagcgcctgtaatcccagttactttgggggctgaggtgggaggatcgcttgagcccaggagatgcagcttgcagtgagccgagactgcgccactgcattccagcctgggtgacagagggggaccttgtttcaaaaaacaaaacaaaacaaaacaaa

SEQ ID NO: 29422 - DNA, 601 bp, Human
cccagaaatcttttttttttttatcggacagacattctgaatgtatagaaatcttacgtttaagtgagttctccaggatgttcaaatggtggctcctacacacattccatctaaacactgtgaccacaggaccccaggtggccagcaccagtggcagggctggcctcaaggcagtggccaggcattggccttgtaggtgtggacgaggatgcccatggcctaggaaggtgtccaaggctggccggccagggactcaccacactgcaagagcctccaacagcgagcaaccccaggactgcargcctcgcgccccatctcccagctcacctgggtgtcctactgctggggtgccatgtccatcaagggcttctggaccccgaaggccgtgatgaagatgttgactaccacgatgatgaacaccaggcccgtggccaggttgttgaggaagtccagcttggcgtgcttggccgggttgttaaggtcgtacttgactgtgggcgagagaggagtggatggtgccaagggcagcccagacgcagcgccccagcctgggacagtggaaggggacccaccccagcggtcaagctgtcctgggacatta

SEQ ID NO: 29423 - DNA, 601 bp, Human
ctgggaggaagcttcacctgctaagtggagctgataaggggtgcagagcccctgacttatcaagagaagccggaaatctttgggttttgggtgttttttgagacagagtctcactctgtcgctcaggctggagtgcagtagtacgatcttagctcactgcaacctctgcctcctgggttcaagcgattctcctgcctcagcctcctgagtagctgggactacagggatgtgccaccatgcctggccactttttgtatttttagtagagacggggtttcaccctgttggcgaggctggtctygaactcctgacctcaagtgatctgcccgcctcagcctcccaaagtgctgggattaccggcatgagccaccgcgcctgacccagaaatcttttttttttttatcggacagacattctgaatgtatagaaatcttacgtttaagtgagttctccaggatgttcaaatggtggctcctacacacattccatctaaacactgtgaccacaggaccccaggtggccagcaccagtggcagggctggcctcaaggcagtggccaggcattggccttgtaggtgtggacgaggatgcccatggccta

SEQ ID NO: 29424 - DNA, 601 bp, Human
gctgggaggaagcttcacctgctaagtggagctgataaggggtgcagagcccctgacttatcaagagaagccggaaatctttgggttttgggtgttttttgagacagagtctcactctgtcgctcaggctggagtgcagtagtacgatcttagctcactgcaacctctgcctcctgggttcaagcgattctcctgcctcagcctcctgagtagctgggactacagggatgtgccaccatgcctggccactttttgtatttttagtagagacggggtttcaccctgttggcgaggctggtcycgaactcctgacctcaagtgatctgcccgcctcagcctcccaaagtgctgggattaccggcatgagccaccgcgcctgacccagaaatcttttttttttttatcggacagacattctgaatgtatagaaatcttacgtttaagtgagttctccaggatgttcaaatggtggctcctacacacattccatctaaacactgtgaccacaggaccccaggtggccagcaccagtggcagggctggcctcaaggcagtggccaggcattggccttgtaggtgtggacgaggatgcccatggcct

SEQ ID NO: 29425 - DNA, 601 bp, Human
agacacggtatctccatgttggtcaggctggtctcaagctcccgacctcaggtgatccgcttgcctcagccacccaaagtgctgggattacaggtgtgagccaccgtgcctggcctggggaaatttttatatatccttgacacacaggcgctctgccccaagagcactgctcctgtctactctgccatgggccaccactggtggagagatggccacctgccaggagtgcccacccctcccttagcaactcacctccacctctgctacaaaccggaggggtgacccctaggcctaaggtcgyggggactgtggtgtgtggccctggcctggctgcatggactgtagtgtgtgcaccatgtggccctggccatggctgcatcccaggccttcctgtggatcctgctcccaggctgtgtcactgggcagacgctcaccctctctgagcaaggacacagggagaggctgtatgtggtgtgagaagtcttcctacactgggtgcctcgtcctgtagagacagcctcagtctgcatcctgcacacagccagggtccagcctaaggcaggcagctaacagattctgcgaggcccggcaaggggcagac

SEQ ID NO: 29426 - DNA, 601 bp, Human
cttgagaggccatgggccactacgagcagcggtcactcgttggcccccgtgtggggaggggtgaggccaggtggatgcagggtgctcccaacccagctgctggccccagcgccccacctcatcctcactatgccctcttggggaattttttttttttcccgagatggagtctcatactgttgcccaggctggagtgcaatggcgtgatctcagttcactgcaatctccaccttccaggttcaagcgattctcctgcctcaccctcctgagtagctgggattacaggcatgcgccatcacgyctggctaattttgtatttttagcagagacacggtatctccatgttggtcaggctggtctcaagctcccgacctcaggtgatccgcttgcctcagccacccaaagtgctgggattacaggtgtgagccaccgtgcctggcctggggaaatttttatatatccttgacacacaggcgctctgccccaagagcactgctcctgtctactctgccatgggccaccactggtggagagatggccacctgccaggagtgcccacccctcccttagcaactcacctccacctctgctacaaaccgga

SEQ ID NO: 29427 - DNA, 601 bp, Human
tgggctctggcagtctgggtagtgccatgtgcagggaggtggacacctcacaggtatggcgactcctggggtcgggcagctgagttgcagggcaggcagcatccagggtcctggaaaggagacagaggagaggctctgagcctggaaggagggagaggagaggctctgagcctggaaggagggagaggagagggtctgagcctggaaggagggagaggagagggtctgagcctggaaggagggagaggagagggtctgagcctggaaggaggaagaggagagggtctgagcctgggaaggrgggagaggagaggctctgagcctggaaggagggagaggagagggtctgagcctgggaaggagggagaggagaggctctgagccaggctgtgacaagccccgagtgtcagggccatttgcacacccggactcaggaaggagaagagcctgattctgacatgagaggtgtcaaagtactccatgcctcagtttcccctctgaaaatggaatgaatatagcatggctgggttactgccaggacttagaggcctggcccagcatggggggctcgggttgggcagctgtgaccatagccacccac

SEQ ID NO: 29428 - DNA, 601 bp, Human
aagattctggagaaggcggccctggccagaaccgtgtgcttctgacgcccctgcagggcagctggaaaggggacagggaagccaaggccggtccagccccgggaacagggagatggcatgtggagcctgacaaagagcgtgggctttattgttcattcatgattagaaaagtgggtgctgggacccccgtggagggggttgggctctgcccggtcactgctggtgcagggtatatacaaggtctacggccctcacaggcctgactggctccctcttgatggccaccaagcccaggcacttwagaccagagccagtggccatccgtagggccaaaggcagttctggctgtgcagggtccctgggttaggaagtggacagaggctggggtcaccagggcaacccggacagggcccacgggaggcagggacgctggtgctttgggagagggagagacatctccttgtccttctggaatgtcctgagacagaggctggccctggtcactcatccagcccatccacggacctgctgtgtgtccttgagtgggtcgagacccttctctgggcacaggtctctgcagctgtccagttctgaccctctg

SEQ ID NO: 29429 - DNA, 601 bp, Human
aggggctgctgatgccagtgacctcagacttccacctctgtgcctccaaacctcaccccaggagatgtcaggagccaaagagctccccaagccaagattctggagaaggcggccctggccagaaccgtgtgcttctgacgcccctgcagggcagctggaaaggggacagggaagccaaggccggtccagccccgggaacagggagatggcatgtggagcctgacaaagagcgtgggctttattgttcattcatgattagaaaagtgggtgctgggacccccgtggagggggttgggctctscccggtcactgctggtgcagggtatatacaaggtctacggccctcacaggcctgactggctccctcttgatggccaccaagcccaggcacttaagaccagagccagtggccatccgtagggccaaaggcagttctggctgtgcagggtccctgggttaggaagtggacagaggctggggtcaccagggcaacccggacagggcccacgggaggcagggacgctggtgctttgggagagggagagacatctccttgtccttctggaatgtcctgagacagaggctggccctggtcactcat

SEQ ID NO: 29430 - DNA, 601 bp, Human
taacatcttttaaattcacattttcttttaacaagtccaggcaaagtatcgtcctttcaaattaatcacggcagtgtccaaaatcatggctgagaaaaaagactgtcaggattacacagggaaagttataaccaaattatattcccacgagcagtctaagagagaatttattacattcttgacaactctgggctttcataatttaagaattatggagttttattatatgttttatatttatttattttattttttgagatggagtctcactttgtcacccaagctggagtgccgtgatacratcttggctcactgcaacctctgtctctctcaggttcaagtgattctcctgcctcagcctctcaagtagctgggactgggactacaggcatgcaatgccatccccggctaatttttgtatttttagtagagatggggtttcaccatgttggccaggctggtctcgaactccctacctcaggtgatccacccaccttggcctcctaaagtgctgggattacaggtaggagccaacttgcccggcttttgttttatatttaaatttaaatcagttcatgcttacagtgattatctctagaaa

SEQ ID NO: 29431 - DNA, 601 bp, Human
ctgattttgattttttttttttttttttttgagacggagtttcgctcttgttgcccagtgcaatggcgtgatctcggctcaccgcaacctccgccttccgggttcaagcaattctcctgcctgagcctcctgagtagctgggtttacagacatgtgccaccatgcctggctaattttgtatttttagtagagacagggtttctccatgttggccaggctggtcttgaactcccaacctcaggtgatccgcccgccttggcctcccaaagtgctgggattacaggcatgagccacctcaccyggcctgatgagaaggtttctaatgtttagctgatagtacaactggcgtttctttatccacttaatattattattttataaaataactgagttttgaatcataaatataggaattttttttccaaatgactttggtctgattttatttttctgtgcgtgccacgtctggtttggcattgaggttatactaggcatacggtgtgagttttgaactctccatcttttcccaagttctagaacacagaaattatatgttccttaaaggtttggtagaattagcctataaaactatttacacctg

SEQ ID NO: 29432 - DNA, 601 bp, Human
ggtattctgaatcagagagaataacgtaagttttaacaagcattttctttctgattttgattttttttttttttttttttgagacggagtttcgctcttgttgcccagtgcaatggcgtgatctcggctcaccgcaacctccgccttccgggttcaagcaattctcctgcctgagcctcctgagtagctgggtttacagacatgtgccaccatgcctggctaattttgtatttttagtagagacagggtttctccatgttggccaggctggtcttgaactcccaacctcaggtgatccgcycgccttggcctcccaaagtgctgggattacaggcatgagccacctcacctggcctgatgagaaggtttctaatgtttagctgatagtacaactggcgtttctttatccacttaatattattattttataaaataactgagttttgaatcataaatataggaattttttttccaaatgactttggtctgattttatttttctgtgcgtgccacgtctggtttggcattgaggttatactaggcatacggtgtgagttttgaactctccatcttttcccaagttctagaacacagaaattat

SEQ ID NO: 29433 - DNA, 601 bp, Human
aataagcgcaaaaggagatgaagcagttagttaccttttttgcttgaacagtccaaaggaaaatggttactataaatacagcaggcaaactgttagactgacctagaacatagtgtactaaatttcagtctcaaattgtgctaaatgctcatcattagtatggcacatttggtccatgatgtggtttaatgccaagacagatcccaatttgttacagaaacacatagattactgttgctttttgtttttaaatacatatattttaaaaagccaggtatacttccacatacaaaggcaggtktcccaggagaaatttataggaagtagtctggggtgcgccgtgtaacatgaggctcaccacgacgaggcgctgggtcaaattgaaggctgtaaatggcaaaaaaggaagcaaataaaggatctgactttgcaaagaaaacaaatgaataaagaacaagacactgtagtagaaacagcagtcctgctttcccaccatgactacatcacttacggctggaatggccatgggcaaatcactgcagatgctcccattccaactaactgcttcatagggctatggtgaaaatttaagaagacagaa

SEQ ID NO: 29434 - DNA, 601 bp, Human
tacttgaagcagacttggtaatagagtcagccttatgtagaactgtgaagtaagccaaaatccaatcccagcaccttcctgcttcctctcccctacacacctgcccttgctcagtcaggtcctggcaggaagcataccacatactctaaaggaaccttgaagaaggtttgccaaggtgcgggcagccttaaaggaacctacaaacgatggtaaggcctcaaagccctaacagtaagaaactattttgttaacacccttagctatgaaggagcaaagggaacccagaaagagctatagcctygggagggaagggcctcaggagccctaaatggaggaagggagctgccacaaaatctgtcaaagagagctctgggagaatatagactccctctgccctgtgatctgtcagtgcatgtcactagacaaacctaataggagtaggaagccagagggcaagagaacccatgtgttgtggtccatagaggcctggatcccagggcatagacagagtggagagtgaatctagaatgacaaaggaaagatatctcagcataggctctagatgccccatctgctcagcattcccccactgtttagtccc

SEQ ID NO: 29435 - DNA, 601 bp, Human
tgcaggtcatctctccattggctaccaaagagttgcagaagctttagcaattcagtgccaaaaccccattccccagaacgcctttgggaggcttttctggagaacaaaattccataggctgaccatggcttttgattcagaacatttggttcctagacacatggcacaataaccaaaatgaccactgctaaacaataccttagttagccagaaagctaatgataaaagtcatttccagtcttactttgattattcctagtagcagggtttttaataatataatggctgagtgaagaacccyattggctgacaagaggataaatgagtcaagtttggactcccctgaaaatatgaactacatgggccacacttagggaggaccatatattcttttcaagctgtaaaatccactaacatttttgtttttccatttgttgcttggttcaatgcaatctttaccttacacacaatgaaacagaatttaaggagcaaacttattacttggaaaattttgcaagtgactattactttctttgcaggaacatgttccctccaaatctggtagaagcctgctttaaacaggtaaacactctacagacat

SEQ ID NO: 29436 - DNA, 601 bp, Human
ccagaagaagggtgtttccagtaaagggaaaagcaaacggagaggccccctaggccatcaggaaaactgagggctcctcatctgtttcagccctaagaaagaaatgtaaatggcagttctgctgcaatatctaaaagattcacaggaagtattacaaaatgccaagccacaatttataacaaaatttgctttaataaagttgacagcaggagacaaaggaagagactataaatgcaagaggaacattgaccttggaaagtaaactttacccaacggggagagaacgctttgattgacctargctttgtgtggaggttgcttctctttcattctttatttttaatccagtctcctctgtggtacctgaggcaggaaagcatccattgctaagaaaagcactcagtcaccaacatgattaaaaatgcccttgtctttaatgccaacaaagcccagagaaatccatttttcaggaatttgtacaagatggatatgaacttgggcacaaagacagatcagaatgtggtctccacaggagcccccacttggaaggctcctttgaaaccctggcaggaataaaagtggacatttatcttcatattat

SEQ ID NO: 29437 - DNA, 601 bp, Human
acctgaggcaggaaagcatccattgctaagaaaagcactcagtcaccaacatgattaaaaatgcccttgtctttaatgccaacaaagcccagagaaatccatttttcaggaatttgtacaagatggatatgaacttgggcacaaagacagatcagaatgtggtctccacaggagcccccacttggaaggctcctttgaaaccctggcaggaataaaagtggacatttatcttcatattattaaatgcctccacctttcacctcttttatgaaagaagcccattcaaggccactgaatgaayctcacatgcagcttgtctagctgtacattcgcctgcacattcaacgctgagttattatatttctgaaaacaggtattcctatgatttcctggcctgggttcttaaaggacttttgaaagaagcattgtatttttcgatttgaaacaagtcctccatagttcccaggagacccttcttcttaagtgtgattggcttctctgtgtttggtaatgtgagtttggttgtagtttgctgcacatatgaaacaaacagaagggaaatccaggcagcgaggcctttaagcaaactctaggttatttc

SEQ ID NO: 29438 - DNA, 601 bp, Human
gactgtcattgttggcttactcattcacgcagtcatcgtcttgccactcctctacttcttggtaacacggaaaaacccttgggtttttattggagggttgctgcaagcactcatcaccgctctggggacctcttcaaggtatgtatgtatgtgtggaaaatgagtctgaaatgttaccttgaaccagggcccctcaagtagggtgtaggagaagccattttattctgagttttaaacttccaagaatgatgagttagctttctcatttctgatgtcaatcacacctgtttgggattcaggraatgcctggctacatatcttttgtggggacaaattggaaatcaactatcctttcccgtccacttcatctctctttagttgacatttgcctgagggagaagaggcagagtgacttggcacaggctgtcgtgatgagggcatgatcacaagtgatgcctcacagaggaacccagaagcaggagagctgccaaatgaccccgtgaggggaccacactgttcttaacctgctcccctatttatacaattgctgacttagttccctttaagttagaacatgggagaggaaggaactgtctgtccc

SEQ ID NO: 29439 - DNA, 601 bp, Human
aactgtctgtcccaaagaccaaacgcacagacagtcagaactaccaggacactcagctgatgtgccctatttcactgttctcagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcaggtacaaggaaagagttctatayaccctttcttaagaatgcctttaaggctgggcgtggtggctcacgcctgtaatcctaacactttgggaggccaaggcgggtggatctcctgaggccaggagttcaagactagcctggcaacatagtgaaaccctgtctccactaaaaatacaaaaattagccaggcctggtggcacgggcctgtggtcccagctacttgggaggctgaagcaggagaattgcttgaacccggaggcagagattgcagggagctgagatcatgccactgcactccagcctgggggacacagcaagactcca

SEQ ID NO: 29440 - DNA, 601 bp, Human
ctttcttaagaatgcctttaaggctgggcgtggtggctcacgcctgtaatcctaacactttgggaggccaaggcgggtggatctcctgaggccaggagttcaagactagcctggcaacatagtgaaaccctgtctccactaaaaatacaaaaattagccaggcctggtggcacgggcctgtggtcccagctacttgggaggctgaagcaggagaattgcttgaacccggaggcagagattgcagggagctgagatcatgccactgcactccagcctgggggacacagcaagactccatctsaaaaaaaaaaaaaaaagaatgcctttaaaagacaagaggatgaccagggttgggaaggggatcccacataatcaagaggtggggatttggggtaatcattctatatttaggtattttaattggtttttttagattatagatgtatacactcattaataacaaggttcaaaaaatataaatatgtataaagtaaaaagggaaacttgcctgccatcacatcgctccacatccttctgtaagtgaccattgttcatgtttggtttggaaagacttttcctatgcatagacatgcacacactt

SEQ ID NO: 29441 - DNA, 601 bp, Human
ctaaaagtcccagtatcttagaaggggaccagtatggggaccatgaatactttctgtgacagacttaatactttattaataccacttataaccagataatactttactatttataaaacatttgctttgcaagccaggtctacactgccttcataaaaagtatttctaatactataaaactttgttcataaatcattttgcttttgaattaactaagcaaaccaaactaagaaaccaaatttgattcttttgacaacattaatcatgaatgttcagtaactttacaaccctccacttggayaggggaattattagaaacaaattattattgtaactctacagcattttagactttgccttacaaaatactttcagggatgtttaaaagtgtatagctgccagtttatttaaaaacgactagaataataggtccaacttcacaagggtcattgtacgaggaccaaattagataaaccatgcttagtatatcagaagacacatagtaagcacatgataaatattagttagcatgatgattagttcaatttttttttttttaatctcatttacgggccaggcatgatggctcatgccggtaatc

SEQ ID NO: 29442 - DNA, 601 bp, Human
agtatcttagaaggggaccagtatggggaccatgaatactttctgtgacagacttaatactttattaataccacttataaccagataatactttactatttataaaacatttgctttgcaagccaggtctacactgccttcataaaaagtatttctaatactataaaactttgttcataaatcattttgcttttgaattaactaagcaaaccaaactaagaaaccaaatttgattcttttgacaacattaatcatgaatgttcagtaactttacaaccctccacttggataggggaattaytagaaacaaattattattgtaactctacagcattttagactttgccttacaaaatactttcagggatgtttaaaagtgtatagctgccagtttatttaaaaacgactagaataataggtccaacttcacaagggtcattgtacgaggaccaaattagataaaccatgcttagtatatcagaagacacatagtaagcacatgataaatattagttagcatgatgattagttcaatttttttttttttaatctcatttacgggccaggcatgatggctcatgccggtaatcccagcactttg

SEQ ID NO: 29443 - DNA, 601 bp, Human
tcttttgacaacattaatcatgaatgttcagtaactttacaaccctccacttggataggggaattattagaaacaaattattattgtaactctacagcattttagactttgccttacaaaatactttcagggatgtttaaaagtgtatagctgccagtttatttaaaaacgactagaataataggtccaacttcacaagggtcattgtacgaggaccaaattagataaaccatgcttagtatatcagaagacacatagtaagcacatgataaatattagttagcatgatgattagttcaatttttttttttttaatctcatttacgggccaggcatgatggctcatgccggtaatcccagcactttgggaggccaaggtgggtggatcacttgaggtcaagagttcgagactaacctggctaacatggtgaaatcctgctctactaaaaacacgaatattagtcgagtgtgggggcatgaagctgtattcccagctactcaggggactgaggcacgagaatcacttgaacccaggaggaagaggtttcagtgagcctagtttgcaccactgcactccagcctgggcaacagagtgagatac

SEQ ID NO: 29444 - DNA, 601 bp, Human
taggtccaacttcacaagggtcattgtacgaggaccaaattagataaaccatgcttagtatatcagaagacacatagtaagcacatgataaatattagttagcatgatgattagttcaatttttttttttttaatctcatttacgggccaggcatgatggctcatgccggtaatcccagcactttgggaggccaaggtgggtggatcacttgaggtcaagagttcgagactaacctggctaacatggtgaaatcctgctctactaaaaacacgaatattagtcgagtgtgggggcatgaasctgtattcccagctactcaggggactgaggcacgagaatcacttgaacccaggaggaagaggtttcagtgagcctagtttgcaccactgcactccagcctgggcaacagagtgagatactgtttcaaaaaaaaaaaaaatctcatttacgttttttctgaagcgcgtcctcttgtgttacatggcaagtcaggcatcggcaccgtgcgtattttgcagcgtatatgctctacgtggggagctttgtaaaagtgttttctgttctggtacttctgttaacagcatcacagccacagctgcc

SEQ ID NO: 29445 - DNA, 601 bp, Human
ctggtccttatctggagaccgagccccagatgccatgtgcactcactcccctgtcagcctaaggggcacatctggctgccacacatctcactccataaagccattcaggaattgggaaacccgctgtctgcaaaggcaacataaatcagcaaggctgtttctgagttgcacaacatgacaccacagcagctggaacaaagctgcaggccccacatgccagcttaggccctgcctctgtgtgcttcccattccagtgggaatgattttcccatcctagcccaatagggtgaggctgagctaygccgacactgggaagagagctagtgtcattaagtggaattgagtttcggatctagggaaagttacaagaaatgtgccctccacattctcaaactctaacctctacaggcccatcccttcgcccccttccctcgctcttccagctggcattctctgtgccttttctcttaaaaatttccttccacttttgaaaatctttccccaggatgcccaaagcaaagcctagaacagagtacgtgttggagttaacacaacatatgttcactagaactgcaacatgaaaagagcttgacagtgtgcg

SEQ ID NO: 29446 - DNA, 601 bp, Human
cctcctgagtagctgggattagaggcgcccgccaccacgcctggctaatttttgtatttttagtagagacgggtttcaccatgttggccaggctggtctcgaactcctgacctcaggtgaaccacctgccttggcctcccaaagtgctgagattacaggtgtgagccacggtgcccggcctcgaccccaatatttagtgaaaagaatggtactattttatgttttgcaagttttcttaatgtctggcttaatacaagacagttggagtttcctgtttctgcagtttcacaactgcttcagkgagttgtgacatcacacatcatgtagtctttgcaaaactccactatacattcatgagaaaatgagactgagagggacaaatgacatcttagtattattatgagaatggcttaaagagaaggctcgttccccactgttgggactctcacttcagtcaaactaataactgaacattcatcatctatatggccttataacctttaatagctactattatgaatattatgtgtctattacgtaatcttgcagttggtagatacggcgaactgaatgttaagaggtgcttcgctggccagttcct

SEQ ID NO: 29447 - DNA, 601 bp, Human
aagttgaaaacttgtgatgctcacgggagcctcgtttttccctcctccccaccctgcctgcagggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccargtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaa

SEQ ID NO: 29448 - DNA, 601 bp, Human
tcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatmtacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcc

SEQ ID NO: 29449 - DNA, 601 bp, Human
gagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtyaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatt

SEQ ID NO: 29450 - DNA, 601 bp, Human
tgcagtgacaacatccactacggtgtccgttttgccaaggccttcgtggatgccaaggagaagaggcttaaggatgcccgggccctcatgaacttacataataaccgctgtggtcgcacggtcagtactcatgtctgtgtaagtacactcatatttgctgggggtgaccagtgtgtgtgaccatggactaaataaatgtgaagatggaagagctgaaggcttctgggtcacttccaaaagccccaacatcctgggacaggagaactaaatgcaagggagcttaggaatgcctagggtcaawcaggtgcgtgaagagtcttcacataggtggaaagtaggaaaaggtggagaaaagaagtaactttttaagaaggaaaagaactgccttcataaagactgagaggataagaggttgttctagtcagttccctggtatttgaacatcttctatgtgcctagtactatgctggaaaatggcacaccactaaagtagaaggcatggtacctggcactctaaaacgtgaaaagtagaggatgtgcaagcacactgtcatcgtgaacagaatcctgtggctctacagttcagtgggctgtcatgaaa

SEQ ID NO: 29451 - DNA, 601 bp, Human
ctggacagcacagctccacagtgtagaaggggtttttggtgcccaagaggacttaagacccagcccttggagttaggagactaacatatacagtagacctagtcagtccacattccagaccagtggtctcctaacattctggatcctttactcctatcattaaaacaatttgagcatatatctccattatatgtatatttatttatacctgtgttccactatatgaatatgtatattataaaacgtaaatattttaaattgatgagataaaaaacatagaagttctagcattttcctcccstatcccagtgacatttggagactaattctgtagaaatcagttaatctattctccgttttgaacctaggctagtcagtttcccatctctggattcttattaaccatggaaaagcttggagtagatgctctcatgggcccaactcatccaaaagtctattgattttatgatctgttggcaggatctcttttgctaaaatcagtcagaatgaggttctaagcattccctatgcatggggaaaacatgatccctatcctagagtttccactgtaaggggaagggataatgcttagggataatag

SEQ ID NO: 29452 - DNA, 601 bp, Human
acttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctacyattctcaacctgtattggacagcactgcctcttttgcttacttgctgcctgttcaaactgaggtggaatgcagtggttcccatgcttaacaaatcattaaaacaccctagaacactcctaggatagattaatgtagtaagtctggctaggccttgtgttgcctttttttttttttttttcttttcttttcttctcttcccatgcactattctggaggtttgccaggtttggggagacatggagtaaaagaaagataggcaactcatggatggtgggagagcaggtaagcaggtctgatct

SEQ ID NO: 29453 - DNA, 601 bp, Human
ccgccctcccaccttcctttcgcccttccaccagacctccctcgacgcccgacagctgctctgggtactgtttccgggtcagggtgacctctggggtgaggaaactgcgactgggagcgggacccaggcgtgcagcattcgccatgctccgctcacgcgtgggagactgggctgtggggtaccggcccggaaagcacgcagcctccaaagccgccttcctcagggaaatttgcgtgaccttactgccctccgtctacaggccttgtacctctccaggccgatttttccacaatttaaatcycagttcacctggtatccagctccagcaacttagagcgtttcacgtcacgccgggcgccaggcgtcggcttgtataacctgaaaacgctcctgtttttctcatctgtgcagtgggtatgatttttttttcatcaacaaatttcacgtgggtaatctgaaatgaaaccacttaagttatgaaactctttccttttgagttattctggagaccttactccgccttcggaaccgccccagtggtgtcacatacttgagggcctgactctcggttgccagacatggcacagaatgttcgatttta

SEQ ID NO: 29454 - DNA, 601 bp, Human
gtcatttgctttaggacatcatctgtagacttcagttccttctgttttgtcacacgatcatacccaagagctatgatgtctaaaatgtgtgctgaggcacctcagggctttacatgaaattcacagggatgccatagaatattttaaattttgcagtgaaacatagtgatagcatctgttgaatacctcaactcaaagtagttcacatttgcaacattaaatcctgcagtatttttttatgatggtgttctttaatgtttgagataagtttttgtttacttatatttttggtgacatctcrttgcaaagccaggattttaggttgtaattaaaagcgagtactgcaccaaaattaatgtagaactgaaaacaagaatgatggtctccagtcttattctaaggcataagaagctgtgcagtgttcaacaggcacacaaatttcattaataagttcagtgattgtggttatttaagaataaaataaaaatattactttttctttaaatgtgtattttttacaatggctactaagcagttaggatatacttaagttttttgggtgtaactaccttattcagtggaattgttaggtgtttctgtg

SEQ ID NO: 29455 - DNA, 601 bp, Human
ttcattaaatatagattacttctaggataagaaattttcttgatgtaaaaatattaaggacattcctattggcactataaatttctgttgtaaatgtatacatatttagaattgattgtatgttcagttttaaagaaaactgaccatatgttaggataagcttctctttggtgtctgaaggaaccttagaccatgtattttaaaataccagacttggctaggcatggtagctcatgcctgtaatcccaatgctttgggaggccgagggggtaggatagcttgaggccaggagttcaagacyagcctgggcaacacagcaggaccccatctctatggaaaggaaaaacacgcttgtatcataaatttcataaaggactatattacttttctattcaccctttaaacaaatatagctttgaatctgtaataaaaatagctgactttatcgttcttagttcttagttgatgctttttttttttatagattatttgaagtgaagtaaatgactaattatctctattacctgccattttttgtatgttgtgctatgtagcaggcacacactgtctagggtttttaaatatgtcacttaattaaatc

SEQ ID NO: 29456 - DNA, 601 bp, Human
aaatattaaggacattcctattggcactataaatttctgttgtaaatgtatacatatttagaattgattgtatgttcagttttaaagaaaactgaccatatgttaggataagcttctctttggtgtctgaaggaaccttagaccatgtattttaaaataccagacttggctaggcatggtagctcatgcctgtaatcccaatgctttgggaggccgagggggtaggatagcttgaggccaggagttcaagactagcctgggcaacacagcaggaccccatctctatggaaaggaaaaacasgcttgtatcataaatttcataaaggactatattacttttctattcaccctttaaacaaatatagctttgaatctgtaataaaaatagctgactttatcgttcttagttcttagttgatgctttttttttttatagattatttgaagtgaagtaaatgactaattatctctattacctgccattttttgtatgttgtgctatgtagcaggcacacactgtctagggtttttaaatatgtcacttaattaaatccaaacaaccctgcaaaagtgggtttgaatacctgcattttatagatga

SEQ ID NO: 29457 - DNA, 601 bp, Human
ttgttctgtccaagatttaaaaaacattcacaggatgtctgatttatgacttttttttaccataaattagtgagtaactgttactaaaatcaataatcataaaattgagaaagatcttgttttataagccttcaattaccatacataatagtgcttttactttgcttgttttggtggttcttgaaataaattatttcatttttgtttcagatctggcagaggacggaaattaagtggagaccaaataactttgccaactacagttgattattcatcagttcctaagcaggtaggttttttktgtgtgttcttttgttttgttttgttttgaaagattgaataagtgtcctagaacaatattttaaaaactggattgcagatcattaatagaaattaatttttgttgtgttgttaaatttatctggtctgaaaattctatttggttctacattttatcttctgtttctttgttgacattttctattgtgttttcattggtttcaagtgtttgctattgtttgttggagcatttttataatagctattttaaagccttagagaattccaacatatcattttggtgttggtatctgttgattaa

SEQ ID NO: 29458 - DNA, 601 bp, Human
tcttagccagttcttccaagaaacagccactcaataattttctgtttggatttcttcaagtgtttgtcatcgtatctatctatatggttatattgccatttcttgtttaccagtaacagacattgtccactgacattcatactatggtaaatgaagatttatttcttactaccattccctctcctttattccagtctacctcactaatcactctgctatatcagaaaaacacacttaaagttcactttcttattcaaacatagaaaatatttttatcatatatatatataaacacacacayatacacacttcataaaaattaggacattatttcacattttctaatacagttgttcctcaccttctttctctcagctgatttcagctatacatttatatttacattgtctaggttgataacatttacattctttgttgttgagttgtccaaatgtctcaatgctaaaacacattaaattgtgtatttttaaaggatcctttaagtgagtttcttaatagatgaataccttgcattgtggaagtatactgctgctctcagtaggaacctagtatattgctatagtgccttattaaattagtt

SEQ ID NO: 29459 - DNA, 601 bp, Human
accaaaaatatcttaccattcattctacaaattagattcttcttttaaactacacattttattcttttctagaattcatcattcgtattgttgtgagagttcttttataccaaagataaatgtcatgttttatacttttttagtttgttaattggtttggatatttttgttgggcaggtgtatttagtttttatgtagacaaatctatcaatggtttcccccttttcctttttactaaggccatctctactaaaggatcagataccaccctttttaatggtctctatagttttactttttaaaaaaatctaaatattttatgtactctaacagtcaaatactttagtggaagaatagataatatgaatgggaaatttacaaataagaaatagacataacctaatttgaagaaaagcttgatcttattagtgctcaaagtaggcccagtgaggtgttacatgcctgtaatctcagcactttgggaggccaaggcgggcaggtcacttgagctcaggaattcgagaccagcctaggcaacatggcgaaatcccccctctacaaaaattaaaaagttagctgggtgtggtggtgcgtgcctgta

SEQ ID NO: 29460 - DNA, 601 bp, Human
acatttgtacatatatcttaaatgatgtccatgaaagccctatgtgttagatgaactacccattctgcaaaaaaatactattctggaagttttaaagttcatttttattggttgttcttttttgtgtgtgagcagcaaacatatttcttagtactgctacattaggtcaaagagtaaagagaaaatttatcttaagggagagctagtgactgattactgctttttaaaagtcagatatttaaatgcatctaaagaattcatacattttttaaattgtgtagtaagatacagcaatataaatttttttattttaaaattgagattgtttttaccataggaatagcagacaaattattctttatctgactcaacaaaaaaactgatttcatttttgtattttcctttcttggctttgtcaataaattacagttactgtgaacaaccagcagagggtgcagctaaataactgggaattttgtttgaagtttttgtttttttcctttgaaatatatcaagccctttttttttttttttttttgcaggttaggggacgtcacatttcaaaattcagtcagtaaaattgtgagagtttttaaaattt

SEQ ID NO: 29461 - DNA, 601 bp, Human
atcccagtctgaggccattttcttctcagaggctgagggtagcaggcaccctcttcctagagcctgcccctccaccctgcagactggaaggggcacttctgaaagacttggggtgccagactcacttcaccaggatcaccttcctccctaatccatctccaaacaccctgggttttcccaccttctggaggaaactgccccctccccatccttccagatcttatttcaaattgtgtccctgataggaacaaaattcaacaagggccggatttgtgttcatctctgcccgcccccccccccctcctagaacagggccagcacatgtaggcattcaacacttgtagaactcacgaacgcaagccacctactccaggaggccttccaggtccacctccgcatcttttcctccagagaatactcagggaactttgtcccaaattctaatcagcattccgtgtttctcaggactctagtaatacaggcatcaaattatgggatgggctatgggcttattccaaggcaaggacttcatcctggtcatctgtgttcataacccaccaccagcagtagcagaatgcctggcaccaagatgccaaggact

SEQ ID NO: 29462 - DNA, 601 bp, Human
catatttaaatgaaatacggctgagggaaaaaatcttttaccctagaatagtatatccagtgaaaatatccttcaaacatgaaggagaaataaagactttcccagacaaacaaaagctgagagataccatcgacaccagacctgtcctacaagaaatgctaaaaaggagttcttcaatcagaaatttaaaaaaattttaatgagcaataaaaaatcatctgggctgggcatggtggctcacgcctgtaatcccagcactgtgggaggccaaagccggtggatcacctgaggtcaggagttygagaccagcctggctaacatggtgaaaccacatctctactaaaaatacaaaaattagctgggcgtggtggcgggtgcctgtaaccccagctactcgggaggctgaggtaagagaatcacttgaacccacgaggcggaggttgcagtgagctgagatcgtgccattgcactccagcctgggcaacaagagcgaaactccgtctcaaaaaaaaaaagaaagaaaaacacagattagtataacactgtatttatggtatatacactactcatatcttaagtagaaagaggaaaagatgaccaa

SEQ ID NO: 29463 - DNA, 601 bp, Human
aagcagaagaactagagtgtttaaagacagggtatttgaaaatacagtcagatgaagcaaaataataaaagaataaacaaagactttgggaggccgaggcaggtggatcacgagatcaggagatcgagaccatcctggctaacacggtgaaacctcatctctactaaaaatacaaaaaaaaaaaaaaaattagccgggcgtggtggtgggcgcctgtagtcccagctactcaggaggttgaggcaggagaatggtatgaacccaggaggcagagcttgcagtgagccaagattgtgccackgcactccatcctgggcaacagagcgagactccgtctcaaaaataaaaaaaaagaataaacaaagaatgaagtatgcctacaggatctagacaatggcctcaaaagggcaaatctaagagttactggccttaaataggaggtagggagagagacagggctagaaagtttattcaaacggatagtagcagagaatttcccaaatctagagaaagatatcaatatccaaacatgagaaggttatagaacaccaagcagacttaacccaaagaagactacctcaaggcatttaataatcaatct

SEQ ID NO: 29464 - DNA, 601 bp, Human
aactaaataaggcacacagggccaattccagagaaacagagatatgtgacctttcagacagagaaatcaaaatagctgttttgaggaaactcaaagaaattcaatatttcctccacagagaaggaattcagaatcccatcaacaaatttaacaaataaattgaaataattaaaaagaatcaagcagaaattccggagtcgaaaaatgcaattgaggccgggtgcagtggctcatgcctgtaatcccagcactttgggaggccgaggcagtcagatcacctgaggttaggagtgcaagaccrgcctggccaacgtggtgaggccctgtttctactaaaaatacaaaaattagctgggcatggtggtgcaggcctgtaatcccagctacttgggaggctcaggcaggagaattggagaggcagaggttgcagtgagccgagagcatgccattgcactccagcctgggcaacaagagtggaactctgtctcaaaaaaaaaaaaaagaaagaaagaaaaaaatgcaattaacatactgaaacgcatcagtcttttaacagcagaattgatcaagcagaagaactagagtgtttaaagacagggta

SEQ ID NO: 29465 - DNA, 601 bp, Human
gtacaaacaagcccagactacaaagactataataaatacctaactccttagtgcccagacaccaacaaacatccacaagcttcaagacgatccaggaaaacacagcctcaccaaacgaactaaataaggcacacagggccaattccagagaaacagagatatgtgacctttcagacagagaaatcaaaatagctgttttgaggaaactcaaagaaattcaatatttcctccacagagaaggaattcagaatcccatcaacaaatttaacaaataaattgaaataattaaaaagaatcaagsagaaattccggagtcgaaaaatgcaattgaggccgggtgcagtggctcatgcctgtaatcccagcactttgggaggccgaggcagtcagatcacctgaggttaggagtgcaagaccggcctggccaacgtggtgaggccctgtttctactaaaaatacaaaaattagctgggcatggtggtgcaggcctgtaatcccagctacttgggaggctcaggcaggagaattggagaggcagaggttgcagtgagccgagagcatgccattgcactccagcctgggcaacaagagtggaactctg

SEQ ID NO: 29466 - DNA, 601 bp, Human
ggtatgggggaggcttcttctgaagatcctccagctcctgcaggggacacaagtgagtgggcagttggcctagtcctccttatttcagccccctccccctgccccagcagcaagctgccccaagttcaaaactggccatcttaggggcagaagccggtaaagtcagagcctacatttactgagcacttagtatgtatcaggcatggtgctggtgctttttcttttttctttttttttttttttgagacagagtctcgctctgttgcccaggctggaatgcagtggcgcaatctcggctccytgcaagctccgcctcctgggttcacgccattctcctgcctcagcctcccgagtagctgggactacagacgcccgccaccacgccccgctaattttttgtatttttagtagagacggggtttcaccgtgttatccaggatggtcttgatctcctgacctcgtgatccgcccgcctcagcctcccaaagtgctgggattacagacgtgagctaccgcgcccagccggtgctggtgctttaagtgaattttctgactgtggcctcaccacaactctggtacacctaggtactaggtgcaggga

SEQ ID NO: 29467 - DNA, 601 bp, Human
ggacaggttccgcaggtatgggggaggcttcttctgaagatcctccagctcctgcaggggacacaagtgagtgggcagttggcctagtcctccttatttcagccccctccccctgccccagcagcaagctgccccaagttcaaaactggccatcttaggggcagaagccggtaaagtcagagcctacatttactgagcacttagtatgtatcaggcatggtgctggtgctttttcttttttctttttttttttttttgagacagagtctcgctctgttgcccaggctggaatgcagtggcrcaatctcggctccctgcaagctccgcctcctgggttcacgccattctcctgcctcagcctcccgagtagctgggactacagacgcccgccaccacgccccgctaattttttgtatttttagtagagacggggtttcaccgtgttatccaggatggtcttgatctcctgacctcgtgatccgcccgcctcagcctcccaaagtgctgggattacagacgtgagctaccgcgcccagccggtgctggtgctttaagtgaattttctgactgtggcctcaccacaactctggtacacctaggt

SEQ ID NO: 29468 - DNA, 601 bp, Human
tgccgggtgtggtggctccacctgtaatcccagcactttaggaggccgaggtgggcagatcacttgaggccaggagtttgagaccagcctggccaacatagcaaaatcctgtctccactaaaaacacaaaaattagccaggcatagtggcacgtgcctgtagtcacagctactcaggaggctgaggcaggagaatcgcttgaaccccagagtggaggttgcaggaaacgaacatcgcatcactgcactccagcctgggtgacacagtaagactctgtctcaaaaaaaaaaacaagtccaartcctaaatgataagatgaattgttcctttgatattccaaagagctttgactaacaaaaagttcaatgtcttaaattttatttccaagtaatgaaaagtgtagattaatttctcaaagtatctttagtcactaataatcggatgaaaaaaagagagatcttgcactctgaaaactattttggaatactgctttcagagagactttatcaagaaaataccaaataataaacagagaaaaataagaacagtagaaatgagctatttgtgttttcatatgtaacaattttctgaaataagacta

SEQ ID NO: 29469 - DNA, 601 bp, Human
gtgtcctcactctaagccaggtaagtggatcgtttcaacacagtaacccaagggacttgacagaggttcccatgttgacctgactcaggcctttctctacttttctggactataggtcagtttaaagagaagacgacacaacctaggccactgcattgtcaataaaaagtaaatcctgccgggtgtggtggctccacctgtaatcccagcactttaggaggccgaggtgggcagatcacttgaggccaggagtttgagaccagcctggccaacatagcaaaatcctgtctccactaaaaayacaaaaattagccaggcatagtggcacgtgcctgtagtcacagctactcaggaggctgaggcaggagaatcgcttgaaccccagagtggaggttgcaggaaacgaacatcgcatcactgcactccagcctgggtgacacagtaagactctgtctcaaaaaaaaaaacaagtccaagtcctaaatgataagatgaattgttcctttgatattccaaagagctttgactaacaaaaagttcaatgtcttaaattttatttccaagtaatgaaaagtgtagattaatttctcaaagtatcttt

SEQ ID NO: 29470 - DNA, 601 bp, Human
tctgcctcctaggttcaagcgattctcctgcctcagcctcccaactagttgggattataggcatgcaccaccacacccagctaattttgtatttttggtagagacagggtttctccatgttggtcaggctggtcttgaacttctgacctcaggtgatccgccctcctcggcctcccaaagacatgggattatagacgtgagccaccatgcccagcgccatgcttcttgtacagcctgcagaagcttgagccaaattaacctcttttctttatatattactcagcctcgggtattcctttamagcaacactaatggactaagacaggggtatcagtgtgtcctgcctgaaggggcttctttctgggcttcgtaggacttaacagaggaaggaggtagcagagtcatggagctgagagctccggggacctgtcccagctctgcctcgggcttgctgtatgactgagctttctctgaggatcagtttcctcgtctgtaaaatggagaagctggaccagaggattccatgctgtatcttacagtcagttgagaaagtcccactaccttctaagttctaggttaaataaaggattttgctacttta

SEQ ID NO: 29471 - DNA, 601 bp, Human
atctcattttttatggtctcagtaaggagaaaaggctgtgcctatcagtcagagaaggccaacagctgaggcctcagagcaggatgggagggtgctgtggttggatgttttgtctcctcaaatctcaggttgaaatttgatccccaagacctacgtggcggtggctcgcgcctgtaatcctagcactttgggaggctgaggcagatggattgcctgggctcaggagtttgagatcagcctgggcaacatgatgaaaccccgcctccactaaaatacaaaaaggtagctgggcgtggtagcrtgtgcctgtagtcccagctactcaggaggctgaggcatgagaattgcttgaatccaggaggcagaggttgcagtgagtcttgctctgcactccagagtgagactctgtcaccaaaaaaaaaaaaaaggaaagaaaagaaaagaatttgatccccaatgttggaggtggggcctaccaggaggcgtatgggtcctgggggcagacctcccacgaatggctccgtggaatggctccgtgccaacctcacagtcataagagagttcttactctattacttactgaaaaagctggttgtttaga

SEQ ID NO: 29472 - DNA, 601 bp, Human
aaaaaaaaagagagatggagtaaaaaaaagtaggaagataaagaaaatatctcattttttatggtctcagtaaggagaaaaggctgtgcctatcagtcagagaaggccaacagctgaggcctcagagcaggatgggagggtgctgtggttggatgttttgtctcctcaaatctcaggttgaaatttgatccccaagacctacgtggcggtggctcgcgcctgtaatcctagcactttgggaggctgaggcagatggattgcctgggctcaggagtttgagatcagcctgggcaacatgatraaaccccgcctccactaaaatacaaaaaggtagctgggcgtggtagcgtgtgcctgtagtcccagctactcaggaggctgaggcatgagaattgcttgaatccaggaggcagaggttgcagtgagtcttgctctgcactccagagtgagactctgtcaccaaaaaaaaaaaaaaggaaagaaaagaaaagaatttgatccccaatgttggaggtggggcctaccaggaggcgtatgggtcctgggggcagacctcccacgaatggctccgtggaatggctccgtgccaacctcacagtca

SEQ ID NO: 29473 - DNA, 601 bp, Human
gacaaacctgaccaacatggagaaaccctgtctctgttaaaaatgcaaaattagccgggtgtggtggtgcatgcctgtaatatccgctacacgggaggctgaggcaagaaccgagaggcagaagttgaacctgggaggctgacgttgtggtgagcagagatcacacccttgcactccagcctgggcaacaagagcaaaactccgtctcaaaaaaaaaaaaaaaaaaaaaaagagagatggagtaaaaaaaagtaggaagataaagaaaatatctcattttttatggtctcagtaaggagaraaggctgtgcctatcagtcagagaaggccaacagctgaggcctcagagcaggatgggagggtgctgtggttggatgttttgtctcctcaaatctcaggttgaaatttgatccccaagacctacgtggcggtggctcgcgcctgtaatcctagcactttgggaggctgaggcagatggattgcctgggctcaggagtttgagatcagcctgggcaacatgatgaaaccccgcctccactaaaatacaaaaaggtagctgggcgtggtagcgtgtgcctgtagtcccagctactcaggaggc

SEQ ID NO: 29474 - DNA, 601 bp, Human
gagtatgggggtcacacagactccggagccaccctgcctgggtgtgattcaactctgacactcactagccatgtgatctaactaggtcaggtgcggtgcctcacgtttgtaatcccagcacttggagccaccctgcctgggtgtgattcggctctgacactcactagccatgtgatctaactaggccgggcacgatggctcacgtttgtaatcccagcactttgggagtccaaagtgggcagatcccctgaggtcgggagttcaagacaaacctgaccaacatggagaaaccctgtctctrttaaaaatgcaaaattagccgggtgtggtggtgcatgcctgtaatatccgctacacgggaggctgaggcaagaaccgagaggcagaagttgaacctgggaggctgacgttgtggtgagcagagatcacacccttgcactccagcctgggcaacaagagcaaaactccgtctcaaaaaaaaaaaaaaaaaaaaaaagagagatggagtaaaaaaaagtaggaagataaagaaaatatctcattttttatggtctcagtaaggagaaaaggctgtgcctatcagtcagagaaggccaacagc

SEQ ID NO: 29475 - DNA, 601 bp, Human
tcaaattcatagaaacaaaatacaaaagtggtcatgaggtgctggggaaagaaaggaatggggagttactgaaggggtacagagtttcagtacaggtagacaaaaagttctagagatgaacggtggtgatggttgtgcaacaatgtgtgtttgtttgtttactgaagcagggtctcgctctgtcacccaggctggagtgcactggcattatcattgctcactgtaatctcaaacttctgggctcaagtgatcctcccacctcagcctcctgagtagctggtactacaggggcccaccaccrtatctggctaattaaaaaaatttttttgatagggtctcactgtgccagggctggtcttgaactcctggacttgagcaatccttttgctctggcctccagattactgggattacgagcgtgagccaccatgcccagctgtaatcctatttaatcctatttaatgacactgaactatatacttaaaaatggttaagatagtaaattttgttatgtgtattttactatgattaaaaacaaacaaactcaggggctggagtgacctaggggttgggagctgcaaggagccagcagaagaccctc

SEQ ID NO: 29476 - DNA, 601 bp, Human
cccaaagaactgaaagcaaacaggtatttgtataccaatgtttctagcagccaaaaggtgaaagcaaaccaagtgtctatcaatggatcaatcaacaaaacgtggcatatacacacaatggagtattatttagccttaaaaggaatgaaattctgatatatgctacaacacggatgaaccttgaagacactatgctacaggaaataagctagacaaaaaaaggacagatttgcaagataccacttatgtgcagtacccagaatagtcaaattcatagaaacaaaatacaaaagtggtcatsaggtgctggggaaagaaaggaatggggagttactgaaggggtacagagtttcagtacaggtagacaaaaagttctagagatgaacggtggtgatggttgtgcaacaatgtgtgtttgtttgtttactgaagcagggtctcgctctgtcacccaggctggagtgcactggcattatcattgctcactgtaatctcaaacttctgggctcaagtgatcctcccacctcagcctcctgagtagctggtactacaggggcccaccaccatatctggctaattaaaaaaatttttttgatagggt

SEQ ID NO: 29477 - DNA, 601 bp, Human
acccaaagaactgaaagcaaacaggtatttgtataccaatgtttctagcagccaaaaggtgaaagcaaaccaagtgtctatcaatggatcaatcaacaaaacgtggcatatacacacaatggagtattatttagccttaaaaggaatgaaattctgatatatgctacaacacggatgaaccttgaagacactatgctacaggaaataagctagacaaaaaaaggacagatttgcaagataccacttatgtgcagtacccagaatagtcaaattcatagaaacaaaatacaaaagtggtcaygaggtgctggggaaagaaaggaatggggagttactgaaggggtacagagtttcagtacaggtagacaaaaagttctagagatgaacggtggtgatggttgtgcaacaatgtgtgtttgtttgtttactgaagcagggtctcgctctgtcacccaggctggagtgcactggcattatcattgctcactgtaatctcaaacttctgggctcaagtgatcctcccacctcagcctcctgagtagctggtactacaggggcccaccaccatatctggctaattaaaaaaatttttttgataggg

SEQ ID NO: 29478 - DNA, 601 bp, Human
ggttggtcctgtgcagagagaaaaggggtcaagctccagtctggttttcctcccttcctgccccaatccgagggtcctaggcatcctctgcttcactcccaggaggaatcatgagccaggacacacacagcacctgcattcatttgacaattgagtcatggattagtgaaaatgtgaaatcaccaaagggcactggcctgggaggcagagaagtctgatcctggcttttgctgtgtgaccacgggtgagccacttcccacctctaggcctcagtttcctcatttgaaaagtggataaagatggactagatgagctctaaggaccatctcagctttcaagactttctgagattatggaagaaaaggatggaacatcctttcttaaaacattagaatgggggtgaggaaatggagaaaatgaggaaatcctaagaactcaggagcttaggaaaataaaatggtgcagctgtgatggaaaacagtatggccatttctcaaaagattagacacagaattaccatatgatccagcagttctacttctgggtagacacccaaagaactgaaagcaaacaggtatttgtataccaatgtttctagcag

SEQ ID NO: 29479 - DNA, 601 bp, Human
aaagtgctcggtcaagtgacaggtattatcattatgaggccagttccctccactgtcatttaggacaccgagtcccagaaaggaacgaaaacttgcccaaagtccacagagggaacagcgggctttcttttcccgagcccttccctgtgcagccaagctgcctctcccatgaaccgcagcaacgttcctctgtcacaactgcacaggtataagaagagaggcaggaggaggtcagtctgtccaggaagcatcccttctatctcatagtaagttcagccaagactcacaatttttatctcckctctttggggcttttcaagctcagaataagctgtgaaccccctctccagtaatctctacccagtatcagtccctcctccaagcaaagcccaaccccaccttggcaagtcttggtgcaaggcttccagttctcactgctgatgatgggcaggcaaatctgtccgttctcgtccacgttggggtggtagatcttggttgtgaatttgatcatgggaggcttgaacggatactccggcgggaagctgatgcgcaggttgaaggctttcaggtggtagggaggttggtcctgtgcagagagaaa

SEQ ID NO: 29480 - DNA, 601 bp, Human
acctgggaggtggaggttgcagtgagccaagatcgcgccactgcactccagcctaggcgacagagcgagactctgtcttaaaaaagaaaaagaattgagttcctcagttgcaacagccacatgtggcttgcgagtcagccaagtgctgccgtttgtcatctgtatgaccttaggcaaccacttcacctctcacatgcctcagatgtccgggtctactaaacaacactacctcacgggcttgttggggaaataaaaatgaagtcggcaggtgatgtttttagcacagtgccgaaagtgctcrgtcaagtgacaggtattatcattatgaggccagttccctccactgtcatttaggacaccgagtcccagaaaggaacgaaaacttgcccaaagtccacagagggaacagcgggctttcttttcccgagcccttccctgtgcagccaagctgcctctcccatgaaccgcagcaacgttcctctgtcacaactgcacaggtataagaagagaggcaggaggaggtcagtctgtccaggaagcatcccttctatctcatagtaagttcagccaagactcacaatttttatctccgctctttggg

SEQ ID NO: 29481 - DNA, 601 bp, Human
ccaggcgcagtgactcacacctgtaatcccagcactctgggaggcggaggcaggcggatcgcctgaggtcaggagttcgagaccagcctggctaacatggcaaaacccctctctattaaaaatacaaaatagctgggtgtggtgtcatacgcctgtaattccagctattcaagaagctgaggccggagaatcgcttgaacctgggaggtggaggttgcagtgagccaagatcgcgccactgcactccagcctaggcgacagagcgagactctgtcttaaaaaagaaaaagaattgagttcytcagttgcaacagccacatgtggcttgcgagtcagccaagtgctgccgtttgtcatctgtatgaccttaggcaaccacttcacctctcacatgcctcagatgtccgggtctactaaacaacactacctcacgggcttgttggggaaataaaaatgaagtcggcaggtgatgtttttagcacagtgccgaaagtgctcggtcaagtgacaggtattatcattatgaggccagttccctccactgtcatttaggacaccgagtcccagaaaggaacgaaaacttgcccaaagtccacagagg

SEQ ID NO: 29482 - DNA, 601 bp, Human
ctttcatttcctgagttaaaaactcctgagctggtccaggtggaggattgcacactgattcagccacaggctctagagctgtgttgttcaatatggtagccattagccacatgcaggcatctaaatttaaatgaattaaaatcaggctgggcacggtggctcacgcctgtaatcccaccactttgggaggccaagatgggtggatggcttgaactcacgagtttgagaccagcctgggcaatatggcaaaacctggtatctacaaagcatgcaaaaattagccaggtatagtggcatgctyctgtagtcccagttactcgggaggctgaggtgggaggatggcttgagcccaggaggtggaggttgcagtgagccaagattgcgccactgaactaactgcctgggcaatagagacagaccgtgtctcagtagaaaaaacaaaaaggattaaaattaagtacaattaagaattgagttctggccaggcgcagtgactcacacctgtaatcccagcactctgggaggcggaggcaggcggatcgcctgaggtcaggagttcgagaccagcctggctaacatggcaaaacccctctctattaaa

SEQ ID NO: 29483 - DNA, 601 bp, Human
atgtcctgacactccacactcactccttgggggaaaggttacatcgcttaggattactctacgaccagatcaaacgccccgctcattcttggctggtgacacccaaggccttgactgattacatcagtggttttcaaacaactacattccatggcttcagagaagctcctcatcacaggggccactgagataagtgaggtttctgggtcttatccccatttcaacaaaaactgctctgttttcctccattatattggtagtccaaataaacttttccttgggcaaaagaggtctaaggctraagactgaaaaccaccactgccccctggctcttcatctttcacagatgcctttgggaacctagtgaaggcagcagcccatctcccgagacagatgtgcacatccacatgcaaaacagacagttcccagaccccctgaagctcatccaaggaccactcctctccctgctcccactcccaccaacctaaggactttcatttcctgagttaaaaactcctgagctggtccaggtggaggattgcacactgattcagccacaggctctagagctgtgttgttcaatatggtagccattagccac

SEQ ID NO: 29484 - DNA, 601 bp, Human
tgggccacagggggctctggcctcagtccatgaggtgtgtccgtccgctatgccgaggatccagtgcacagagggtcagaacatgagttaggagggccggtccactccgaatcggagggtgaactcttcggcattctttctgaacagctccggattctgtgtcagcaggtcagcgaggtccatccgcaggggctccctgatattcggtctattcaccagcacattgagggcctccaggactggggagagacaggccagatcaggatatcagggcagagggaagggagtcatggctgcccgytcccaatgtcctgacactccacactcactccttgggggaaaggttacatcgcttaggattactctacgaccagatcaaacgccccgctcattcttggctggtgacacccaaggccttgactgattacatcagtggttttcaaacaactacattccatggcttcagagaagctcctcatcacaggggccactgagataagtgaggtttctgggtcttatccccatttcaacaaaaactgctctgttttcctccattatattggtagtccaaataaacttttccttgggcaaaagaggtcta

SEQ ID NO: 29485 - DNA, 601 bp, Human
aagcaaggtcagaaatttatgcttaaatccctagtcctctatggtcctgatgaaaccaccccatcccctcatcaaagactcagctgcactccagaattcatctctgactttaatggcttaagcaagaacatggtttccgtggctccccctggactgaatgctggaggatatatacttcacagtctgaggcctggtcccaggaactggcaatctaacaggatggcaagtggttttgaaacatatagattttcaggatggaagtttgattcttcagattgtgactcatccgtggaaaataaayggtttagcacctaaatctgtatattcccatcagtggcttggctgactcagttgtaaatagggtaccctccatctgtctcccacccatatgctccactgtccccaggccctcagtgcctgagccctagggggattcgagttggctgctggattcatttcctgcaagcaggcctgcaaggtgacctgtctctctaagatggagagctggagaactggcctgtaactgcaaacttaaactcccttggctctggggaatgtaaagggtgtgggaagggtgcacctgtggccaggtgaacctggg

SEQ ID NO: 29486 - DNA, 601 bp, Human
ttttgtttgtttttttctttttgcttttttgagacagagtctcgctctgttgcccaggctggagtgcagtggcacaatctgggctcactgcatcctttgcctcctgggttcacgccattctcctgcctcagtctcctgagtatctgagattacaggcacccaccaccacacccagctaattttttgtatttttagtagagacagggtttcactgtgttaggcagattggtcttgatctcctgacctcgtgatccgctcacctcagcctcccaaagtgctgggatcacagacgtgagccacygcgcccagccaccaatatgttaatgttctagcacctagaacattgcctgttccatttttggctctcagatgccctttgagtgaatatgtgggcatgtattgggttccagctgtgtaccaagtgcctaccaggtggtaggagtaggatgacacattaggccgggcacagcggctcacacctgttatcccagcactttgggaggccaaggcaggaggatctcttgagcccaggagttcaagaccagcctgggcaacatggtcaaaccccatctctacaaaaaatgcacgccaccatgcccag

SEQ ID NO: 29487 - DNA, 601 bp, Human
agtgcctaccaggtggtaggagtaggatgacacattaggccgggcacagcggctcacacctgttatcccagcactttgggaggccaaggcaggaggatctcttgagcccaggagttcaagaccagcctgggcaacatggtcaaaccccatctctacaaaaaatgcacgccaccatgcccagctaagttttgtacctgtagtcccagatactcgggaggctgaggtgggaggatcacctgagcccaagaagctgaggctacagtgaactgtgattgtgccagtgtactgcggactgggcaasagagcaagaccctgtctaaaaaaaagaaaaagtaaagacaaataaaaacacaggcacacaaacatgggctcttccacacttgtgtactttactcagaggatggggtagagggcggtcccacaggagaagcatgtgaataaagccaccgtctcggcgtgggagagcctgtgattgttacagaagtgattcagagggccggccctggctccttccgtttggggcttccttgggaaagtcaatcagacatggaggtcttctttgagaagctttctagtcattgtcattgccaaaataaatgtg

SEQ ID NO: 29488 - DNA, 601 bp, Human
atgacacattaggccgggcacagcggctcacacctgttatcccagcactttgggaggccaaggcaggaggatctcttgagcccaggagttcaagaccagcctgggcaacatggtcaaaccccatctctacaaaaaatgcacgccaccatgcccagctaagttttgtacctgtagtcccagatactcgggaggctgaggtgggaggatcacctgagcccaagaagctgaggctacagtgaactgtgattgtgccagtgtactgcggactgggcaacagagcaagaccctgtctaaaaaaaaraaaaagtaaagacaaataaaaacacaggcacacaaacatgggctcttccacacttgtgtactttactcagaggatggggtagagggcggtcccacaggagaagcatgtgaataaagccaccgtctcggcgtgggagagcctgtgattgttacagaagtgattcagagggccggccctggctccttccgtttggggcttccttgggaaagtcaatcagacatggaggtcttctttgagaagctttctagtcattgtcattgccaaaataaatgtggcttcacaggccacggcaaggacagg

SEQ ID NO: 29489 - DNA, 601 bp, Human
caggccacggcaaggacaggccttgtcccagacaatagctcctttctaggagtttgcgttttaagtccgagtgtcttggcatataatagggtcctgaataaaaatgtctttgtatttgaaaggtaattcatggaaatttttcttctaaggttacccttcattcttgggaaaatcagataacccagaattggtctctggttgaagaataaggatgtatattatttggaccttagtaatcagcctgctggataaatgtggaatcgtaatctagctctaactacttcattttatcagtgagcayactgaggcccagggaagttggaggcttccagaggtcagtctcattagtaggggtcacatcaagggaaagggggtctgtccccttggatgcatttggcttctctgagtgccctgagtcagttctgttcacccccgggctctgtccatggtgcttcatctcattcaaggtgatacaagtgatcctgagaccactgacctaaacacacctgagcttcagcctgagaccaccgatctaaacacacccgagcctcagcttctccctgggaacacaggcagtgttgaaggaggaggcaggtgacaa

SEQ ID NO: 29490 - DNA, 601 bp, Human
ccagactggagtacagtggtgtgatcatggctcactgcagcctcaaactcgtgggttcatgcagtcctccctcctcagcctctctagtagctaggactacaggcatgtaccaccacactcagctaatttttctgtttttcttttttgtagcaatgaggccttgctacattgcccaggctgttctcaaactcctgatctcaagcgatccctctgcttcaacctcccaaaatgctgggattacaggcatgagccactgctcctggcttggttttatcttttcacagctgtgatattccccccscagtgtgcttgcctgattttatatacaaataccctaggatctgcagagtggacccctctgaacctggtatctgatgaaaagtgagcaaagaattttgtgttctcctaagttgtggtggctttgactatgaagctctagctgtattgataatagtattggtttttccatccctgtgatgctccggtgagaccgcagggaagcttgtcacaagagaactaaaatttctgagtctcaggggaggaaggttaagacccactccccacctcgaaattcttcttttttgacagaggctgaaatatg

SEQ ID NO: 29491 - DNA, 601 bp, Human
ggagtacagtggtgtgatcatggctcactgcagcctcaaactcgtgggttcatgcagtcctccctcctcagcctctctagtagctaggactacaggcatgtaccaccacactcagctaatttttctgtttttcttttttgtagcaatgaggccttgctacattgcccaggctgttctcaaactcctgatctcaagcgatccctctgcttcaacctcccaaaatgctgggattacaggcatgagccactgctcctggcttggttttatcttttcacagctgtgatattccccccccagtgtscttgcctgattttatatacaaataccctaggatctgcagagtggacccctctgaacctggtatctgatgaaaagtgagcaaagaattttgtgttctcctaagttgtggtggctttgactatgaagctctagctgtattgataatagtattggtttttccatccctgtgatgctccggtgagaccgcagggaagcttgtcacaagagaactaaaatttctgagtctcaggggaggaaggttaagacccactccccacctcgaaattcttcttttttgacagaggctgaaatatgaaattgc

SEQ ID NO: 29492 - DNA, 601 bp, Human
gatcctccacatttaagccagcatctttctctttcctcaagttggattttctagggagacactcgaaaaccgtgaaacctgaaacatgtagctgcttgtttttgagaccgagctaagggatttggcagaatctgtgaagctttttgggggacattttggttttgagaaagaagggtagacctgagtcttcagggttgaggagaggaacggcgtgtccacgggaaggtctcgctgcagagctggttcacgccactcctgtggtcttcagtcggtctgcacttttttttttttttttttttttgagatagagtcttgctctgtcacccaggctggagtgcagtggcacgatcttggctcactgcaagctccgcctcccgggttcacgccattctcctgcctcagcctcccgggtagctgagactacaggcgcccgccaccacgcccggctaattttttgtatttttagtagagatggggtttcactgtgttagccaggatggtcttgatctcctgacctcatgatccgcccgcctcggcctcccaaagtgctgggattatgtgcgtgagccaccgtgcctggcccagtcggtctgtacttcta

SEQ ID NO: 29493 - DNA, 601 bp, Human
agtgctgggattatgtgcgtgagccaccgtgcctggcccagtcggtctgtacttctaacgttccccttgcttttctggcattgagcctctgtgctaatgagttaattatttgttccttcgataaatatctgattgcagaattccattgtacaaggtctaagatctgtaaactcacataagtgcaggtgcagttgcaggtgatatttacagaagtgcatgtcgttatttcctgctcacggtttgcaggtctgggactgcaggtatgcgccactgcacccagataatttttttttttttttttgagacagagtctaactctgttgcccaggctggagtgcagtggtgcgatctcggcccaccgcaagctccacctcccgggttcacaccattctcctgcctcagcctcccgagtagctgggactacaggtgcctgccaccatgcccggctaattttttgtatttttttttagtagagacggggtttcactgtgttagctaggatggtctcgatctcctgaccttgtgatctgcccaccttggcctcccaaagtgctgggattacaggcgtgagcccagtgcacccggcccagtttcaccacgt

SEQ ID NO: 29494 - DNA, 601 bp, Human
ggtgatatttacagaagtgcatgtcgttatttcctgctcacggtttgcaggtctgggactgcaggtatgcgccactgcacccagataatttttttttttttttttgagacagagtctaactctgttgcccaggctggagtgcagtggtgcgatctcggcccaccgcaagctccacctcccgggttcacaccattctcctgcctcagcctcccgagtagctgggactacaggtgcctgccaccatgcccggctaattttttgtatttttttttagtagagacggggtttcactgtgttagcyaggatggtctcgatctcctgaccttgtgatctgcccaccttggcctcccaaagtgctgggattacaggcgtgagcccagtgcacccggcccagtttcaccacgttggccaggctggtctcgaactcctgacctcaggtgatctgcccacctcagcctcccaaaagtgctgggattacaggcatgagccactgcgccaggccatgtctggattttcttaaggcccagcacatctgcacccagaggagggtttttgtttaatgcatacactctagccactgtgaaaactttcctgttgcttt

SEQ ID NO: 29495 - DNA, 601 bp, Human
cccagataatttttttttttttttttgagacagagtctaactctgttgcccaggctggagtgcagtggtgcgatctcggcccaccgcaagctccacctcccgggttcacaccattctcctgcctcagcctcccgagtagctgggactacaggtgcctgccaccatgcccggctaattttttgtatttttttttagtagagacggggtttcactgtgttagctaggatggtctcgatctcctgaccttgtgatctgcccaccttggcctcccaaagtgctgggattacaggcgtgagcccastgcacccggcccagtttcaccacgttggccaggctggtctcgaactcctgacctcaggtgatctgcccacctcagcctcccaaaagtgctgggattacaggcatgagccactgcgccaggccatgtctggattttcttaaggcccagcacatctgcacccagaggagggtttttgtttaatgcatacactctagccactgtgaaaactttcctgttgctttctggttctctgcttatggggcataaatcatctccaagatggaatgaaaattgtcaattttgtgaatttggaaatgattt

SEQ ID NO: 29496 - DNA, 601 bp, Human
tctgttgcccaggctggagtgcagtggtgcgatctcggcccaccgcaagctccacctcccgggttcacaccattctcctgcctcagcctcccgagtagctgggactacaggtgcctgccaccatgcccggctaattttttgtatttttttttagtagagacggggtttcactgtgttagctaggatggtctcgatctcctgaccttgtgatctgcccaccttggcctcccaaagtgctgggattacaggcgtgagcccagtgcacccggcccagtttcaccacgttggccaggctggtctygaactcctgacctcaggtgatctgcccacctcagcctcccaaaagtgctgggattacaggcatgagccactgcgccaggccatgtctggattttcttaaggcccagcacatctgcacccagaggagggtttttgtttaatgcatacactctagccactgtgaaaactttcctgttgctttctggttctctgcttatggggcataaatcatctccaagatggaatgaaaattgtcaattttgtgaatttggaaatgatttgatattttgggtaacagcttttctttaaggagttggaactg

SEQ ID NO: 29497 - DNA, 601 bp, Human
ttagaggtaaacatttctattaataggttcctgggacttctcatgagacagtgctcagctgattcaggccaggggcagcccattgcctttgagattgtcagctgtgccgcagccctcagagtgggcatgagctttgactggatgagcttggtggcacagcatgtcagtatgtttttggcatcaggtaatagaaaatccaacaaaatgtatcttacacagggcgaggtttatcttctcacacagctgtgtagcagtaggtggctcccaagtggcaagaaggcggtccctgtacacatctcarggtttcccatgtgagatggccactgtggctctggtcatcacataagtgttcaaggcagaaaggaggaggaagagcagtgctggctcatgggctcctttttaccaggaaatcaaaaactttccctccaggcttgcctttctgtctggccagatctgggtcacaaggtcatttctagtgccaaaggcagccaggaaactccctctctagtgaagggggtggcagggagcggggaccagcaccacccgcttgctgcgtccctgggagtggggccaggttggccaaccggcagtggccaccacc

SEQ ID NO: 29498 - DNA, 601 bp, Human
tggccaggcacggtgactcactctgtaatcccagcattttgggaggctgagacgggcagatcacctgaggtcaggagtttaagaccagcctggccaacatggtgaaaccccatgtctacaaaaatagaaaaattagccagacatgatggcaggtgtctataatcccagccactcgggaggctgaggcaggagaatcgcttgaacccaggaggcagaggctgcagtttgtcaaaatcatgttattggactccagcctgggtaacagagtgagactctctcaaaaaaaaaaaaaaaaaaaaaagactaaagtgtatagtcaagacattgtaagactggcataaggatacacatacataaatgatggaacagcattcagaatccagaaataaaccctcacattaatgtcaaataatttttcaaccaggtaccaagacaatttcagtggggggaagaatagccttttcaacaaatggtgctgggtaaaagtaggtagactctacttcatcagaatattgtgcttcagaagacatcaagaaattgaaggctggccgggcatggtggtgttcatagctaatcatcagttacagattccttggttcct

SEQ ID NO: 29499 - DNA, 601 bp, Human
atcctgcagccgcagttcaggcttatcagattgcgtttctggaagctgtacatccagagaagggtgcaggcctggtgagtctgggaggggtgtctggtgcggcccttgcagctgtgactccatttctttcagtccatcagtctctggcgagagccggagaggttcctattaattcccacagccgtgggagcctggcatagccccgtagagggcctgatggaggcacaggatgggcgggaatacaggcaggtcctgtggcctgaggagctgccctgaggatgttagcttttgtcctgagggrcacggcaagcctgtgtggggcagaggcatgcgggctgactcgagacgcatcactgctgtggggtgggcaggtgcatgctttgctggtgaatgtggggcagagagggagtgaggggtggaggaggggtggttgtgttgagtctgaaggctgctggtgcaggcctggcggagaagaaggggcctggtagagagtggggccagacgtggctggaatcctgggaagagagagcagaggaaggaccctggggagctgccctgtgtgagggacgtgcagaggaagaggagccccgcggggccaggc

SEQ ID NO: 29500 - DNA, 601 bp, Human
tttggctcgggtgcctgagagacccgattcaaatcacattgtgcgagtgttctagagtgagggccggtgggggggaatgtaaccggaaatgccggcaggcactctggggccgggataagtgggatgttcgtttgattagatgcctcccttctggttcctgcgttgcccaccagtgtcccctcgagggacagtgacgccatcagcctgcctggcagccaatgtgacccctgccaccagggaaaggtcggctctagagacgtaagtgtgtgaatgaaatgaaggcacagcagagctcgtgttrtctaacctgttttctggttgggcagataaacaggccatgaaatgagtgcacacagtgctcacgggaaccaagagctggctgggcgccgggtgccaagcgcaggggccctggaggggctggtccagctggcgtggcctcagtgtggtgggcggcccggtgagcacctgctgctctaggggctggcttccttgtcctctcccagcaccctgtatgtctgctgtgttctcagaaacaaagttcgagaccaaaggctggcgagccagggccctggctggaggcagacgagatgggtgcaggatc

SEQ ID NO: 29501 - DNA, 601 bp, Human
gtcctttgctgtccaccatgctgggagcgtggaggaagagagcaggcgctggacagaaacacacaacctgggggctcctggatgagctccccaagaactggagactcagataacagggcagggagaaaggccacagctggggagccaggaagggcagcccctgctgccgcccaaggagttgggtttaaagctgagtgcagtgggaccctttggggggcttcaagccggaggggcatgattgccacgtttttgaaaagatgcctttggccgctgtttgggggatggcagctggcaccagtgyagctggagcggggcctgctctggagtctctggagggaagcagaggcgaccgtgacagtgacggatgtcagggtagtggagttgctgtcagctgattctgccacagcagttcaagctggagcaagtgcctggaaggaatcagcactgtcctcctgtccctagggtctcggggacatagaacacctctcactgctcactggaggactgtgggacaaggcaggttgcccccagggtctcctgccctcccctgtggacttgggcctccctggtgtgctgcagtggaggtggggaaggtgaaggc

SEQ ID NO: 29502 - DNA, 601 bp, Human
ccctcaggctggtgacccacagtgagccccgccgtgtactttcctcttgtaggataaggagcccaggggaatcatcccgttggaaaacctcagcatcagggaggtggaggacccccggaaacccgtaagctcttcctcctgaaccttctctcctgccagccacctgggagccatcctcactgcctgcagggaacctgccccaagcccccctgaccgcctcccctctctctttctccaccagaactgttttgagctctacaatcccagccacaaagggcaggtcatcaaggcctgtaagackgaggccgacggccgcgtggtagaggggaaccatgtggtgtaccggatctcagccccgagcccggaggagaaggaggagtggatgaaatccatcaagtgagtggggcctcgggggcggggccaggcccgtcttctcgtgccggttggagggcgggggatggtctggaacatggatgcttccgtgtgcaagagtggaccttctgtctccagaaaccccagagggccgggctgccaaagccgacgttcagatctgagcctgcggtcctgtctgaggggcctctggggctggtgggaaagggga

SEQ ID NO: 29503 - DNA, 601 bp, Human
cgggcggcccctccgcggaaggcgtggcagggaggcagtcgccctgcggtgcaagctgctgctccagagcataccgtggcccaggtggtatccccaaggcctcgtgccgtggctggggtcctgggaggtggtcgccctgcagtgcaagctgctgctccagagcgtaccgtggcccagactgatcctcgaggcctcctgccgtggctggggtcatggtcggctgcgcatgtccagaagcatttccttcctgcgaccatcccggcgcccctagggggagaagccaggacagcagcttccgctstctccacagcagacacgggacggattccacagacgggagcctcattcgtaccatgccaaacgcattcactcggggcagtattaaccgttctagaaagccactgttttatagcaaaacaggaaaggaaaagctaccagttttttattcagaatttttctcagatatataggattatagcttttatatgcctttttatattctgaaattataacaaaagatactttctaacagtagtatttttagaatggcagctataaagttaactcctggacacaagtatatactgtgcactgaaaaaat

SEQ ID NO: 29504 - DNA, 601 bp, Human
actcaaatcgatgggctaaaatgagggaaaagccaatatcgacacacatttccaactctcacttaactgcaaccatacaaattagatgttaaggtctacaaataaaaactgaatgtacagtataatcaaagctagttctcagattagatgagaaggctattattttatttcagattgaggattggctcttttgaaagctaatacccatcccttgctctttgggccctacatttacttacagaatgaaaaagtgccctaaatccagcctccgggacgttattatataaatacactcacacagatgggaccaaaaactgagttttatcatataaggttttttgtttttttttaattaacttattttttgcaacgggatcttgctttgtcgcccaggctagagtgcagcagcacgatcacagctcacagcaacattaaattcctggactcaagtgatcctcccacctccagccttctgagtagctgacactacaagtgtgcgccaccgcactggctaattttttaaaactctttttagagacggggtcttgctatgatccccgggccattctccaattcctggcctcaagtgatccttccatcc

SEQ ID NO: 29505 - DNA, 601 bp, Human
atcctaaaatcctacaaaacaaatggacaaacagaaccccccctgtgaactgacatggcatggagtatacaatcctctgacctcagcctccccttcaactcccatcacaccccatacctgcaggtagaacccagtgatttgctgcaattatgttttctgtctcttcctccagattttcactgctggggccatcttcattcagctggaaaatgtgaagtgcaacagtgcatgcactcaaatcgatgggctaaaatgagggaaaagccaatatcgacacacatttccaactctcacttaactscaaccatacaaattagatgttaaggtctacaaataaaaactgaatgtacagtataatcaaagctagttctcagattagatgagaaggctattattttatttcagattgaggattggctcttttgaaagctaatacccatcccttgctctttgggccctacatttacttacagaatgaaaaagtgccctaaatccagcctccgggacgttattatataaatacactcacacagatgggaccaaaaactgagttttatcatataaggttttttgtttttttttaattaacttattttttgca

SEQ ID NO: 29506 - DNA, 601 bp, Human
ggaagaagcccgctgccaagctgaccgtggtctaatggtagcgtcagtgtcaaggaaaaacacctgctacttagcagaccgggaaagggagtctccctttcccccggggagtttagagaagactctacccctccacctcttgtggagggcctgacattagtcagacccgcccgcagtcatccagaggcctgtctccctgtgatgctgtgcttcagtggtcatgctcctagtccgccttcatgttccatcctgtacacctggctctgccttttagctagcagtagcaaattagtgaaagtaytaaaagtctctgatatgcagaaataatggtgtaagccgtctctctgtttctcttctctctctctgcctcagctgccaggcagggaagggtcccctgtccagtggacacgtgacccacgtgaccttacctatcagtggagatggctcacactccttaccctgcccctttgtcttgtatccaatatatatcagcgcagcctggcattcggggccactaccggtctccgcgtcttggtggtagtggtcccccaggcccagctgtcttttatctctttgtcttgtgtctttatttctacactct

SEQ ID NO: 29507 - DNA, 601 bp, Human
ctcctctatccattcagaagcccgcagacagatctgggcgtgcttagctgctgactaaatcaccagagaacaagactgaggccagagagaaactgacttccaggtcctcttttcagttgcttccatgtcaaaagtccacaaaagaaaaagaattacgttcaagaagcatcactggcattccacgtaaaaaagagagagaccgtttactgatactgtttattaaaacagtggagggatacagacaatctaacaaaatatagactgggttgaatattaaacaaaattaattataaaacatttygattctttgatagagtgaggaaaagtcttgctaggacttctttttgccatttctaagccataaaaccaatgcatatttccagatctttgtactggaaaaagctatattccttacaataacattttccttctcttgtgttgccctctctgcccctagagatcttttttggttactctttggaggcagggtctcactcccgtcacccaggctcaccacagcctggacctcctgggctaaggtgatcctcccacctcagcctcaaaagaagctgggaccacaggcatgtgctcccagctaatt

SEQ ID NO: 29508 - DNA, 601 bp, Human
ctagaaggttgtcggtttaccagaatgagggcaagggacacctggcccgcccagggtggaaaaccgcttaaaggcgttcttaagccacagacaatagcatgagcgatctgtgccttaaggacatgctcctgctgcagttaactagccccacctattcctttaattcggcctatcccttcgtttcccgtaagggatacttttagttaatttaatatctatagaaacaatgctaatgactggcttgctgttaataaatacgtgggtaaacctctgttcggggctctcagctctgaaggctgtrcgacccctacttcccacttcacacctctatatttgtgtgtgtgtgtgtctttaattcctctagcgccgctgggttagggtctccccgaccgagctggtcttggcacacattcctgcagctgaccccaaaacgagcgcttctcaggaagccagatacgctctctgtggtgagacagtggtgatggcctggacaaaacgttcctctgcacagttcagtctgctgtcaccccacactcaacaatccagcttctgagaatgccagggactccccaggcaccctgaggacagaaagaacatttca

SEQ ID NO: 29509 - DNA, 601 bp, Human
ccaggctggagtgcagtggtgctatctcggctcactgcaagctccgcctcgccggttcacaccattctcctgcctcagcctcccaagtagccgggactacaggcgcccgccaccgtgcccggctaattttttgtatttttagtggagacggggtttcaccgtgttagccaggatggtctcgatctcctgacctcgtgatccgcctgcctcggcctcccaaagtgctgggattacaggcgtaagccaccgcgcccggcctagcaaggatctcactttcgcatggcgttcctgattgtgccayctaccgtgggctctggtgcccaccaccacctgggcatggccactcatcatccctagacatactctagagctgggttacttcccatgttcatgatctgctctcccctctagcgtctaaactccatagagagagcccctgttgtctggtctgttgaccaatgtcccccaaggacccagcatgagccagcagagcgggcacaaggtgcccccagggagcatgctgcacaggcctggggggcgtggctgcacatgtggcagtgctaccactgctgcctggggaaggtcaacttcacctagaccc

SEQ ID NO: 29510 - DNA, 601 bp, Human
aggtaaacacagccggtcactgacgtcccctacactgactggtacctcaaataatgaacaatgatgactgtattgtgccaaaagaacaaaaatattgagtcagtggccctagtttcaactatcagctcaacctgtcacatacaaaactagttttcaatttaagaagggagttaatgcatatgttgaaatcctccgtactggaacgagcttattttaagctatcttaattaattaagaacatataagaaatccatttgtatcaagaggaaaaaaaaaataaaggtaccttcatcagttcttccaaacaagagaggtagattttgaagatggctgctgcagagggtggcccaatgtactgcttgatgtcagccctgtccacgaaggccacgtcgatcttctcggtgatgttagaagtggtcagaatcacaacattggaatgcctgttgtggccgagaagcaagcaccacagtcatcacggctgtcggtgacccaattctatcctgccctatctggcaaggaggttggcaggacgatggccagcaggctgccaacaggaaggaaagtggccttgtgccaacacaggccacgcagaccccccagc

SEQ ID NO: 29511 - DNA, 601 bp, Human
agggtgacacagtttctcttctggcttctataacacctgcattaatcttccttttttgctgttaaacaaaacttgctggcattatgcatcccatccactgggggtgggctgggaacaaacaggtttcgatggttcttcacaaggagacaaacaatctgaattatcttttacaaacagtgaaaatgacaagatgtttgtctctcagtatgcattttaaaacaacataaatagaatacacttcttttaacaaagcctggccttggtggctttctagcttgcagtctaagtaacgtttggtttrcagaagggattccctgggagacggctgtgtggggcaacctcacttactggttgtgtgttctccatgggaaaagcaccagatggggaagcccaggatcagatgtaagctgcaagcttctttctctcttcaaactgcttgtccactgccagagacagggcctggaggaacccctctatggtgacggtgggggcctagaaggtacacggtcattgctggaggggctcaactcacgtttggtggggccatctggcatccacagcccctgccgccacccacagtgcagatagcacagaagggggt

SEQ ID NO: 29512 - DNA, 601 bp, Human
tgctcccaaagggctgggattacaggtgtgagccaccgcgcccagccagaaaaactcataacattttaagcacgtttatgaatttgtgttgggtctcattcaaaacccatcctgggccacatgtggcctgcagaccacaggttggacaagcttggtttaaatcaaaagaagcatgcagtaattacagtgacaaacactcttgtttagaaaatcaccaggtagggttacatctgtggttggttgtacatcttgcttgaaactatgaaaggactgtttaattgctactctgaagaggacaagktataatctaatttgtttaggaaggtaattgttaaaagcagcaactattttaaagagggattttacaagtccatgcaaactccacacctcccccaacaagaaaaacttggcctttttaagtacaaaggggagatattatgcagacaaaaatattctgactttgtcaataagggcaaatatgacatttaccattcattaatgtttacgattcggtagacacaattccaggcattttacactcatgatttcatttaatcctctcaacctcacaataggtatgattatccctattcaacatata

SEQ ID NO: 29513 - DNA, 601 bp, Human
cactccagcctgggcgacagagcaagactcggtctcaaaaaaaagaaaagaaaagaaaatcatcatccagagttagattttttttctaagtactagtatttttttcattactcacagctctttaatataaaaataacttatctggactacagtttattaggagtgtccaatcttttggcttccctgggccatactggaagaactgtcttgggccatacataaaatacactaacaatcgctaatgagctttaaaaaaaaaaaaatcgcaaaaaacctcattttttatttatttatttatttwttttttttttgagacagagtctcgctctgtcgcccaggctggagtgtagtggcacaatctcagctcgctgcaacctctgcctcctgggttcaagtgattctcccacctcagcctccccagtagctgggactataggcctgcgccaccatgcccggctaatttttgtattttttagtaaagagacgaggtttcaccatgttggccaggctggccttaaactcttgacctcaggtgatcctgaggccctcctcaaagtgctcccaaagggctgggattacaggtgtgagccaccgcgcccag

SEQ ID NO: 29514 - DNA, 601 bp, Human
ctgcagtgagccaagatcgtgccactgcactccagcctgggcgacagagcaagactcggtctcaaaaaaaagaaaagaaaagaaaatcatcatccagagttagattttttttctaagtactagtatttttttcattactcacagctctttaatataaaaataacttatctggactacagtttattaggagtgtccaatcttttggcttccctgggccatactggaagaactgtcttgggccatacataaaatacactaacaatcgctaatgagctttaaaaaaaaaaaaatcgcaaaaaamctcattttttatttatttatttatttattttttttttgagacagagtctcgctctgtcgcccaggctggagtgtagtggcacaatctcagctcgctgcaacctctgcctcctgggttcaagtgattctcccacctcagcctccccagtagctgggactataggcctgcgccaccatgcccggctaatttttgtattttttagtaaagagacgaggtttcaccatgttggccaggctggccttaaactcttgacctcaggtgatcctgaggccctcctcaaagtgctcccaaagggctggg

SEQ ID NO: 29515 - DNA, 601 bp, Human
ctggaggtcaggtacggtggctcaccgcctgtaatcccagcactttgggaggccaaggtgggcggatcacgtgagatcgggagtttgagaccagcctggccaacaggtaaaacctcgtctctactaaaaatacaaaaattagccgggtgtggtggcacacgcctgtaatcccagctactcaggaggctgaggcaggagaattgcttgaacctgggaggtggaggttgcagtgagccgacactgtgctactgcactccagcctgggttacagagtgagactcttgtctccaaaaaaaaaaaaggaaagggagctggaacttaaagtggcactgtttgtctgagataacaacagtgctcctgctctgtcactaacttctgctctcaatactatcaaataataagtgacctataaacgaagaaaaatacactgagaacacttatttaaagtaacatagacacaatttattaaaaatgggaatgagctcagtctggttttctacattttcatctttattttttaattttcttggaaagggtctcacttcactctgccacctaggctggagtatagtggtgtgatcatggctcactgtagcctcaa

SEQ ID NO: 29516 - DNA, 601 bp, Human
gcacctgtagtcccagctactcggggggctgaggcagaagaattgcttgaacccaggaggtggaggttgtagtgagccaagatagtgccactgcactccagcctgggtgacagagtgagaccccgtttcaaaaaaaaaaaaaaaaaattattcttaaataaatgtgccactgcaatttagtatgctgttagaacacagtaaactctggattatgataaattattgatactattatttctacatttggcagttttcctacttatacagaaatagagatgggaatattaaagaatagcaaackgcagtaacaggtaaatatatttttcatctacagaaggttgataaaagctcaaaaaacaatcaaaattaaacaagaagagaaaaaaagtgctaagcagtacatttaaaaagaaaggatcaaagtaatgtttgagtaaccttcatgacttcaaaaaagaaaaatctaagtagtctttgatttttcttacctctgatctcaagattgcatgaatggcttcaatttcctttgtcctagaatcaggtaattctgctacaagagaaataacaaatattgaatatttaatcaataccatatgaagta

SEQ ID NO: 29517 - DNA, 601 bp, Human
tgggcaaaaaagcaagaccatgtctcaaagcaacaaccacaacgaaaagaactagaagtaataataacctgaaatctattagagaggtaactgaactttggaatcaatattttacaagataaagatattccaggttatacaattaagggttaaaaagcagttcactgaattcaaagaacattgcttattttgagtctttatgctttcaaaaccagaaaaaaattaaataaaaatttggatttgctgtatttaaattattaaaatgtctttttctttttttgatacaaggtctcactctgtygcccgggctggaatacagtggcaggatcacagctcaccgcagccttgacttcctgggccctaagatcaggtgatcctcccacctcagcctcacaagtagctgggactacagacacccaccaccacaccttgactaatttttttatctttattttttgtaaccggtctcaaactcctggcctcaagccatcctcccacctccacctcccaaagcgctgagattacaggcatgagccactgcgcccaatctagaccctaataatgaataaaacattaaaattaatttgctattcctgtatcc

SEQ ID NO: 29518 - DNA, 601 bp, Human
ttcagaggccaaggtggaaagactgcttgaagccaggagtttgagaccagcctgggcaacagagcaagacatcgtctctacaaaaaattttatttatttatttatttttttatttacttacttacttacttatttattggagatggagtcttgcttaggctggagtgcaatggtacgatcttggctcactgcaacctccacatcccgggttcaagtgattctcctgcctcagcctcccaagtagctgggattacaggcgcccaccaccatatccagctaatttttgtatttttagtagagrcagggtttcaccatgttgaccaagctgacctcaagtgatctgcccacctcagcctcccaaagtgctgggattacaggcatgagccaccgtgcctggcctattacaaaaaaatctttaaaaattagctgggtgcggtgttgcatgcctgtggtaccagctactcaagaggctgaagcagaaggatcacttgagcccagaagttcaaggttgcagtgagctatgactgtgccactgtattccagcctgggcaaaaaagcaagaccatgtctcaaagcaacaaccacaacgaaaagaactaga

SEQ ID NO: 29519 - DNA, 601 bp, Human
aaaagagttgccagagataatattttctattatatggaatattgaacagagggggctggtctgaaaggagaaaagaataaatgcatagaaagaagaaaagagagtacaaatgaaaagagagacagactcctgatggcctccagttctagctgcagtccttctaaagtcagactacatttctgctattgaaatccataggacactcacatcttaaaatattccgtcctgcttaatctttggttataccattagggtccactgaaatcaacttaatttcttttttaggcagtcctaactattygtaaaacttgatatttatgatttttattctttctgaggggtctaccaacaaagagaaaatttacctattttcaaaaatagaataaaacattctatcttacaattaccatagggtaccgtggatctttttataaatctaagaaaaatcatgggagcaaaatcaacttgtattttctgtatcttaaaacatttggctcttttactatcatgggaattttaaaaaatcatttaaaaaattattcccaactattttaaaaatgacaataacaagaaaacggaaaacttatgaaatcacctagga

SEQ ID NO: 29520 - DNA, 601 bp, Human
cagaccttaattatcctgaagaactagtagtaagaaacaggaccaatggtcccaacagctgattaccttctattctactggctgcttttgcatgactttctgtaagctgtttatatgaaaaacaccatacataactcagcgatataatatactgaagtcaaaccctggttataaaagttcacttcaggttttttttcacacaaaaatacctaaggttatttatttaactctgattaataaatagaactgtgaaactttgaatatggtcaatatctacttggttgtctgccctcatctccayagccatatgagagtcagaaagattgagaaagggctaggcgtggtggctcatgcctgtaatctcagcactttgggaggctgaggcaggaggatcacttgagcccaggagttcaagaccagcctgggcaacataaggaacaaaaaatacaaatacaaaattagctgggcatgttggcttgcacccatagtcccagctactcaggaggctgaggagggaagactgcttgaacctgagaggtcaaggctgcaggggagccatgatcacaccactgcactccaacttgggtgacagagcaagacc

SEQ ID NO: 29521 - DNA, 601 bp, Human
ttttacagatctgaatatacctcgatttatattctaactctaaaaacatacctaaatacattacagtgaagtacatatgaagtaactgtgataacatttacctctttttgttgaagttgatttcggtaacttgtagattgctgctttatttgaatctctgatgcttcatgtttctcttctagatcagtacaaagtttcttaagcctttcattctagaaaaaaaaagtattttcaacaaaaagactgcaagtaaaacatgtaattagttatgtgcacagcattatgaaaaacgtactgcttyccccccccaaaaatgtcaaatataaaaggtctcggacagaattctggactttaaaatatgcttttaaattaaagttaaaaatgcactgaccagccgggcactgtggctcacgcctgtaatcccagcactttgggaggccaaggcagatcatgaggtcaggagatcgagaccatcctggccaacatagggaaaccccatctctactaaaatacaaaaaaaaattagacgggcgtggtggcgtgtgcccgtaatcccagctactcgcgaggctgaggcaggggaattgcttgaacccgggag

SEQ ID NO: 29522 - DNA, 601 bp, Human
gttgtgtaactgattatggctggatgtaggcttaaaatgcaccatgaatctgaggtaactttgtattgacctgcacaacacagctggaagaatgctttgatttataaatccaatctttttagataagataacagtgaaacagtgagcccatggttattagcccatgaatcttaaaaagaaataatatactgaaagtggtcttagctttagatttggcaaagaggagccagcgaaaatctgacctatttaggaagagaacagttctgaagttctgaaattaccagcagttttgactaaaggmgggtaagtcatagcgcaaaagaaattataaacacaggacctaccaaaatgccacatccattcttgtaaaagattattcaaaacacaaaatcaaacaatatagacagaactgaaaaaagttttctataaagtagagtagtccagaagacactgccacaactgaggaaaatttgatattaggaagacagccaacaagtaacagtatttctatatgcataaagttaagcaagtagacaaaaaccaaacacatttatgttgtatgtcataacaaacaagtttttcatattggagccccttctca

SEQ ID NO: 29523 - DNA, 601 bp, Human
tttggttcacacacaagttatataatattacttaaaatagtgtataaaattaccttcacaagtacctatgggtataaagtttatatgtaacataaatgaattccatgtttagacctgggtcccatcctcaagatatctcattatgtttatgaaaatattccaaaatctggccggatgaagtggctcatgtctgtaatcccaacactttgggcggcctgaggtcaagagtttgagaccagcctgggtaacatggtgaaaccccatctctactaaaagtacaaaaaaacattagcccggtgtrgtggcgggcgcctgtaatcccagctactcagaaggctgaggcaggagaattgcttgaacccgggtggcagaggttgcagtgagctgagatggtgccactgcactccagtttgggcaacagactgagactctctctcaaaaaaaaaaagaaaagaaagaacaagaaaagattccaaaatccaaaatctgaaacacttctagtctcaagcatttcggataagagatattcatcctgtataaaatctgatatataagacaaaaaagggctccttggaagaaagtttacagccccaaatagcaa

SEQ ID NO: 29524 - DNA, 601 bp, Human
atgacttttataactgagacttttactaattcaggcctatgcttttaataagcagatttagatgtataactcccatcatcaatcaacaatttgacttaccttaatgatattttgtagtttacatatttcactttgatcagagttatctgttccttgtgctttggaagtctagatcagaaaaagagaattagtaaataattatactgattttcttgtcaacagaaagtcacaaactaacttcattacaagaatacttttgtaaaaagggggattttcacagattccgactaaagaatgccayggaccttttaaagaacctagtctaatagtgaataatacacaataaataaaagatatcatatttaagaatgtattaactaatgggggggacaacagttttacaaaataactaaagttaaggtagaaaaatttatagaatattttacttagcttgacaaaatgtaagggtaaagataattgagcagctttctaaaaggaaatttctttttcctttctttttttttttttttgagacagggtctttctctgtcactcaggctggaatgcagtggtgtgatcatggctcactgcagcctccacc

SEQ ID NO: 29525 - DNA, 601 bp, Human
ctacccaagttgagcccactgtgtctctcgcaggaacctggatcttgagctgagtccatcgactagggaaactggtttgacgggaagcaccaggacaggtgccctctcaagagtctgtccactgggtcccgccacccagattcctaacactcttcccactcctatccaacctgaggccaaaacattcaactcctccttcaatcctgcggatggactaccctgggttcttccagtaaatcctcttttgctttacttggccagagatggtttttgttgcttgtaaccaagaatcctaatctayagaaaaattgatgctcttatggaaaaaagaaaaaaaaagatcctaatctataaattaacttcttacttatgtgccaccactgggctaagagctttacatttaaacctcaaaacaatcctacaagataggtattatcatggtctccattgataataaaacagaagtaacttgcccgagattagcatagcatgtaaataatacagccaggattcaaacacaggtctgatccggattctatccactctagtattgtaataataatgaacccaaaactaaaaattctatatctgacaataattt

SEQ ID NO: 29526 - DNA, 601 bp, Human
agtgtcacccctctgaccaatctgtacctgctgttccactacttccatcctctcactcagcctttcctttcaccagtcttattgggactcccaaactgtcaacctggcgccttcctacccaagttgagcccactgtgtctctcgcaggaacctggatcttgagctgagtccatcgactagggaaactggtttgacgggaagcaccaggacaggtgccctctcaagagtctgtccactgggtcccgccacccagattcctaacactcttcccactcctatccaacctgaggccaaaacattmaactcctccttcaatcctgcggatggactaccctgggttcttccagtaaatcctcttttgctttacttggccagagatggtttttgttgcttgtaaccaagaatcctaatctacagaaaaattgatgctcttatggaaaaaagaaaaaaaaagatcctaatctataaattaacttcttacttatgtgccaccactgggctaagagctttacatttaaacctcaaaacaatcctacaagataggtattatcatggtctccattgataataaaacagaagtaacttgcccgagattagcata

SEQ ID NO: 29527 - DNA, 601 bp, Human
aaactatcaactggccaggtgcagtggctcatgcctgtaatcctagcactttgggaggccgaggtgggtggaccacccgagatcacgagtttgggaccagcctggccaatatggcgaaaccctattgctactaaaaatacaaaaattagctgggcatggtggcaggcacctgtaatccagctacttgggaggctgatgcaggagaatcgcttgaacccggggggcggaggttgcagtgagccgagatcgcgccagtgcactccagcctgggcaacagatggagactccatctcaaaaaaaataataataataaagaaataaaactaataaccttgttgtaacagattttcaagttcttcaattcgttcttcatagtcacttaattcttctcgatgtcgtcgacttatttctgtcaatttctgttggtgtgcattctgcagtactgacatttcatgttgatggtcatcaatttcctgacttcggttctgttttagttccttaaaaaataaaaacaaagttattcacatttataatcaataaatttatgtaagctatatatttaactgttgtccaaaagtgtgcattattaaaaagaattctc

SEQ ID NO: 29528 - DNA, 601 bp, Human
ctcaaaatatctctgtcattttctgcagaagataattttttatttatatcttttattttatcctcaagttgttccatttttttggtagactccactttttctatttgtagaacttgaatagttttttgcatctcatagattttagagagatcagtttctataactccagagccacctagaacataaacacaaaacaatgacatcaaatgtcaagtaccaagaaataaacggtttgctatatacaactaagagatataagacagttcagaatttggaaagcttaaaagttaaattactatamtaaactaagtgttttaaaataaataagttgggggaaaatatttgaatcaactacataaaggcctatgtatcttagtttgaaagaaagtgataatatctctaatcatttattaccaaagtatcatcaccaaacaatgcaaagaaatctataaattataactatttaccacaaaggtaaaaaggacatttccattttcacagaattttttttttttttttgagatggagtctcactctgttgcccaggctggagggcagtggtgccatctcggctcactgcaacctctgcctcctgggctca

SEQ ID NO: 29529 - DNA, 601 bp, Human
acagagaattttaaaagctaactcttcagctgggggcggtggctcacgcctgtaatcccagcactttgggtggccaaggtgggcagatcatgaggtcaagagatcgagatcatcctggccaacatggtgaaaccctgtctctactaaaaatacaaaaattagctgggcgtggtgacacatgcttgtagtcccagctacttgggaggctgagggaggagcatcacttgaacccgggaggtggaggttgcagtgaaccgagatcgtgccactgcactccagtctgagctacagagcgagactytgtctcaaaaaaacaaacaaaaaaaaagctaactcttcaacatttactattggctagacactatcctaaagagcggcagaaagtaactcatataatcctcattactaaaactacaaggaagataccattattatcccaaccctatagatgaaataaccaatgcatagagatgttaacctgtccaaggtcagctaattagtgatagagctcgattccaacccagtcatgtccttaaccactacgctattctgctccattcagagagctgccatagttaacataggcaaaaagcaattatga

SEQ ID NO: 29530 - DNA, 601 bp, Human
gaaatttaaacatcatcccgaagttcacaggcagctataaagtactaaatgcaggggagtaacctgctttgcatttctgacaaattattctggctgcagaatgaaaaaaatagattgaaggaatcatggagaacagagaattttaaaagctaactcttcagctgggggcggtggctcacgcctgtaatcccagcactttgggtggccaaggtgggcagatcatgaggtcaagagatcgagatcatcctggccaacatggtgaaaccctgtctctactaaaaatacaaaaattagctgggcrtggtgacacatgcttgtagtcccagctacttgggaggctgagggaggagcatcacttgaacccgggaggtggaggttgcagtgaaccgagatcgtgccactgcactccagtctgagctacagagcgagactctgtctcaaaaaaacaaacaaaaaaaaagctaactcttcaacatttactattggctagacactatcctaaagagcggcagaaagtaactcatataatcctcattactaaaactacaaggaagataccattattatcccaaccctatagatgaaataaccaatgcataga

SEQ ID NO: 29531 - DNA, 601 bp, Human
gccttagccaagaaatttccccaaagtggttcaaacataaaaatacttctaaatacctttccctttcagaatcttattccttccttgctatgaatacatacaataaagcccttctttctaccactgaaactgttgctctgtacccctataaagaccttctttcaccaggcgtggtggctcacgcctataatctcaacactttgggaggccgaggtgggcagatcacctgaggtcgggagtttgagaccaccctgaccaacatggagaaaccccgtctccactaaaaatacaaaattagctrggtgtggtggctggcgcctgtaatcccagcaactcaggaggttgaggcaggagaatcgcttgaacccgggaggcggaggttgcggtgacccgagattgcgccactgcactacagcctgggcaacaagagcgaaactccatctcattaaaaaaaaaaatagaacttctttctaccactgaaactgttgctctttatgcctcaccactaagaaagtactgtccaccaaaatggacacattctgaagcacacaagcagcatatacagttattacagtatgctactccagacctcctgacctac

SEQ ID NO: 29532 - DNA, 601 bp, Human
ggcctttaacttaataatactagcttacaactctcctatatttaagcacctgccttagccaagaaatttccccaaagtggttcaaacataaaaatacttctaaatacctttccctttcagaatcttattccttccttgctatgaatacatacaataaagcccttctttctaccactgaaactgttgctctgtacccctataaagaccttctttcaccaggcgtggtggctcacgcctataatctcaacactttgggaggccgaggtgggcagatcacctgaggtcgggagtttgagaccaycctgaccaacatggagaaaccccgtctccactaaaaatacaaaattagctgggtgtggtggctggcgcctgtaatcccagcaactcaggaggttgaggcaggagaatcgcttgaacccgggaggcggaggttgcggtgacccgagattgcgccactgcactacagcctgggcaacaagagcgaaactccatctcattaaaaaaaaaaatagaacttctttctaccactgaaactgttgctctttatgcctcaccactaagaaagtactgtccaccaaaatggacacattctgaagcacac

SEQ ID NO: 29533 - DNA, 601 bp, Human
gttcaaatgattctcctgcctcagcctcccaagtagctaggattacaggcacccaccaccatgcctggctaattttttgtattttttttagtagagtcggggtttcactatgttggtcaggctggtctcaaactcctgacctcaggtgatccacccaccttggcctcccaaactgctgagattacaggcatgagccaccgcgcccagccagcacattctttttcaaacagagtatcacacgtaataagagcaatttctggttcctcaaacttttcagttagacacacacgcacacacacayacatactcttactgtgtcacaacgtgaaatgtatttcttactgcagatggttaaagacatatgtgtattttacagtgctttccttatatataagaatctctaaaatgttaacagctactgtaatacctaaaatttgattaaattgaagtaacttcaaaattctctcatgagacacatctgtttcctaaagaaaaatattaagtactacttagcaatctgtaaaaaattaatttactaccaaaagcatttggaaatatctaacaatttgagggagaacttccagatgtctctgaggaaaat

SEQ ID NO: 29534 - DNA, 601 bp, Human
gtatgaactttagttcagtaacacctcaatattggttcattagctgtggcaaatacctcataacaatgtaagatgttaacaaggaaaactcagtatgaggtctatgagacctatctttgcaaattttctataaatttaaaactattctaaaagaataagtttattagaaatgttttaaaaggaacccaaaggacaaaaatgtcttcaaatttaccctatacaacaaagtattcagaacccccaaatcaacaaaaagtgtacgtgtgtgcacacgtatgtgcgtgctgtccattcataaagyatccacaattgttatgagagaaagtaacttcactgcaaaagtagggccacaagtttcagacaatagctgaaattctaaaaagcacaaaaacgtgtcaggctgctttacagccactttctttttttttcttttttttttttttgagacggagtcttgctctgttgcccaggctggagtgcagtggcgcgatctcggttcactgcaacctccgcctcctgggttcaagcagttctcgtgcctcagcctcccaagtagctgggattacaggcatgcaccaccacgtctggctaatttttgtat

SEQ ID NO: 29535 - DNA, 601 bp, Human
tgctccctttccactgctacaaaccattttgttatcaaatctttttcccattattgaagatattaattgtataccaatttctcatactgcaaaatgtatttatgctaggaaaaaattatcttgaaatcatcttgaatatgcatctggaagctttacttcccagaatcttattcccctgtggctataatggaaaatggaattataaaattcattctgtataaagtactctttgtgacaggccactttttcagcaaatctcatttttttcacactttatgggtgggcaatttttcttatatcygagatatgccatgattttcacttttgaagactgaaataaaatgcaccatgggagattaaaattttactactgcacagcagaggaagaataagaaaaatcacctaacagagaaattcattttcactgatcacctttccagttctcttaatagttattaaacttattgtttgattcataattcttttaaagtgaaagtatacctcattctgtagggcagtattttccatttgtttttgtttcagggccaacatgacttggtctctctcctgttgaaacacaactgtcttctcctgcattgat

SEQ ID NO: 29536 - DNA, 601 bp, Human
gcagattcttctctcccttcgtaactcttctcaaatatttcctctttggcaacactttctctacagtctcagttccacactgctttgtatacatacccactctaataattacattatactgtaaagtagacctcaaaaacttttttttttttttttttttgagacagagtctcactctgtcacccaggctggagtgcagtggtgtcatctcggctcactcactgcaacctcctcctccagggttcaagccgagtagctgggattacaggcatcttccaccacacctggctaatttgtgtakttttagtagagatggggtttcaccacattggccaggctggtcttgaactcctgacctcaggtgatctgcccgccttggcctcccaaagtgctgggattacaggcatgagccaccgtgcccggcaagaattcttatatctaaaatttaagatttcaaccctgaagtaacacagaggtacaaatttaaagttttgcttaggcataaaactacaagtccttgttacttcctcattctcatatcccctaatcacctccgacaactagcagttaatttactgtcaataattactgaatgcatgaa

SEQ ID NO: 29537 - DNA, 601 bp, Human
atgactctggtttcactaggaccatacttaaattgaagcaagtcagtcagggaagatacaaatggaagtcacacatcaatgaagttggtctcactcaactatgccaatttatgacagaagactacatttgatttaatatcagtattgtagtgggggaaaaatgaaaagaaaaaaacctactttgtcttttaagttcttcaatttgttcttcttttacatctaactgttctgtaagtcttgatgctgaatccaatgcagcatttgcttcatccaaacattcctgagaaagaaaactttattwaaaaaaagtatgcaaaaattatttcacaaactataaggctgagagacatcttagagtcaacctctacatttcagctggtgaagctgcacctctatgaccttgggcaaatgtatccaaccaataagtatcaaaggcagaacccacattcttttcaatacaatactgcctcatttagaggaactaaataaaaagagcagatgccactgaaagacaacatgatgacagaagtaaaaaaaaaaaaaaaaaaaagtaacaacataaactacaaaaaaacaaagatacaggaagtccagaaatata

SEQ ID NO: 29538 - DNA, 601 bp, Human
cataaaaagtcaaatcagtccaatcaacccctctgatggtcaacagggtgacagccaatgcaatggcattgcctcaacatccaggaaaactaactggacagccagggccaacttaatgactctggtttcactaggaccatacttaaattgaagcaagtcagtcagggaagatacaaatggaagtcacacatcaatgaagttggtctcactcaactatgccaatttatgacagaagactacatttgatttaatatcagtattgtagtgggggaaaaatgaaaagaaaaaaacctactttgtyttttaagttcttcaatttgttcttcttttacatctaactgttctgtaagtcttgatgctgaatccaatgcagcatttgcttcatccaaacattcctgagaaagaaaactttattaaaaaaaagtatgcaaaaattatttcacaaactataaggctgagagacatcttagagtcaacctctacatttcagctggtgaagctgcacctctatgaccttgggcaaatgtatccaaccaataagtatcaaaggcagaacccacattcttttcaatacaatactgcctcatttagaggaactaaa

SEQ ID NO: 29539 - DNA, 601 bp, Human
aaatatttgtctaaacgacagaagtttcaaaaatttcagaatataaattctttattattttatccaaatttaagcatctgatgtgtgatatgagtatataacatatacctttacagtccaattagtaaacatattagtctattaaaatatgaagatttcagaagagctcttccaataaagaatttgtttatagtccaacagattataattcaatttcaattgataaattttcttgcgtgccagtatatatgatatgaacataaataaaacccttacaatttagtgagacagaaaaatatgyacacgttaaccaccaccaaccgtccgctctaggcagatctttcaacataaaagagtgctttctacattcttggagtctcaagtcagtttgttaaactgcgcttatatatattaacatgccaatgtttggttactgagtgtagcacttaaattttcaaaggagaaaaacccttctcaaactataaactacacatctaactcggattagcaagaaccaccattagtgagaaagcaaagcaggtggccaagaaagatgtaaccaattccccatcacttccagaggaataattcatagctggtt

SEQ ID NO: 29540 - DNA, 601 bp, Human
cttactacctaaaggactgataaattttactactttcccttcctatacaagttcagaaaaatagaaatatttgtctaaacgacagaagtttcaaaaatttcagaatataaattctttattattttatccaaatttaagcatctgatgtgtgatatgagtatataacatatacctttacagtccaattagtaaacatattagtctattaaaatatgaagatttcagaagagctcttccaataaagaatttgtttatagtccaacagattataattcaatttcaattgataaattttcttgcrtgccagtatatatgatatgaacataaataaaacccttacaatttagtgagacagaaaaatatgtacacgttaaccaccaccaaccgtccgctctaggcagatctttcaacataaaagagtgctttctacattcttggagtctcaagtcagtttgttaaactgcgcttatatatattaacatgccaatgtttggttactgagtgtagcacttaaattttcaaaggagaaaaacccttctcaaactataaactacacatctaactcggattagcaagaaccaccattagtgagaaagcaaag

SEQ ID NO: 29541 - DNA, 601 bp, Human
gaagggaagagaggaagggaaagagcctgccataatgaatttgggaatctgtttcaagatgctacaacctagtgtaaaagaaaaactgttttcagtatagcctacacctcttagataaagttatgacttttcacaaaatttagcaggcaaaactacttactacctaaaggactgataaattttactactttcccttcctatacaagttcagaaaaatagaaatatttgtctaaacgacagaagtttcaaaaatttcagaatataaattctttattattttatccaaatttaagcatctgaygtgtgatatgagtatataacatatacctttacagtccaattagtaaacatattagtctattaaaatatgaagatttcagaagagctcttccaataaagaatttgtttatagtccaacagattataattcaatttcaattgataaattttcttgcgtgccagtatatatgatatgaacataaataaaacccttacaatttagtgagacagaaaaatatgtacacgttaaccaccaccaaccgtccgctctaggcagatctttcaacataaaagagtgctttctacattcttggagtctcaa

SEQ ID NO: 29542 - DNA, 601 bp, Human
tttatacttaaataccagttatgtaactgatgaacttcatttaccataacaacagctttttaaatggtgtcatctatgttgcaaggcaaactctttacttacccatctgaataatgaaaggcttaaggagttacgttctccccaaataattacaataaagaaaaacaaacccatattacaatgataacagttgaattaatatttgccagaagaaaaaacaatatatacataccttacctgatcatcttttaggcagtcaaaggtttgaaaacaatcttgattagattatttttctatgaakttgggctaatacaattcctttttattggaataggtaaattcctaatgtcttagtggacagattctgctttaatgcccaagacctctgacaacttcaatggtaacagacaagcaatcctttgaaggtgcctacttcagcaatgggaaactcaaataaaaaagacctcctaaagcaaagaaagcactaagacaaatttgtcaaatctgcttatcattgagcactcttagggttcccaagccgtactttcctatgaatgacaactttccgaactctgggcaagcttctggtgttacctagtga

SEQ ID NO: 29543 - DNA, 601 bp, Human
gaagaatatttgtatgcttatctaataccttattaaacacattacagctcttgttttatacttaaataccagttatgtaactgatgaacttcatttaccataacaacagctttttaaatggtgtcatctatgttgcaaggcaaactctttacttacccatctgaataatgaaaggcttaaggagttacgttctccccaaataattacaataaagaaaaacaaacccatattacaatgataacagttgaattaatatttgccagaagaaaaaacaatatatacataccttacctgatcatcytttaggcagtcaaaggtttgaaaacaatcttgattagattatttttctatgaagttgggctaatacaattcctttttattggaataggtaaattcctaatgtcttagtggacagattctgctttaatgcccaagacctctgacaacttcaatggtaacagacaagcaatcctttgaaggtgcctacttcagcaatgggaaactcaaataaaaaagacctcctaaagcaaagaaagcactaagacaaatttgtcaaatctgcttatcattgagcactcttagggttcccaagccgtacttt

SEQ ID NO: 29544 - DNA, 601 bp, Human
caggcctcaattcctaaacacaaatactaatttgtatggctaaaatctgactaatgttcactcttggtaattcaaaacattttctgataaaaaaacaatgctatacatgtgttttaagttcccagatttggcccccaagtaaatttaattcatatgctgcggggttctggatcccacaagcaaggtctatgaaatacaggaggatgaaagaggataaggaataagaggaacgaatagggaaagaaaaggcaagagaagaatatttgtatgcttatctaataccttattaaacacattacarctcttgttttatacttaaataccagttatgtaactgatgaacttcatttaccataacaacagctttttaaatggtgtcatctatgttgcaaggcaaactctttacttacccatctgaataatgaaaggcttaaggagttacgttctccccaaataattacaataaagaaaaacaaacccatattacaatgataacagttgaattaatatttgccagaagaaaaaacaatatatacataccttacctgatcatcttttaggcagtcaaaggtttgaaaacaatcttgattagattattttt

SEQ ID NO: 29545 - DNA, 601 bp, Human
gctggagaatcacttgaacctaggaggtggaggttgcagtgactggagatcgcaccactgcactccagcctgggtggcaagagcaaagctccatctcaaaaacaaaaaattaaaattaaaaaaaaaaatgaaagcacaaacaggcctcaattcctaaacacaaatactaatttgtatggctaaaatctgactaatgttcactcttggtaattcaaaacattttctgataaaaaaacaatgctatacatgtgttttaagttcccagatttggcccccaagtaaatttaattcatatgctgckgggttctggatcccacaagcaaggtctatgaaatacaggaggatgaaagaggataaggaataagaggaacgaatagggaaagaaaaggcaagagaagaatatttgtatgcttatctaataccttattaaacacattacagctcttgttttatacttaaataccagttatgtaactgatgaacttcatttaccataacaacagctttttaaatggtgtcatctatgttgcaaggcaaactctttacttacccatctgaataatgaaaggcttaaggagttacgttctccccaaataattac

SEQ ID NO: 29546 - DNA, 601 bp, Human
tcacctattttgggcgccctggccgggcaggcggcttatcttacggcccctgggtccctgcccgtcgtccgcctgtccggctaggaggggggaggggaccctctggtcaccctcatccccacccacgtgggacctagaagtcctgaccgccctttccctcgcctttaatcaacacctaggggctggggacgctcatggaggggaagggggatgctaagctcggcctgatccccctccctggcttccccctgctcaccccaggcccagggcgggaccgccccctggtcgcctataacctcarccctggaagccccagaaatttccccctatcctagccggacctctgacccctccccttgctgggggcggtggaatccctgagttcttagtgcagcgggggtaaccagactgccaccccctcctccaattctgcgatttcttttggatgtgtagtggggtcagtggggtaaattgagtcacccatcgggggatccctggaagcagggagattcagggaacctggtgcctgccccctggccactcaggggcccccagtctgccaggaaccctgcccctctggccttgactcacgccgggccgg

SEQ ID NO: 29547 - DNA, 601 bp, Human
ccctggggtggacgctacggaggacgcgcctggggcgacggggagcggtgggagggctgcgggctcagccctcctacctctgtctccccttaggagcctggtgaaaaaatatctgcccaagagacctgccaaggatgatcctgagtccaagtaaggttggagaggggctgcagggctagatttgtggggaaaggcggtgcttgggtctcacttcccctccctcagctgggacaccccaccgctcctctcacttccccttctagaggtgagagcatggatgcaagatgcgggattatctggyttggaatcctgagtccactactatgtagagaaattgacttgggcttgtgactcaggttttctgccactattttccttaactgttaaatacagaggccccagcagttacaaaaccagtaactttgggcagatgacttaaagttttgcgcctctgttttcctcatctgtgaaatggaatgatgacgattcctccagctttgtagggctttcatgaacacgagctgagtgaatgtgtttaaacagtgtgcagtccatatcaaacgccgtaaggagcatttgacttggaattgagtccccaatt

SEQ ID NO: 29548 - DNA, 601 bp, Human
agagacagggtttcaccatgttagccaggctggtaattgtagttttgacttttatcccacttagtgtgaatgttaacacctctcattgtaaaattaaaaaaaaaaaatagggttgggcacagtggctcacacctgtaatcccacacattgggagggtgcgcaggtggatcacttgaggtcaggagttcgagagcagcctggtcaacatggtgaaaccttgtctcttctaaaaatacaaaaattagccaggcgttgtggtgcgcgcctgtaatcccagctactcaggaggctgaggcatgakaatcgcttgaacccgggaggcggaggttgcagtgagccaagatcgcaccactgcactccagcctgggcgacagagtgagactctgtctccaaaacaaatagatacggtgtttgattacaaaatgatgtccccaaccccactaagatgatgcagaaaagatggtataagctttgtacaccatctttaaaaactggaaaattctgtgttccaatatacattcgaggtccagtgcggtggctcacacctgtactcccagcactttgggagggtgaggcgggaagatgcggagttcggggggat

SEQ ID NO: 29549 - DNA, 601 bp, Human
ctgtaatcccacacattgggagggtgcgcaggtggatcacttgaggtcaggagttcgagagcagcctggtcaacatggtgaaaccttgtctcttctaaaaatacaaaaattagccaggcgttgtggtgcgcgcctgtaatcccagctactcaggaggctgaggcatgagaatcgcttgaacccgggaggcggaggttgcagtgagccaagatcgcaccactgcactccagcctgggcgacagagtgagactctgtctccaaaacaaatagatacggtgtttgattacaaaatgatgtcccyaaccccactaagatgatgcagaaaagatggtataagctttgtacaccatctttaaaaactggaaaattctgtgttccaatatacattcgaggtccagtgcggtggctcacacctgtactcccagcactttgggagggtgaggcgggaagatgcggagttcggggggattggagtttgagacctcatctggaaaaaaaaaattagccaggtgtggtggcgtgtgcctgtggtcccagctatttgggagcctgaggtgggaggatcacttgagcccaggagtttgaggctgcagtgagacgc

SEQ ID NO: 29550 - DNA, 601 bp, Human
gtgagccaagatcgcaccactgcactccagcctgggcgacagagtgagactctgtctccaaaacaaatagatacggtgtttgattacaaaatgatgtccccaaccccactaagatgatgcagaaaagatggtataagctttgtacaccatctttaaaaactggaaaattctgtgttccaatatacattcgaggtccagtgcggtggctcacacctgtactcccagcactttgggagggtgaggcgggaagatgcggagttcggggggattggagtttgagacctcatctggaaaaaaaaarttagccaggtgtggtggcgtgtgcctgtggtcccagctatttgggagcctgaggtgggaggatcacttgagcccaggagtttgaggctgcagtgagacgcaatcatgccgctgcactgcagcctgggtgacagcaagaccctgtctcaaaaaaaaaaaaaaaaaatctactcaagggttggggttaaggaatatggaccagaatttgtcatcgcttcaaggattacattcttggggcttaacccttttccacctggaggtgcgtcctggggcatcagcctgctcgggaggaggggcctga

SEQ ID NO: 29551 - DNA, 601 bp, Human
aattctgtgttccaatatacattcgaggtccagtgcggtggctcacacctgtactcccagcactttgggagggtgaggcgggaagatgcggagttcggggggattggagtttgagacctcatctggaaaaaaaaaattagccaggtgtggtggcgtgtgcctgtggtcccagctatttgggagcctgaggtgggaggatcacttgagcccaggagtttgaggctgcagtgagacgcaatcatgccgctgcactgcagcctgggtgacagcaagaccctgtctcaaaaaaaaaaaaaaaaaatctactcaagggttggggttaaggaatatggaccagaatttgtcatcgcttcaaggattacattcttggggcttaacccttttccacctggaggtgcgtcctggggcatcagcctgctcgggaggaggggcctgactccctgttccccgattctcatccaaccccagattcagccagcaacagtccttcgtacagattctccaggaggtgaatgactttgcaggccagcgggagctggtggctgagaacctcagtgtccgtgtatgtcttgagctgaccaagtactcacaagagatgaaa

SEQ ID NO: 29552 - DNA, 601 bp, Human
tcccagcactttgggagggtgaggcgggaagatgcggagttcggggggattggagtttgagacctcatctggaaaaaaaaaattagccaggtgtggtggcgtgtgcctgtggtcccagctatttgggagcctgaggtgggaggatcacttgagcccaggagtttgaggctgcagtgagacgcaatcatgccgctgcactgcagcctgggtgacagcaagaccctgtctcaaaaaaaaaaaaaaaaaatctactcaagggttggggttaaggaatatggaccagaatttgtcatcgcttcarggattacattcttggggcttaacccttttccacctggaggtgcgtcctggggcatcagcctgctcgggaggaggggcctgactccctgttccccgattctcatccaaccccagattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatggtgaggagccccccgattcaggttttacaaagggcttct

SEQ ID NO: 29553 - DNA, 601 bp, Human
caagagatgaaacaggagaggaagatggtgaggagccccccgattcaggttttacaaagggcttctgctggaaccctggcgagccttatcactcttctttctgtagcacttccaagaagggcggcgggcccagcagcagctggaaaatggctttaaacagctggagaatgtgagtttgcagaggtagcagtgactgtggcccggaggcatgggggcagggttgcggatccggagtcagggagctgccctctttgtcagacctggaccttccctcccccataggcttccagtactcccttgwcccctacttactggatgacatcccaataatccctgaaaccttggtttcccaccctgctgtctttgggatggtggctccctcactccggttctgtcccctacacagagtaagcgtaaatttgagcgggactgccgggaggcagagaaggcagcccagactgctgaacggctagaccaggatatcaacgccaccaaggctgatgtggagaaggtgtgtgtggcgggggcgggggggcggtgcggggtctgggacaagcttggggagtccgagtgggacgtgatcggaacctggcagtacctt

SEQ ID NO: 29554 - DNA, 601 bp, Human
atgaaacaggagaggaagatggtgaggagccccccgattcaggttttacaaagggcttctgctggaaccctggcgagccttatcactcttctttctgtagcacttccaagaagggcggcgggcccagcagcagctggaaaatggctttaaacagctggagaatgtgagtttgcagaggtagcagtgactgtggcccggaggcatgggggcagggttgcggatccggagtcagggagctgccctctttgtcagacctggaccttccctcccccataggcttccagtactcccttgacccctrcttactggatgacatcccaataatccctgaaaccttggtttcccaccctgctgtctttgggatggtggctccctcactccggttctgtcccctacacagagtaagcgtaaatttgagcgggactgccgggaggcagagaaggcagcccagactgctgaacggctagaccaggatatcaacgccaccaaggctgatgtggagaaggtgtgtgtggcgggggcgggggggcggtgcggggtctgggacaagcttggggagtccgagtgggacgtgatcggaacctggcagtaccttccacct

SEQ ID NO: 29555 - DNA, 601 bp, Human
gaaagggaatcagaaacctatagtaacagtgagctgtgcttttagtcagctgttcttcctgctgggcatgccttttacttgtttgtttatttacttctatagagagatggggcctggctctgtcacccgggcaggagtgcagtggcataatcacagctcactgcagcctggaacccctgtgctcaagtgacctttctttctttttgaaattcctacttattcttctaagctccacctctaacaacccctctgaaaggtctcgaatttcccctctcctgtttcaatctagcgctccactctstgtcccatccgtggccctgggagtatcagggctggttctgctttttcttcaaatccctgttcccttgtctcctcctttgagaagcctttgctgaccccctaggcacgcgtccccctctgagatccccctggccctgtgtctcttccccaaccacagtgggctggagtctctcttcccgactctgtcttcccctccagactggcttggggctggggccagcgtggagcgcgatcatatttgcagagtgaatcactgtgcttctagtccctctgttagcacccctgagccacccttgtccct

SEQ ID NO: 29556 - DNA, 601 bp, Human
aagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaaggtgggggccgggacccttgggatggtgggggagaaggacagtgaagtggggacagtggggcccctattgagtcagccccagccgcctgaacgccgagtcccgggcaggaattttcctcttggctgccagcccrgactggagggaaggaaggcggccgattggcctgggagtcccccgaggcgaaggcgggggcagggtggggaggtggggaggtccgtggcgtttgtctgctgcttctcgggatgctgggagaaaacctgctggtggaattcagggctggcctgagggctggtgacaccatccctggggactccccgagtttctctctccatcctgctgatgggactctgggagccgccctgcatgtcttgctttcttgggtttttggattttaatataccttagcacccttggtttatacctttgatttata

SEQ ID NO: 29557 - DNA, 601 bp, Human
atttaaatggtactcaaagatctccccaataatcccaaggccccgacggttttacaggtgattcctaccacacttagttacttcttggccaggtgcagtggcctgtgcctgcaatcccagcattttgggaggttgaggcaggaggatcatctgagcctaggagtttgagacctgcctgggcaacagagtgagaccccatttctagcaaaaataaaaaaattagctgggtgtggtggtttgtgtctgtagtcccagccacttgggaggctgaggtgggaggatggcttaagcctgggaaatkgagactacagtgagctgtgactgcaccacttgcacttcagcctgggtgtcagagtgagaccctgtctcaaaaagaaaaaaagaaacagttacttcttgtcttatacaagtcattccagcaaacagaaaaagtgtgaaagctgtcaacctctttaggctgaagaatcctgattcccaaatctgtggccaagaattcaataagataaaattaagggctcattttaccttatttatgatcatagaggcaaaatcctagccaagcaaatccagtgtttaaaaaataatacatcactttgggagg

SEQ ID NO: 29558 - DNA, 601 bp, Human
agcaaatccagtgtttaaaaaataatacatcactttgggaggccaaggagggcagatcacgtgaggtcaggagttcgagaccagcctgaccaacatggtgaaaccccgtctctactaaaaatacaaaaactagctgggcattgtggcacgcgcctgtaattccagctactcgggaggctgaggtgggagaatcgcttgaacctgggaggcggaggttgcagtgagtcaagactgcaccactgcactccagcctgggtaacacagcgagtctctacctcaaataataataataataataatacattagccgagcacagtggctcatgcctataagcccagcactttgggaggctgggtagaaggatcactcacttgagcctaggagttcaaggccagcctgggcaacgtagtaaaaccccatctcttagaagaagaagaagaaaaacccaagtaaatttttttaaaaactaaaaaaaaaaaatccaccattggttgggttttatcccaataatgcaaagatagttcaatatcaaaaaatgtatccatctagttcaccacattaattggctaaaagaaaagcagcatatggttatctatttaa

SEQ ID NO: 29559 - DNA, 601 bp, Human
tgagaccagcttggccaacatatggaaatcctgtctctactaaaaatataaaaattagccaggcgtggtggcgtgtgcctgtagtcccagctactccagaggctgaggcacgagaatcacttgatcccgggaggcacaggttgctgtgagccgagattgcgccactgcattccagcctgggcgacagagtgagactgtgtctcaaaaaaagataaaaaataactggaaggaagttgagctcagatctggtcttttccaaaggtccattatagtcgtgactacctgtatatatagacatagrggagacagggatgagaaactgatgataatgataacagtatttattagtcacttactgcattctaggcactattcgaaacagtgtacatggatttattcgaattttcaaggtttcctgagagattgtatgcagacttaagatctgtcttgtttagtgttatatttatctttatttattttttcccctgcccccccttctttttttattttttaaaaattattttgattttttactagagacaaagtctcacaccattgcccaggctggtcttgaactcctggcctcaagtgatccttccac

SEQ ID NO: 29560 - DNA, 601 bp, Human
atccttaaccattgtcctgccttgctatttgctccttgatgcaaaacccctgttttttgcttgttaaatcacatggagcccggtgctgtggctcatgcctgtaatcccagcactttgggaggctgagccaggaggatcccttgaactcagcctgggcaacatagccagaccccatctctactaaaaatttttgaaaaatcaggcgagtgtggtgatgcgggtctatagtcccagttactcaggaggctgaggcaggagtatcacttgagcccgggaggttaaggttgcagtgagccatgaytgcaccactgcacaccagcctggggaaagagtcagaatgagaccctgactcaaacaaaacaaaacaacagcaacaaaaaaactcacacggaagtatgttttcctgtctatcctgtctcccttgtcatagggaagccctaaagaaaatgaaggatgtctatgagaagacacctcagatgggggaccccgccagcttggagccccagatcgctgaaaccctgagcaacattgaacggctgaaattggaagtgcagaagtatgaggtcaggaaagaccctggggaggggcgggagccagcggg

SEQ ID NO: 29561 - DNA, 601 bp, Human
cctgggcgagagcgaggctctgtctcaaaaataaaaaataaaaataataaattttgcctaaagcagatctgggcccacccccacccccatcacagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggrgccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaaca

SEQ ID NO: 29562 - DNA, 601 bp, Human
tgggcgagagcgaggctctgtctcaaaaataaaaaataaaaataataaattttgcctaaagcagatctgggcccacccccacccccatcacagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagycccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacacc

SEQ ID NO: 29563 - DNA, 601 bp, Human
aggctctgtctcaaaaataaaaaataaaaataataaattttgcctaaagcagatctgggcccacccccacccccatcacagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctakgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttaca

SEQ ID NO: 29564 - DNA, 601 bp, Human
atcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttacaggccacacagggaatgaggaaggggaggtgatcttgggcacaccttgggtcaaccctgcccctttctggaagttggcctatgtcattgtcagtgggtgtctgcttgtgactcargtagggagaaggataccaagtttcttttttttttctttttgagacagtctcacccagttgcccaggctggagtgcagtggcgtacgtgatctcagctcactgcagactccatctcccgagttcaagcaattctgcctcagcctcccaagtagctgggattacaggcacacaccatcatgcccagctaatttttgtattttttgtagagacagggttttgccatgttggccaggctggtcttgaactcctgacctcaagtgatccatctgcctcggcctcctaaagtgctgggattatggc

SEQ ID NO: 29565 - DNA, 601 bp, Human
agcctcccaagtagctaggattacaggcgtgtgccaccatgcccagctaattttctttttgtcttttttagtagagacggggtttcaccatgttggccaggctggtctcaaactcctaacctcaagtgatccaggtgcctcggcctcccaaagtgctgggattactggtgtgagccactatgcctggcccagacatttttttgttttttttaatgaaatgaaattaaaaatatcaaagaacactgtagtaagggtgttgctttgtgaaacttttatcacacaaaatctttgtgtgtgctgrgtcatcaaaatggcaaacgtaggccagacatttgctcacacctgtaatcccaacactttgggaggccaaggtggaaggattgcttggggctaggagtttgagaccatcctgcatgacatggcaaggccccatctctataaaaaaaaaattttttttaaataaataaggcaaatgtattcatggtgggtggtagtcaaaaaagtttgagatgttgacccagggaacaagatctaataatctgcccaaacccaactcctacctcctctccacgctctattccatccccgttctggactcacc

SEQ ID NO: 29566 - DNA, 601 bp, Human
caaagtgctgggattactggtgtgagccactatgcctggcccagacatttttttgttttttttaatgaaatgaaattaaaaatatcaaagaacactgtagtaagggtgttgctttgtgaaacttttatcacacaaaatctttgtgtgtgctgagtcatcaaaatggcaaacgtaggccagacatttgctcacacctgtaatcccaacactttgggaggccaaggtggaaggattgcttggggctaggagtttgagaccatcctgcatgacatggcaaggccccatctctataaaaaaaaawttttttttaaataaataaggcaaatgtattcatggtgggtggtagtcaaaaaagtttgagatgttgacccagggaacaagatctaataatctgcccaaacccaactcctacctcctctccacgctctattccatccccgttctggactcacctctgctctgtcctttgcctaggtcccctgcctgtgcccttcaccaatggggagatacagaaggtaagggcgggtcccctgtctctttggatttcaatccttggggtgcatgagacagatcagaaggtgctgtggttggtaggatagcc

SEQ ID NO: 29567 - DNA, 601 bp, Human
ccttccctgggcagaagggaaagggggtgaggcccggggaagagatggtggggctgggcgccagctgaagccatggaggaacccaggaaggggctgggtgccaagctgacgccccagccaaagccttcgctctgggacaggccgactcagtcaggccacagagcaggaactctgcagggtctgcttaaaggttccccttccctaggagctcctgccagggtacttggcaagggggagggcccttggacccagccctcaaccttctttcacctcatctttggatctagaactttccatccaycttcttctttcaaggccctcctttgctgcttcagggttagggtttcaggattcctggggtcaaatcctggcaaacagtcaggtggaccacatgagattcagggagcaccacatgggctccccatgcccccatgtgtccccacattccaagaagcccctccctggtcactggcccaaaaggcaagccagtacctaaaagccacattggagtggcccagggagagggagcggttcagctaatcccatgatggtctgttcccatcccatccctccagcctgagcagtagaaccagcctgccct

SEQ ID NO: 29568 - DNA, 601 bp, Human
gacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaycctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaacccttcagcctccgtgtgttcct

SEQ ID NO: 29569 - DNA, 601 bp, Human
ccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcrgtgatccggggccgctcccgggcgcgccctcggctccaggtgagcggaggaaccgggcagaaccgagggtgggcgttacttaggaggaggaggctgggagggagattggggcgcatccgctcactccgcttcccctcgcaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggccc

SEQ ID NO: 29570 - DNA, 601 bp, Human
ggccgactccccagacccctcgaaggtgcggggacccccagcggaagcgagagggagcgaaatcgaggaacgagtgacagccggacagtccgccgggcggtgatccggggccgctcccgggcgcgccctcggctccaggtgagcggaggaaccgggcagaaccgagggtgggcgttacttaggaggaggaggctgggagggagattggggcgcatccgctcactccgcttcccctcgcaggtcctacccggagccgctgccatgggagagccagccttgggcgctggggaccagccgccgygcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgc

SEQ ID NO: 29571 - DNA, 601 bp, Human
acacacccctaagaaaaggcaagacttgaacgttctgaccaggtgcccctcttcttctttgccttctcttgtcctctttctcctatttcttaccctgtcctccacctgccttccattttgaagtgggatgttaatgaaatcaagttccagtaacccaaatcttgtttacaaaatattcgtggtatctgtgaacatgttaagagtaatttggatgtgggggtgggggtggagaaaggggaagtggtccagaaacaaaaagccccattgggcatgataagccgaggaggcattcttctaaagyagacttttgtgtaaaaagcaaaggttacatgtgagtattaataaagaagataataaataatattctttttaatatttgcctccattactttggattcacctgtgttacttgtcctcagcttcagatagaatctccttcccctccctcgtttccatttttccagtctctttcctgaaaggcagctaaactgggtgggagcaatttttgcctccttggtaataacctgggggatgttttctcacatgtaaatctcagcctgttaggtgtccaggagtgaaacacatctttgtattctaaagg

SEQ ID NO: 29572 - DNA, 601 bp, Human
tgtatctaccagcaagtgcctgcctgcagggccacctctggatgagtggggaggccaggtttgcccctcaacctgtctagctttttcacagggtggatgttttacacctctggtattcttccagtctgaactcaatcccatcccccaaccaattaggcaggttgtaaatgactgctgggtgcttgatgaaccaatctgcctgagttaggaactcttcctaacccacataaagtatttgaccctacctgaccatttactgcatgacccccatgcttagcctctctggaccagtttctggtcwgtcatacctcaccggcgcaatacgaagattcaatgaatgaaaacgtaagtagtttgtgccctttctatgtgggatgactgaaaggagcttaccaagccatgatgactttggaacatgactatagtttgtttgattcttatatcaatcctgtgagacaggcaggtctcacactatcaacaccaatttacagattagaaaactgagactgagagtggttaagggactttgccaagtctgtcaattcttgactgacagagctggaaccaggtctctaaactcccaatacagtaattcctgtct

SEQ ID NO: 29573 - DNA, 601 bp, Human
gagatcatgccactgtactccagcctgggtgacagagaggattctgtctcaaaaaaaaaacaacaaaaaacctgctttaacaatacgttatgggctgggcacagtggctcatgcctgtaatcccagtactttgggaggccggggtgggtggactgcttgctgggcaacagagcaaaatcccatctctacagaaaaattagccaggcatggtggcacatgccagtggtcccagctactcgggtagctgaggcaggaggatcacttgagcccaggaggtcaaggttgcaatgaaccctgatcrtaccactgcactccagcctgggcaacagagccagaccctagccaaaaaaaaaaaaaaaaaaaaaaatcaaaactatttattatgaacattttctcctatttcatttagtattcaaataccaatggctgccaattacgccactgtatgtatataccataagatatatcacgaatcccttactgttagacattttgatttgccactttatcactgttatacatggagcgatgctcccagcttgagtttaagaagaattcagacctgccaggagcctctgtaaagagcctaggggaggccaga

SEQ ID NO: 29574 - DNA, 601 bp, Human
aatgaaccctgatcgtaccactgcactccagcctgggcaacagagccagaccctagccaaaaaaaaaaaaaaaaaaaaaaatcaaaactatttattatgaacattttctcctatttcatttagtattcaaataccaatggctgccaattacgccactgtatgtatataccataagatatatcacgaatcccttactgttagacattttgatttgccactttatcactgttatacatggagcgatgctcccagcttgagtttaagaagaattcagacctgccaggagcctctgtaaagagcctaggggaggccagacgccgtggctcacgcctgtaatcctaacactttgggaggccgagacaggcagattgtctgagctcaggagtttgagaccagccagggcaacacggcgaaaccccgtctctactaaaatacaaaaaagtagccgggcgtggtggtgggcacctgtagtcccagctactcgggaggctgaggcaggagaattgcttgaacccgggaggcggaggttgcagtgatccaagatcgcaccactgcactccagcctgggtgacagagcgagactccgtctccaaaaaaaaaa

SEQ ID NO: 29575 - DNA, 601 bp, Human
atgtagtttcgctcttgttgcccaggctggagtgcaacggtgcgatctcagatcactgcaccctccacctcctgggttcaagtgatttttctgcatcacactcccgagtagctgggattacaggcatgggccaccatgcccagctaattttgtatttttagtagacacggggtttcgccatgttggtcaggctgatcttgaattcctgacctcaggtgatccacccgccttggccttccatagtgctgggatcacaggcgtgagccaccatgcccggcccatattttctaaattttctacmgtaaacctttgtacctaataagaggcactttgctaggtactgagagtgcagtgttgagcacatattaattatcttgtttcttcaatagtgcattcgtttttgtattttattatttctgtcctacttcatttatggttttattcttttccttccttccttccttcctccctccctccctctttctgtctgtctgtctgtctttctttctttctttttactgttattttatggtttttttttgagacggagtttcgctcttattgcccaggctggagtacaatggtgcaatctcggctcacc

SEQ ID NO: 29576 - DNA, 601 bp, Human
ctcctgcctcagcgtcccaagtagctgggatcacaggcacacgccaccacgcctggctaattttgtatttttagtacagacagggtttccccatgttggtcaggctggtctcgaactcccgacctcaggtgatcgcccacctcagcctcccaaagtgctgggattacaggtgtgagccatcgcacccagcctatttatttattatttatttttattttttgagacagagtcttgctctgtcacccaggctggagtgcagtggagcgatctcggctcaccacaacctccacctcctgggttsaagcaattctcctgtctcagtctcctgagtagctgggactataggggcccgccacttcgcccggctaatttttgtatttttagtagagactgggtttcgccatgtttggccaggccagtctcgaacttctggcctcaagtgatccacccggcttggcctcccaaagtgctgggattacaggcgggagtcaccgcacccagcctgttcttctttaaatctctttaacttgaaaggttagctttgttttcattttcaatctttaaaaaaaaaatactttaatactattaattttccttgaag

SEQ ID NO: 29577 - DNA, 601 bp, Human
gttcaaacgattctcctgcctcagcctcccaggtagctgggattacaggcaggtgccaccacgcctggctaattttgtattttttagtagagacgaagtttcaccatgttggtcaggctggtctcgaactcctgacctcaggtgatcctcccacctcaacctcccaaagtggtgagattacgggtgtgggccactgtgccctgccgtgtatggggcctttttattgttaatttataatttaattactttgtggtcagtgaatggttttcgtaacactgatcttttttttttttttttttttgagacagagtctcgctctgttgcccaggctggagtgtagtggtaagatctcagctcactgaaacctctgcctcctgggttcaagtgattctcctgcctcagcctcctgcgtagctgggattacagacaggccggcaccaccaagcctggctaattgttttgtattttcagtagagatggggtttcactatgttggccaggctggtcttgaactcctgacctggtgatctgcacaactcagcctcccaaagtgataggattacaaacatgagacaccgtgccctgcccaaagctgatatat

SEQ ID NO: 29578 - DNA, 601 bp, Human
gcaggggccatgacaggaggccaatccagagaggttcgtgggttacaggaagaagacagataaggctatagcatgaagcatattagttcgaggaaggatttaaggtgcggaggccagatctgaaagtaatgaaacaactccagtgcaactgtttcataactggttctctttgattcttctagaaagccatgtcctgccaccgcagccagctcctctggttccgccgcctctacattatcttctcccggtacatgagaatcaactcactgagcttcctctgaagccttgaagggttttcagrtccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccct

SEQ ID NO: 29579 - DNA, 601 bp, Human
agccctgggcaagcacagcacctacaactgcgagtacatcaaaggtaggagggcaagcgctggtcggcacctgtgcggaaggtggaccttccacatccaccagggactttggcaaaccgaagcccctatctcctgtgtcccagggatacataaatacaagtcatatccaccagctcccaaccccttccatctaaggggagacataaccttctgaggggtgcacttactgcccctgaagggatctaagccatagttcgccacttgcctgctgggaggctgaagaggtttcctggccaacgcrgcggtctctggccatttgagtgggcaagcagacccggtcgggcttttctcctggtcagaggctggaagggaattattttccagccagattattgacacctagatagctgttgccagaaatgagtaggagtcccaccctcagtttctgagaacagtgcatttatgagatggaagaggaattatgtgctgaagggtgtgctgggtggggtggtgggggcaaggagacagcagttgggtgctgtgcccctaaggtccagctcaggctgtggtcaggaagtggtggatgctcctcctgttcatg

SEQ ID NO: 29580 - DNA, 601 bp, Human
ccatcacctcgatctttttttttttttttttttttgagacagagtttcactcttgttgcccaggctggagtgcaatggcacaatctcggctcactgcaacctccacttcccgggttcaagccattctcctgcctcagcctcttgattacagctgggattacaggcgcatgccaccaagcccggctaattttttgtatttttagtagagatggggtttcaccatgttggccaggctggtcttgaactcctgacctcaggtgatccatccacctcggcctcccaaagtgctgggattacaggygtcagccaccgtgcccggcccacctgaatcttttataaggaaacaactgcattaataataaaaaaaagtgcactagctgaagtggcaccttgggggttgccagccttagccaggagatgagtgtgtgggagagcagatggttgagggagcagggacacctgctctccagcctggatctgcctatcccttgcaggaaaaggccactgatcaggcccctgagagattcaggctgcactgaggtgagggacagaagggctgctccccacaaagtcctcctttggtccttctctgcctcccagt

SEQ ID NO: 29581 - DNA, 601 bp, Human
cattctcctgcctcagcctcttgattacagctgggattacaggcgcatgccaccaagcccggctaattttttgtatttttagtagagatggggtttcaccatgttggccaggctggtcttgaactcctgacctcaggtgatccatccacctcggcctcccaaagtgctgggattacaggcgtcagccaccgtgcccggcccacctgaatcttttataaggaaacaactgcattaataataaaaaaaagtgcactagctgaagtggcaccttgggggttgccagccttagccaggagatgastgtgtgggagagcagatggttgagggagcagggacacctgctctccagcctggatctgcctatcccttgcaggaaaaggccactgatcaggcccctgagagattcaggctgcactgaggtgagggacagaagggctgctccccacaaagtcctcctttggtccttctctgcctcccagtgcagaacccactgtctctgttactgccctcagggctccctcaaacccacctttgaaggccatgaggccaggcttttggtgctggaggcctgggctctagtccaggctctgctctaactttc

SEQ ID NO: 29582 - DNA, 601 bp, Human
tcctttgtccttcagaactctgtgagtgggcaggaaggaccccccagcttcctctgatccactccaggcacatcatgccattcatcctcaccacaccccagtggtactgtcatcacctctgttctgcagatgaaagtaccaaagcacaaaggggcaaagagaggccgggtgtggtggctcacgcctgtaatcccagcactttgggaggccaagatgggcagatcacctgaggtcaggagttcgagaccagcctgaccaacatggagaaaccccgtctctactaaaaatacaaaattagccrggcgtggtggcgcatgcctgtaatcccagctactcgggagactgaggcaggagaatctcttgaacctgggaggcggaggttgctgtgagccatgattgtgccattgcactccagcctgggcaacaagagcgaaactctgtctcaaaacaaaacaaaacaaaaacaaaaaaaatcaaaggtgcagaggagaagcaactggccctgtgccacccagctactaagaagtggagtccagagagcctggctcaagagccaaactctgaaccaccacaccaggatagttcccacccctccccagac

SEQ ID NO: 29583 - DNA, 601 bp, Human
tgccattcatcctcaccacaccccagtggtactgtcatcacctctgttctgcagatgaaagtaccaaagcacaaaggggcaaagagaggccgggtgtggtggctcacgcctgtaatcccagcactttgggaggccaagatgggcagatcacctgaggtcaggagttcgagaccagcctgaccaacatggagaaaccccgtctctactaaaaatacaaaattagccgggcgtggtggcgcatgcctgtaatcccagctactcgggagactgaggcaggagaatctcttgaacctgggaggcrgaggttgctgtgagccatgattgtgccattgcactccagcctgggcaacaagagcgaaactctgtctcaaaacaaaacaaaacaaaaacaaaaaaaatcaaaggtgcagaggagaagcaactggccctgtgccacccagctactaagaagtggagtccagagagcctggctcaagagccaaactctgaaccaccacaccaggatagttcccacccctccccagacatcatctcatctcatcatctcatctcatctcatcatctcatctcatctcatctcatctcatctcatctcatctca

SEQ ID NO: 29584 - DNA, 601 bp, Human
aggttgctgtgagccatgattgtgccattgcactccagcctgggcaacaagagcgaaactctgtctcaaaacaaaacaaaacaaaaacaaaaaaaatcaaaggtgcagaggagaagcaactggccctgtgccacccagctactaagaagtggagtccagagagcctggctcaagagccaaactctgaaccaccacaccaggatagttcccacccctccccagacatcatctcatctcatcatctcatctcatctcatcatctcatctcatctcatctcatctcatctcatctcatctcattatctcatctcatcatctcatctcatctcatctcatctcatctcatctcatctcatctcatctcatctcatcatcatctcatctcatctttactgcacagtaatctatgggaaggaggcagaacaggaggcattaccccccttatatggtcaagtgagacccagagacaaattatttgctcaaggtgacaatgagtttatggcagagccaggacaagaagccaggtttccagcttccaacccaggcatctttgagttctgattatgtaattccagatactggaaaagtttaggatttctcc

SEQ ID NO: 29585 - DNA, 601 bp, Human
ccatgattgtgccattgcactccagcctgggcaacaagagcgaaactctgtctcaaaacaaaacaaaacaaaaacaaaaaaaatcaaaggtgcagaggagaagcaactggccctgtgccacccagctactaagaagtggagtccagagagcctggctcaagagccaaactctgaaccaccacaccaggatagttcccacccctccccagacatcatctcatctcatcatctcatctcatctcatcatctcatctcatctcatctcatctcatctcatctcatctcatcatctcatctcattatctcatctcatctcatctcatctcatctcatctcatctcatctcatctcatctcatcatcatctcatctcatctttactgcacagtaatctatgggaaggaggcagaacaggaggcattaccccccttatatggtcaagtgagacccagagacaaattatttgctcaaggtgacaatgagtttatggcagagccaggacaagaagccaggtttccagcttccaacccaggcatctttgagttctgattatgtaattccagatactggaaaagtttaggatttctccttctagtccactc

SEQ ID NO: 29586 - DNA, 601 bp, Human
gggcaacaagagcgaaactctgtctcaaaacaaaacaaaacaaaaacaaaaaaaatcaaaggtgcagaggagaagcaactggccctgtgccacccagctactaagaagtggagtccagagagcctggctcaagagccaaactctgaaccaccacaccaggatagttcccacccctccccagacatcatctcatctcatcatctcatctcatctcatcatctcatctcatctcatctcatctcatctcatctcatctcatcatctcatctcatcatctcatctcatctcatctcatctcatatcatctcatctcatctcatctcatctcatcatcatctcatctcatctttactgcacagtaatctatgggaaggaggcagaacaggaggcattaccccccttatatggtcaagtgagacccagagacaaattatttgctcaaggtgacaatgagtttatggcagagccaggacaagaagccaggtttccagcttccaacccaggcatctttgagttctgattatgtaattccagatactggaaaagtttaggatttctccttctagtccactccacacctctcctaccagggtttgggtag

SEQ ID NO: 29587 - DNA, 601 bp, Human
gcaacaagagcgaaactctgtctcaaaacaaaacaaaacaaaaacaaaaaaaatcaaaggtgcagaggagaagcaactggccctgtgccacccagctactaagaagtggagtccagagagcctggctcaagagccaaactctgaaccaccacaccaggatagttcccacccctccccagacatcatctcatctcatcatctcatctcatctcatcatctcatctcatctcatctcatctcatctcatctcatctcatcatctcatctcatcatctcatctcatctcatctcatctcatcttatctcatctcatctcatctcatctcatcatcatctcatctcatctttactgcacagtaatctatgggaaggaggcagaacaggaggcattaccccccttatatggtcaagtgagacccagagacaaattatttgctcaaggtgacaatgagtttatggcagagccaggacaagaagccaggtttccagcttccaacccaggcatctttgagttctgattatgtaattccagatactggaaaagtttaggatttctccttctagtccactccacacctctcctaccagggtttgggtagag

SEQ ID NO: 29588 - DNA, 601 bp, Human
agcgaaactctgtctcaaaacaaaacaaaacaaaaacaaaaaaaatcaaaggtgcagaggagaagcaactggccctgtgccacccagctactaagaagtggagtccagagagcctggctcaagagccaaactctgaaccaccacaccaggatagttcccacccctccccagacatcatctcatctcatcatctcatctcatctcatcatctcatctcatctcatctcatctcatctcatctcatctcatcatctcatctcatcatctcatctcatctcatctcatctcatctcatctcatatcatctcatctcatctcatcatcatctcatctcatctttactgcacagtaatctatgggaaggaggcagaacaggaggcattaccccccttatatggtcaagtgagacccagagacaaattatttgctcaaggtgacaatgagtttatggcagagccaggacaagaagccaggtttccagcttccaacccaggcatctttgagttctgattatgtaattccagatactggaaaagtttaggatttctccttctagtccactccacacctctcctaccagggtttgggtagaggagccaag

SEQ ID NO: 29589 - DNA, 601 bp, Human
cgaaactctgtctcaaaacaaaacaaaacaaaaacaaaaaaaatcaaaggtgcagaggagaagcaactggccctgtgccacccagctactaagaagtggagtccagagagcctggctcaagagccaaactctgaaccaccacaccaggatagttcccacccctccccagacatcatctcatctcatcatctcatctcatctcatcatctcatctcatctcatctcatctcatctcatctcatctcatcatctcatctcatcatctcatctcatctcatctcatctcatctcatctcatcttatctcatctcatctcatcatcatctcatctcatctttactgcacagtaatctatgggaaggaggcagaacaggaggcattaccccccttatatggtcaagtgagacccagagacaaattatttgctcaaggtgacaatgagtttatggcagagccaggacaagaagccaggtttccagcttccaacccaggcatctttgagttctgattatgtaattccagatactggaaaagtttaggatttctccttctagtccactccacacctctcctaccagggtttgggtagaggagccaagtt

SEQ ID NO: 29590 - DNA, 601 bp, Human
aacaaaacaaaacaaaaacaaaaaaaatcaaaggtgcagaggagaagcaactggccctgtgccacccagctactaagaagtggagtccagagagcctggctcaagagccaaactctgaaccaccacaccaggatagttcccacccctccccagacatcatctcatctcatcatctcatctcatctcatcatctcatctcatctcatctcatctcatctcatctcatctcatcatctcatctcatcatctcatctcatctcatctcatctcatctcatctcatctcatctcatctcatctcttcatcatctcatctcatctttactgcacagtaatctatgggaaggaggcagaacaggaggcattaccccccttatatggtcaagtgagacccagagacaaattatttgctcaaggtgacaatgagtttatggcagagccaggacaagaagccaggtttccagcttccaacccaggcatctttgagttctgattatgtaattccagatactggaaaagtttaggatttctccttctagtccactccacacctctcctaccagggtttgggtagaggagccaagttcagccacagcagatcc

SEQ ID NO: 29591 - DNA, 601 bp, Human
aaaacaaaacaaaaacaaaaaaaatcaaaggtgcagaggagaagcaactggccctgtgccacccagctactaagaagtggagtccagagagcctggctcaagagccaaactctgaaccaccacaccaggatagttcccacccctccccagacatcatctcatctcatcatctcatctcatctcatcatctcatctcatctcatctcatctcatctcatctcatctcatcatctcatctcatcatctcatctcatctcatctcatctcatctcatctcatctcatctcatctcatctcatcctcatctcatctcatctttactgcacagtaatctatgggaaggaggcagaacaggaggcattaccccccttatatggtcaagtgagacccagagacaaattatttgctcaaggtgacaatgagtttatggcagagccaggacaagaagccaggtttccagcttccaacccaggcatctttgagttctgattatgtaattccagatactggaaaagtttaggatttctccttctagtccactccacacctctcctaccagggtttgggtagaggagccaagttcagccacagcagatcccac

SEQ ID NO: 29592 - DNA, 601 bp, Human
ctcatctcatctcatctcatctcatctcatcatcatctcatctcatctttactgcacagtaatctatgggaaggaggcagaacaggaggcattaccccccttatatggtcaagtgagacccagagacaaattatttgctcaaggtgacaatgagtttatggcagagccaggacaagaagccaggtttccagcttccaacccaggcatctttgagttctgattatgtaattccagatactggaaaagtttaggatttctccttctagtccactccacacctctcctaccagggtttgggtaraggagccaagttcagccacagcagatcccactctgatcttaaatccatgtttcatcccactctgcagcaccttatttgtggcaatagaaggcagttaagttagacccaatgacctctggaagagaaactgggactctaattggtctcatctctgtctaccttcctaaattctttattaaaaaaatttttttttgagacgtggtctcagtctgtcacccaggttggagtgcagtggcaccaccacagctcactgtagcctcaaactcttgggctcaagcgatcctcccacctcagcctccc

SEQ ID NO: 29593 - DNA, 601 bp, Human
ttccagcttccaacccaggcatctttgagttctgattatgtaattccagatactggaaaagtttaggatttctccttctagtccactccacacctctcctaccagggtttgggtagaggagccaagttcagccacagcagatcccactctgatcttaaatccatgtttcatcccactctgcagcaccttatttgtggcaatagaaggcagttaagttagacccaatgacctctggaagagaaactgggactctaattggtctcatctctgtctaccttcctaaattctttattaaaaaaawttttttttgagacgtggtctcagtctgtcacccaggttggagtgcagtggcaccaccacagctcactgtagcctcaaactcttgggctcaagcgatcctcccacctcagcctcccaagtagcttggactacagatatatgccactacgcctggctactttttgtattttttgtagagaagggttctccctatgttgcccaggttgcctaaaattttttaagccagtcaaatttagcagtggggggactgtacatcaactttagtgacactggtgttaataagttctgataacccattacc

SEQ ID NO: 29594 - DNA, 601 bp, Human
ctccctaaacttgatcttcatctctgttgcccgtggcagttttgtgtatcagtctgtccagctcactctgccaatctctccaccttgtatctgcatgtccccacttttgctcctgtgctcctaaatacctctttttttctctctctctcccccaacctctctgcctgttttccctgcagccatgggtcagagccccctctctgcagtctggtctttgctgctgctgctctggttcctcgtggtgagggcctttccagatggtccaggcctcctttgatgcatgagacacgggacagcctcrcctgctgcctctgcccatcctgaggatgttggccatgtgtgctttcagtgtaaccaagattcctgtcaatcccatctgcagggaactctgggaccttctctggtagctgccagaccggctggtggagaaacaggagacaatctggggactgaaccttacccagggctgtaggagtgagactctgaataaagggttgggccggcggtgtggcgggtacttcaagacaggcagcaactaacctggcgatagaagggcttcagctgatttgggggatgactggagaggaaagcgcttggccgt

SEQ ID NO: 29595 - DNA, 601 bp, Human
cagagactagagcaacgctgctgcaagccaaggtggctggcaaccaccagaccccggagaaggcaggaaaggtcctccctaggagctcagagagagtgaggccctgctggcaccttgactttggacttctggcctccacagctgtaagcgtaaatctctattcttataagcccaccaccgttggtggcagtttgttacagcagccccaggacacccacacgccacatagacaaggaggtgctcttgcggccagggccaggttgactgctgagcctggcccataggcacaggaccatggccmccagcaacccatggccgaccccgatgctgtgcaggctgatactcactggtggtgcttccagacatctgaatgatgcacttggagtcacggctcatttcccgggaattgaaggggcggacccgcaccgccaccttcaccgaagccccggccatctctgtggccttcgtgggtcactcctcgcagtagtgggagccccagtgtggggggaacaccttggaaaaaagggaaacatgaattagaaacaatatctgaggaggcaggacaggcactccggctgcagctgaagccacaggtcttttc

SEQ ID NO: 29596 - DNA, 601 bp, Human
caaccatggagttccccatgaccccacatgcaagactgaggtggcaattgtgctgccggcacccagtgggggatggaaggggattcacagggccctccctgatgtcctgggtcaccttacaatgacacagcaaagcctgttggagcgtggaacaggcgtcctctgcccaccccgggccacagtgctcaccagaggtcacggttcccacccggagtcgaaggtcacacccagagccatggttcgcacctgaggtcacatttcccacctgaggtcacatttccagactcacagctctgcgcakcctgaggcttccctcttaaaggcaagggtcctgccacctgagcactttctccgaccacaaaaggccagggctgcagtcagctaatgcagcgagcgttgttggaaaagcactggccttcctgggcaggacaaccggtaggtgcattgtgttcatccacgggccccggcaaggccagggccccggccacggaggtcacccacttacgaacgcacctttgtcagcttcccctcaaacttccccaatctcccacagtgcatcctgggaccacctcccaaataaactcttggtgctcaaatcctc

SEQ ID NO: 29597 - DNA, 601 bp, Human
ccacagacatttaatttagtttggtgatccccggaagatcggcatctcagaagaggttggtgtcttgcatatgttcatctttgagaaggggaggttccttcaggacctaccagttgcccaaaaaaagtgtaggggctcctgcatttccctcctgacctcctgggcttgcctagacttctgctcagagcttactggggagcagaggctgctggcacataggcgaaatcccagaactccaatgtcttcagggccagacgggatccaggcatttgaagcagggtgtctcgcttcaggtttcaaycccactggctaaaggaaacgtggctgcccacagatatggctccggcctctggctcctaagccgtggggtaaagctttggttcagcttttgttctccaggccagaggagagggtagagtgaagcaggcaaaaaccactggggcatgaggtctcgggtccaggcctgcactgctgtctctgaactggcagctctctgggtctgggccggcgcagcctcagccagaccacctttcaccagctgggcagtgctgccagtgtcgaggtcttggcaacgctggctcacctccaggctgtaccctcc

SEQ ID NO: 29598 - DNA, 601 bp, Human
cctccgtcaggcttccctgcgccaggcctaggggacatccttctctcctgagctccctcagcccttcactcagatttctgacgtagcttccagcactttcttccaaaaccaccactggtttgctttctccaaaatgaaaacagctttcctagagatttttcctgattattcattcttcggccactcttttccctcccccgcaccctgctgtctcccatgcacgtgcacatccagtgcacacaggacctgcagtgagtgcccatctgccctttacccacacacggcctcactcttgggctcygtgctgacctttgcccccttccccacaacatcgtgtggcactttctcacagctgtaaacacaaactttcaggagcactcaggtccgctgccgggatagacttaacatcccttcagcagctcccagctggcgggcatttgggcggttgccccgggcttggtaaaacagcaccaaggtgaacgtttcaaacgcacacctttgaccacttgctggataaccttcgttgcatttcacgcaagcagcctggtgaggtcggcctcacacgtctcatatccatcaccaggccgtccccagcaagcgg

SEQ ID NO: 29599 - DNA, 601 bp, Human
accagccagggcagccactcccaattctattgatctgagctgcagctgagaagtcaccagggacggtggctcctgtgagtgctcctggcaggtggacatccacccgcaccctctcatgccctgtctgcagtgtcctcctggggcttgtctgggggcaggtcagccctctggaacaccctggcccctcaacctccaggagaaaagcccatgacccccttcctccgtcaggcttccctgcgccaggcctaggggacatccttctctcctgagctccctcagcccttcactcagatttctgacrtagcttccagcactttcttccaaaaccaccactggtttgctttctccaaaatgaaaacagctttcctagagatttttcctgattattcattcttcggccactcttttccctcccccgcaccctgctgtctcccatgcacgtgcacatccagtgcacacaggacctgcagtgagtgcccatctgccctttacccacacacggcctcactcttgggctccgtgctgacctttgcccccttccccacaacatcgtgtggcactttctcacagctgtaaacacaaactttcaggagcactcagg

SEQ ID NO: 29600 - DNA, 601 bp, Human
gagaatccctcaggcctgcttgtcctgggcccccacccctcccaggcctgtgttgtggctgggacccccatcccaccctggccctgcctacacccccatcccaggccctgcactggggctgggacccccaccctaccctgccggcaaccccactcccaggccatgtattgtgtctgggagccccaccccaccctggccctgccacccctcccacaccctgtgctgtggctgggaaccatcctctgtcactacagatgggccccaagctccagagaggggaggtcctctcccccggtcacaygacgcacagccagactagaagccagggtccccgcaacacctcccagccctgaggtccgccaggcctgtggagacaggcagcccctccttcagcagcctgcttctcacagagacctccccgattctgctggagaaagggctttttttgccagggtctggaattttttccttgtgcaggtttgaggagggaggagggagaaacaggtcctcccagggcctgctgggctgggctcctcagccagcccctttagggcccccatcccctcccaccccaggctctggccaggcccccagagctggg

SEQ ID NO: 29601 - DNA, 601 bp, Human
cctccagaaccctagcacgatcaaccagcgctgtggaaacaattgcagcgccttccctagcacagcccggctgggcctcccagctctgacacagaggcctggggccccttgctcaagccagcaacacccaccgtgtccacctcatcccctcactccgccgcactctggccccatccccacaccccttcctgccccatccaccccctcgcctcacccggctgcactcaggtcgggctccccgcacaggcctggccccatccccacaccccttcctgccccatccaccccctcgcctcacccsgctgcactcaggtcgggctccccgcacaggcctggcccccatccccacacccccactagcccttgctccctgtcccacccttgcccagccctaggtgccaaccttgctcagatgaagccctgatgccacaccccacatgggccatgagctccatgaggtgggggccctctgggacagggcacagatggtgcccaaggaatgccaggtaggtgggggacagagggcagcacaggtgagtgggcgggagtggggctcagttgcagctgtaaatggcccttgggagaatccctcaggcctgct

SEQ ID NO: 29602 - DNA, 601 bp, Human
gcagagagaaggccaagctgtcccgacttcagcgcctgccgggacccaacagcacccgtggcgccgcctccagaaccctagcacgatcaaccagcgctgtggaaacaattgcagcgccttccctagcacagcccggctgggcctcccagctctgacacagaggcctggggccccttgctcaagccagcaacacccaccgtgtccacctcatcccctcactccgccgcactctggccccatccccacaccccttcctgccccatccaccccctcgcctcacccggctgcactcaggtcgggytccccgcacaggcctggccccatccccacaccccttcctgccccatccaccccctcgcctcaccccgctgcactcaggtcgggctccccgcacaggcctggcccccatccccacacccccactagcccttgctccctgtcccacccttgcccagccctaggtgccaaccttgctcagatgaagccctgatgccacaccccacatgggccatgagctccatgaggtgggggccctctgggacagggcacagatggtgcccaaggaatgccaggtaggtgggggacagagggcagcacaggt

SEQ ID NO: 29603 - DNA, 601 bp, Human
ctatggccaggagcagaggcagagagaaggccaagctgtcccgacttcagcgcctgccgggacccaacagcacccgtggcgccgcctccagaaccctagcacgatcaaccagcgctgtggaaacaattgcagcgccttccctagcacagcccggctgggcctcccagctctgacacagaggcctggggccccttgctcaagccagcaacacccaccgtgtccacctcatcccctcactccgccgcactctggccccatccccacaccccttcctgccccatccaccccctcgcctcacccsgctgcactcaggtcgggctccccgcacaggcctggccccatccccacaccccttcctgccccatccaccccctcgcctcaccccgctgcactcaggtcgggctccccgcacaggcctggcccccatccccacacccccactagcccttgctccctgtcccacccttgcccagccctaggtgccaaccttgctcagatgaagccctgatgccacaccccacatgggccatgagctccatgaggtgggggccctctgggacagggcacagatggtgcccaaggaatgccaggtaggtggggg

SEQ ID NO: 29604 - DNA, 601 bp, Human
tggccggaaggacaggacccgctgccccctggaacactgtctgaacccagaattggtgttgacagaggcctggaggcctgaggcagtcccctcccaggttctcacacccaggaggaacactggccattcctggtcagggagcccccggagaccaccaccatcacatcagcaaacctgaagaacgaagccctcatggcaccgtcctatgcttggagatgaaggctggagatgaggctgtgtctgccccggattggttttcctcagccagcgtgggctgggggccagcggcacagcctccagkatgcccgcaccctccgtgccagcatgcaccctggggacctgccaccaggaccacggagaacaaaatgccccagttacgagttaaactgtgtccccctaatttcatattttgaagtctttacccccagtatctcagaatgggacctcatttggagataaagttgctgcagatgtaattagttaagatgaggtcctactccatgaagacgggccctaatctagtgctgccatgtccttataaaagaggagatttggagacagggagggtgccatgagaacatgagggcagagatcagggtga

SEQ ID NO: 29605 - DNA, 601 bp, Human
ggacccagcacacccactgccaccttccatccttgcccccagcatttcccaggccctggacgggcctggaccctgcagactgcatgtcctcagtggccggaaggacaggacccgctgccccctggaacactgtctgaacccagaattggtgttgacagaggcctggaggcctgaggcagtcccctcccaggttctcacacccaggaggaacactggccattcctggtcagggagcccccggagaccaccaccatcacatcagcaaacctgaagaacgaagccctcatggcaccgtcctatkcttggagatgaaggctggagatgaggctgtgtctgccccggattggttttcctcagccagcgtgggctgggggccagcggcacagcctccagtatgcccgcaccctccgtgccagcatgcaccctggggacctgccaccaggaccacggagaacaaaatgccccagttacgagttaaactgtgtccccctaatttcatattttgaagtctttacccccagtatctcagaatgggacctcatttggagataaagttgctgcagatgtaattagttaagatgaggtcctactccatgaagac

SEQ ID NO: 29606 - DNA, 601 bp, Human
gactagctggcatctacactccaaggtggggagatggtcttaagaggcctcgggccccagacaagccaggcccccaaattggaggggacctaggaccccactcccaggcagatgagctgtctctgccccctccttatggtggacgctgccacccatggatgtccaagggtaccaccataccagcctgcaaggctctgtgtcattctcccgccaaatgcaactggctcccctcaaaggcagccacccggggaggatccttcccacctgcaagctgcggcccctccatctctggtgtccaccytgggctcacagcccctgccctgccccgccccctgctcaggcctttatgctccggctcagcgtgcacgtgcccgagaagcgctggaagcctgggcgtccatcacgtttgtgttacgcctgtgcggttcttctaggcttgctactccagacagagctctatgggactgtcttctgccagagtccctcctccccctccctcctccacccaacttcaagcccagtcccaggcaccctgggctggcttcaggcagtgctcacagaatatctgttcctcaaacccagaacaaatccatgaacacgt

SEQ ID NO: 29607 - DNA, 601 bp, Human
tcgccccagttagagaggaatgagcggctcagagaagttgagggaccccgagggccacatggcctatgcactgctgcccccgcctcccccgacccggggtcccggcttactgaggtgtgcgaccagtaggagtagtcaaagctgaagcttttgggcgtctccttgggctgtttggggttaacaatggctgtgggagggaacacaggtggttagcgctgtgctgggagggcccctgactagctggcatctacactccaaggtggggagatggtcttaagaggcctcgggccccagacaagcyaggcccccaaattggaggggacctaggaccccactcccaggcagatgagctgtctctgccccctccttatggtggacgctgccacccatggatgtccaagggtaccaccataccagcctgcaaggctctgtgtcattctcccgccaaatgcaactggctcccctcaaaggcagccacccggggaggatccttcccacctgcaagctgcggcccctccatctctggtgtccaccttgggctcacagcccctgccctgccccgccccctgctcaggcctttatgctccggctcagcgtgcac

SEQ ID NO: 29608 - DNA, 601 bp, Human
ggaggggaagggggaaagggctgtccactgtccaccctaccacggcccacacccgcggctctgggaagcccaaggagcccgccacacccctcaggagatggcatgggtctcggcagggtcctccagaacaggaagcccaaggctgctgagggtggcctggagttggtcctgatgccaccctgacctgccagggacctcagggaaggttcccaagactcagcacatgggatgtggcagcccagggcccacctccagcacggagtcacaatgacggccagggtgcgctgtgggcctcatcagkaacagcacccccacccaccagcccttgtggggccaccaaaggggtgcaggatggcgcagagtgtgactcacgacctcaggagctgagagtgacaagggccatcacctcaccctcaggaagtcccgggtggcagagggagtctgttgccatgacaaccagggcatcccaggcaggaggcccagggcagcagaggccaaggagccaggttgcttatggctgcagcactgcagccgaccctccccacatgccccctgaccccagcacactggcccccacacagaatgtggacccctgggacta

SEQ ID NO: 29609 - DNA, 601 bp, Human
ccgccctgctgggcctggcactgatggcgcctcctgccagaactccagcagggcccatggccacctgcccacagtggcgtcctcagccccagcccttgctggtatattcagggcagcagtgactgcgaaagcttcccactcctgggcacagagaagcccatgcagtgcccagctgggcaggagccctccagggccatgatatgggaggggaagggggaaagggctgtccactgtccaccctaccacggcccacacccgcggctctgggaagcccaaggagcccgccacacccctcaggagmtggcatgggtctcggcagggtcctccagaacaggaagcccaaggctgctgagggtggcctggagttggtcctgatgccaccctgacctgccagggacctcagggaaggttcccaagactcagcacatgggatgtggcagcccagggcccacctccagcacggagtcacaatgacggccagggtgcgctgtgggcctcatcaggaacagcacccccacccaccagcccttgtggggccaccaaaggggtgcaggatggcgcagagtgtgactcacgacctcaggagctgagagtgacaagg

SEQ ID NO: 29610 - DNA, 601 bp, Human
ctccagcaccatcagggactgagcagccctcactccacccagcccctttgcgctccccacacggctgcctgagcgagcccccaaccaggtggtggctgaggtgcccctgggcctggacagctggggcatgagggcaggggacagagtaagagatggtcagggagaggctgggtgccctcctgctgcccctcccgtaagcctggactggctgtccaggcaaaagccccagaagatggccccctggcctggtccatggagaatgccaaggcatgggagaagggcctctggggcggggggggggacgtccacacctggtgccagtgtaagtgtgaggacactacccgccctgcacaggccagcattgggcctgtccttgtgctgcccccactggcctgaccaccacccctaccctgaccaccagccactgcccttggtggcaccgcctgtgaggccactcactcaccttctccgtggtgatattggtctctgcgtcatggcgcttctgggtgaagatgatgttgaagacggcgtgggagcgactgctggtctcattcatgttggtggccgccacggtcctgaggagcagaaagccacgcacggt

SEQ ID NO: 29611 - DNA, 601 bp, Human
gggtccccgcatggcggcctggcccctaccttgaggcgcgtgcccttggctcccgtggagtcagcccgctcgctcccagccaggtccaccaggctgattttgctcacctgaaacagtagatacatcacatgcaggaaaggccacaagatgcgcgggggcatcccaggacccctgggcaaggtctccacagctgttgaaggagccctggccaagcgtcccctctgcaaggcgccgcccctccccaggcccagcagtcctgaccccgcagtttccacccgcacctccgtcccagctctcccarggccctgcccgagttgagtgcccagccacctccccaggggagcacgggcgctgccaccacacgctgggtggttttcacacaagggcgtactcgctccctatggcatccacgaggtgcgactgtcactgtccccacttccatagatggtgctcagtgtccgtggttggattagaacccagctccaggaggccctggccctgctcagccaccacacgggccatggctgcacctagcgaggtgggcaccggccaggctcccaacaggggcacccgcagtctggggtgggaggccctgcaccgg

SEQ ID NO: 29612 - DNA, 601 bp, Human
gcatgtgacactctggccatctccgggctctcccttgaacctggccacctcccagacacagggcccggaaacgagggtgacaggggcaggatggggcgccaaagaccctctggggttctggctatggaagccgggccgggccactcaccatttcagccagggcggagatgaccttgcccagggtggtcagcgacttgttgatgttggccccctcctgcgggcagaaaagacagtggggttgggatgctggggacccgtggggcctcctgctctggagggatgccctgggtggacctgtgcrgtgtggagtggaggccaccactgcagctgctgatctctggggccacttgggcgtggggtgccctggcagaaagccagctggagcctctggccaggagcatgtcccccagtgttgccctcagccccatgcaaaccctgatatcatcccatgtccccctgaaatgcttccgggtcccctgcccaagcatctagtgctgaggccagcaggggtcgaggaaacacactccttcccgaccccggcactgcttcccgggtggtgccccaatctccccagggaagacctggcctctgggcgcaaggt

SEQ ID NO: 29613 - DNA, 601 bp, Human
gtggtctcctagacagcagctcccccaggcagggtccctccagggccgcccttcccgggcccaggcctgggctgcctgctgcacggggccaactgtggccatagccccactttacaggcggggaaactgagggtcccgggagaaaccagggcccctaccccttctccagcatgtgacactctggccatctccgggctctcccttgaacctggccacctcccagacacagggcccggaaacgagggtgacaggggcaggatggggcgccaaagaccctctggggttctggctatggaagccrggccgggccactcaccatttcagccagggcggagatgaccttgcccagggtggtcagcgacttgttgatgttggccccctcctgcgggcagaaaagacagtggggttgggatgctggggacccgtggggcctcctgctctggagggatgccctgggtggacctgtgcagtgtggagtggaggccaccactgcagctgctgatctctggggccacttgggcgtggggtgccctggcagaaagccagctggagcctctggccaggagcatgtcccccagtgttgccctcagccccatgcaaa

SEQ ID NO: 29614 - DNA, 601 bp, Human
cagtctggtgccacggggccctgggctgcctgcagccccaaagcacacccccaaaggctccatggagggaatagaacagggcccatgcaggcccaggagcctcagaacagtctcttccagcctcacagagtccagggtatacccctcacaaagagtcgcccctggtcactggtgcttcctaattcaagcacgagaggatccatcccccaagaccagggagcgggaagcagagcttgtctccctggagaactcacctcagcgtgctaagggtctcatcgtagttgatgtctgcaggactcarggctgccaccatagctgtccttgagttaccgcctgtgggaagaagaccaggttgtgcccagagggggatctaggccccagggctatgtctgctccccccttccccccacatttacagatggggaggctgaggcccagagaggtaaactgagtcacaggcttaccccccccccacccccaccccatgaacacagacaacagcaaggacctggccttccttggctgctccttcatctctgaaccaggcaccgctattatttctcttttacttgtgtttttctcacatttggggccattttac

SEQ ID NO: 29615 - DNA, 601 bp, Human
cttaagcactggtggtgcacagtcgaaagaagggagagaccactgacccaaacaaccgagcagcctctagcatggctaggggcccaggctccccaccccaggtgcccaccctgcccataagacacacctatgtcccctctgctatctaaaaatccccagtggttaccccggccggcaggtgagtgtaaactgcttcgcccagcaggcacagctctcccagtctggtgccacggggccctgggctgcctgcagccccaaagcacacccccaaaggctccatggagggaatagaacagggccyatgcaggcccaggagcctcagaacagtctcttccagcctcacagagtccagggtatacccctcacaaagagtcgcccctggtcactggtgcttcctaattcaagcacgagaggatccatcccccaagaccagggagcgggaagcagagcttgtctccctggagaactcacctcagcgtgctaagggtctcatcgtagttgatgtctgcaggactcagggctgccaccatagctgtccttgagttaccgcctgtgggaagaagaccaggttgtgcccagagggggatctaggccccagggc

SEQ ID NO: 29616 - DNA, 601 bp, Human
aaaatgtgagcacatctatgtgtgcataggcttgtgctcacaccgtgtaccagccgatgcacatgtctacgtttccagctagtacatgaacctctattgggccacacgccctttgtttctcttaagcactggtggtgcacagtcgaaagaagggagagaccactgacccaaacaaccgagcagcctctagcatggctaggggcccaggctccccaccccaggtgcccaccctgcccataagacacacctatgtcccctctgctatctaaaaatccccagtggttaccccggccggcaggtcagtgtaaactgcttcgcccagcaggcacagctctcccagtctggtgccacggggccctgggctgcctgcagccccaaagcacacccccaaaggctccatggagggaatagaacagggcccatgcaggcccaggagcctcagaacagtctcttccagcctcacagagtccagggtatacccctcacaaagagtcgcccctggtcactggtgcttcctaattcaagcacgagaggatccatcccccaagaccagggagcgggaagcagagcttgtctccctggagaactcacctcagcgtgc

SEQ ID NO: 29617 - DNA, 601 bp, Human
agcacagcctggcacagagtgagaaatcgcccccatggcaagtcgctggggagggcatttggggccacaggccagagaagacttacaagggaggtcacccagttcccgctcgcccacttggggaaactgaggcccaggtgagaagggacagggtggtgtcctctcccccagtggtcccagggtagagggagaaagtccagtgggaaaatgtgagcacatctatgtgtgcataggcttgtgctcacaccgtgtaccagccgatgcacatgtctacgtttccagctagtacatgaacctctaytgggccacacgccctttgtttctcttaagcactggtggtgcacagtcgaaagaagggagagaccactgacccaaacaaccgagcagcctctagcatggctaggggcccaggctccccaccccaggtgcccaccctgcccataagacacacctatgtcccctctgctatctaaaaatccccagtggttaccccggccggcaggtgagtgtaaactgcttcgcccagcaggcacagctctcccagtctggtgccacggggccctgggctgcctgcagccccaaagcacacccccaaaggctc

SEQ ID NO: 29618 - DNA, 601 bp, Human
ctgtgaaagctgagcttctggcatttccagagttgagggcctgggcgtggggggtcaggtcagctggagaaatggcattgcagatggaggcctgagccaagagctggggacaggacagtccctccagccctcctggccctttggtgctgatatcctgaccttcgcaggcctttgggtgcacagggggtcagaggacctgatctcggccatgtttagcctgagaaggcctcagcgacaccctgactcccccgttgctttggtttctcatgtagaccatatgggtgggaaggagccaggagtstgggctcagaggcagacagaatcccacatctacgagcagggccctgtggctgagggagagcagtgctttctgccccccaaaaaggagaagaaagcagagcaggtaccctggggttcacccctccctgaccatgccaccctaggccctcatgctggctggggctggaagcagagatgcagagagcagcaaagggaatacacacatttgggtcctccaggcacagtgttggctatgggggagggaagcgtgggggagggggagagacagagaaacagaagaacaggtttgtctccagagggt

SEQ ID NO: 29619 - DNA, 601 bp, Human
cgagctgtggggccaggctgtgctaaccttcagcccactgacatggaaattggcccagagaccatcctggaggaggtgaacatgggaccctcatgagggaggcccttcccctccaccacgaggagctcacccaccagcctaggcctcatgcatccctaaggcccgggaggtggggctgtgacatctctgaagtgggtggtgccaggggtctcctagcggaagcgaacacacagcagagcagcagcaagcacgggaccacacggggtgtgggggaagtggagggcgccctgcagccaagctyggggaggcactgagccccatggagccagacccgaggccaggaggcacaaaggttgggtgggatttggcagtatccgctgtgaaagctgagcttctggcatttccagagttgagggcctgggcgtggggggtcaggtcagctggagaaatggcattgcagatggaggcctgagccaagagctggggacaggacagtccctccagccctcctggccctttggtgctgatatcctgaccttcgcaggcctttgggtgcacagggggtcagaggacctgatctcggccatgtttagcctgagaa

SEQ ID NO: 29620 - DNA, 601 bp, Human
gcaggtgtgaacacaggatggcctggagggagctcaggaacctgcaccacactcactgcccttctcagggggtataattctataggacgccagggaggaagctgctgtgacctgggactgtcgtcagtggaggggatgctgcggggtggggagggacgagactcctctccacccacagatgccatccagctcactgctccttgaacaagcacccactcacacaattaaagactcgacaggaagagtctcagtcctggacattcattcttggagcttcccttgtccaggcttggcatgggtrggggcacaggccatccagacacccaggtctagggtcctgcaggcgcatttcctgcccagcagctgagtgttgtgcagcccacagcctggggacccccaagtgaactggctgccttggctgctgtgggtggtctggagatagaccactgggcacctgggtggccacacgccagaggctcctgctgatgctccacaatggccctatgaggatgggctgtacccaggagggcagggtgcctctctaactcctccgagctccccactcccagagtctgacaccctgaagccccaggtggtgccc

SEQ ID NO: 29621 - DNA, 601 bp, Human
attctccacaaaaagcaaagtgtgactatgggtgagcttcacagccccagtgcctgggccagagccccaccgtgctcccctacttccaggagccccctctggctctacctgagacagcacctcacctggtcctgttcagatgagggcagtaccacagaactgagatagctcctacctttttgggagagaatacgcccaaggtgccgccatcctccctcatggccacacccatctcggccagcagggcttccctgggggaacagagctgaggtcagcacaagctccacaaggcttccagcaytggcctcagccctggctgaccaatgggggcagcgggcctgtggccaccgtggcctgggtggtgcccatgcgtgtcccatctggtcactgggttagggcatctgctgatgggactggcccctctgcaccatggtcagggatcaggtctatcaggcctcaggtctctcaggccttggtggctagcagccagcagtacacaaggtgggggtcattggcgatgagggaacaggtttgccctgggctgggatgtggccaccccatggtgcaggtgcccagcactggagggcagggctcagtgctc

SEQ ID NO: 29622 - DNA, 601 bp, Human
agtccaaactcagtggcccctctgcagaagcaggaatggggagtccagccttcccctgccagatcccagggcctggccaggctggagtggctgccaggtcccctctcacctggtgatcccatccttgatgtagtagagcaggcactcagacatcagcgggtcctcgttcaggttgacgaggtgtggtgtctgcagggagacaggaggatcatctctcttgcagaggggcaggagcctgatgctggccacacccccctccaacctctctccaggcaccagactaccaccagggtccctgccyccgcacttggctggtgccaccaggctggtcactccaagccaggaaaatgaggaacacagaaagctcaagccgaaggcccagcccaccaacagcagcaggccggtgggacccgaccacccgcatacacccaagcctggcacagcagccccagcactgcagcagaagctgagcttccagaagggcagacagccccagctctcagcatgtgggggccctggggccctctgaggctggggtgagcccccagatgtgcagaccacaggctttgtcccatggggtcctgggttcccagctttggac

SEQ ID NO: 29623 - DNA, 601 bp, Human
acggcacactgacaccacaggcccatccccaagttgggcagcaccaggcaatggggacagccccacgtcatctccaggagggagaccactgggcaggcaggggaaacggacagatggccgcccacagccaacaggaaaccaaggtctggaaatagttttccaccctagatctgggctcaatcctcatggctcactgtcctcccgccatgaacatcctccaccctgggccccaacacgcttcccggccagcagcccacctgtgcccccacctccagccctcaaggaggctcagctccctaargcagcagctacccctggccacagaaagtaccaggcattttcccaagcaccaacctaatggaagttgtttttaaggctggccccaaatatctctctctctctccaaatctctctctctctctctctctctctcacacacacacacacacacacacacacacacacacacacgtcctgcctagaagtatgactcgtgacccacttagtgctgggtaagctgggagagggtgacctcattcaggcctgatcatcacggcacaggggcatgggtgcgggtagggacggtagggtggtgatacct

SEQ ID NO: 29624 - DNA, 601 bp, Human
gtcagcctggccaggccacagcacccagtgattcagccacaccctccctgggtgttgtgtggaggtttctgcacatgtgctccacacctgcaatcagctgatggaaatcaaggaggcccccaacggtggggtgggcctcatccaagcaggtgaagacctaagagcaaactggggcttcctctgaggaagaagaaacccagcggatggagtccactcctgccaagttcccaccctgccccgagttcccagcctgccccgagttcccagcctgccctgagttcccagactgccacctgcccayggatttcaaacttcgctgaccagccccaccatctgataagccaattccttgaaataaatctctttatacctagacatggttgtacgttatctcactacatctcggtacatgtctacagccatgtctgtgcatcaggctgctgctgtttctctggcagaaccctaactgcgtgggcaatagtcacacaccactcaagagggccccctgtctgactgtctgacttctctaaagaagggactttatgccacgtgtgcctgcacgtgtttgaacatcacagacactgcagtgtctgggaacaga

SEQ ID NO: 29625 - DNA, 601 bp, Human
cccacaggcaggactcctgagtcccgaagactcctccgaaagccttcgggggttggcagatgggctagaagtggggccactgggtgtcacctgcccctcctcaccccctctgctttcccctaagacagggttaggaaagggtctcccctgttccaagccaatggtcacttttatgtcagcctggccaggccacagcacccagtgattcagccacaccctccctgggtgttgtgtggaggtttctgcacatgtgctccacacctgcaatcagctgatggaaatcaaggaggcccccaacggyggggtgggcctcatccaagcaggtgaagacctaagagcaaactggggcttcctctgaggaagaagaaacccagcggatggagtccactcctgccaagttcccaccctgccccgagttcccagcctgccccgagttcccagcctgccctgagttcccagactgccacctgcccatggatttcaaacttcgctgaccagccccaccatctgataagccaattccttgaaataaatctctttatacctagacatggttgtacgttatctcactacatctcggtacatgtctacagccatgtct

SEQ ID NO: 29626 - DNA, 601 bp, Human
tcctcctccaccttccactgggctcagctaagggatccacctcccggcagcttcctgaatggaggagcaagggggcattccttccatcccccaccacctctcccagtccctctggggagccacccttcaggccctgctgtacccgctcttggcgctccgccagcctgttctgtcggtgccacagcctgccctcccctccactgcaccgtcctgacccctgtgggcctagggagcattcccctcatctgtcctttcctccgaaagaaaatgtccaaatctatttttatgtatgattgctgcrttggtagaaagagaatgaggattctacaaggctggactctattcacatttttcttctgattttaaaataattggaacaggaggaacagcggtgtctgcaggtactcgctgtgaagcctgtgcctaccaccgctcctgtggcttcagccctgcccaggaggaccctcccaccatccacccagcggccctccagccccacctgagcttctccagcgtccagtagtgggtggccccgttcttctggtcctggacctccacggccacaatggtgcgggggaagggccgcgtctctcggtctttg

SEQ ID NO: 29627 - DNA, 601 bp, Human
gaactggccttggggtccactgctccctcttgggccctgcagagtgggaagtacaggcccagagcatctcggagggagagtgccacaggtttttatctggtaggccagcttatctcacctcacagcctagtaacactcatgaaaaattaatcagaataaatccatggcacctgcccatgaggacctgctgtcttccaagagggagggtgaggctttccttccaccatctccacccaaggacagagtaaagcccgtgtaaaccctgcgatctggggccacccttagccttcagctgtcagcrctgctgctccaagctccagacttttgaaaacttccactggcctagcccagggaagcaatcttaatcgccaaaaaaaggttgctattaagaattatcttatgacattcatatatgtaaaatatataaattcagctgtttcgtgagctgaccttctgactactacagccaggtttctagatctttccttcacctgacttcccttccatgataacagaaaggcagctggatttgccaaatctgccagcagggtgggacgtctgctccctgggtctgggcttccccagcctccattctgtctcc

SEQ ID NO: 29628 - DNA, 601 bp, Human
acagattggtgaggtgcaaagacgcatgctgggacccagggaagcctttccagaggggacaagagtgggtgccccaatttcgctgaagctttggagagagagccagcagctaccagaaggttaaaggaaaatcaacgaggggccttcccagggccgggcctgcacagctgctgcatgggagaagccaattcttgccaaaccaaaaagatcaagatgattcccaatgaagcccttcacagaccaccccgcaatatgggggccaggtctctctttgatgacttttgtttggtttggtagtttygtaaaatctcaaatccacaaaaggggaaaaaaatgttggaaggacccagctctttctggctgagactgcgagagccccaccccacttctcctgatgtcctcatccccctgtgcgtcctgatccctcacctacctgacacccggagccactcctggggcccaggaggtgcagggggcctggccctacggcccggggctttctgagagaggcctgcatggaactggccttggggtccactgctccctcttgggccctgcagagtgggaagtacaggcccagagcatctcggagggagagtgc

SEQ ID NO: 29629 - DNA, 601 bp, Human
gggactgctgggggtggggccccgagggacatccaggtagaggttatacaatgaaaaggaccccggaggtctgacaccaaatgctcccccatctctacagcaccctgtgagcatcctcatggcactgacctcgggccccaggccaccggtgggacatgtggatctggctgtggctctagtgctgggtgctctcctgctctcctctccccactgcccgtcccagtctgcctggctcagtgatagacttgttcagccagaagggacctctagggccctgaatccactgccccagtggcagcamcagcctcaagagagctgtgagctgggcccggaaggtgcccctccactctgcgaagagcccatgccaaccaatgcacccgaagtgtgaggtgatggggcagagcactggtgcctggcatcttggagcctggcgtctctgcccagtggagacaccctccagggccgcaggtctcacatgctgggcaggccatgcccccacctgccctctaggtgccagaaataacctgacatcagttgggaaccagagcgtagcccaggcctgtccctaccagccacagacacacccaacgcagagtggctc

SEQ ID NO: 29630 - DNA, 601 bp, Human
taactgctttcaaacagatgggcaagatgcagcccagactgtgccccaaaggtggggactgctgggggtggggccccgagggacatccaggtagaggttatacaatgaaaaggaccccggaggtctgacaccaaatgctcccccatctctacagcaccctgtgagcatcctcatggcactgacctcgggccccaggccaccggtgggacatgtggatctggctgtggctctagtgctgggtgctctcctgctctcctctccccactgcccgtcccagtctgcctggctcagtgatagactygttcagccagaagggacctctagggccctgaatccactgccccagtggcagcaacagcctcaagagagctgtgagctgggcccggaaggtgcccctccactctgcgaagagcccatgccaaccaatgcacccgaagtgtgaggtgatggggcagagcactggtgcctggcatcttggagcctggcgtctctgcccagtggagacaccctccagggccgcaggtctcacatgctgggcaggccatgcccccacctgccctctaggtgccagaaataacctgacatcagttgggaaccagag

SEQ ID NO: 29631 - DNA, 601 bp, Human
cagactgctgctaactgctttcaaacagatgggcaagatgcagcccagactgtgccccaaaggtggggactgctgggggtggggccccgagggacatccaggtagaggttatacaatgaaaaggaccccggaggtctgacaccaaatgctcccccatctctacagcaccctgtgagcatcctcatggcactgacctcgggccccaggccaccggtgggacatgtggatctggctgtggctctagtgctgggtgctctcctgctctcctctccccactgcccgtcccagtctgcctggctcrgtgatagacttgttcagccagaagggacctctagggccctgaatccactgccccagtggcagcaacagcctcaagagagctgtgagctgggcccggaaggtgcccctccactctgcgaagagcccatgccaaccaatgcacccgaagtgtgaggtgatggggcagagcactggtgcctggcatcttggagcctggcgtctctgcccagtggagacaccctccagggccgcaggtctcacatgctgggcaggccatgcccccacctgccctctaggtgccagaaataacctgacatcagtt

SEQ ID NO: 29632 - DNA, 601 bp, Human
ccctcgcaaccccaggctccgatcatcccattatgaagcaacatggcagaaatcacagcagccggcatctgtggaggctccctaggggccaagcacagtggcgagcacacagggccttttgctcttctacctcctgggaggcagtgcacccccatctcctcgccagggcacgtcctaataaacagccatctcaactcaaccagctgcacccttctttcttagagatgcaaaaaatccacccagggtctcagcacattagaacgatgaaatatggtacttatacctcatcgcacagaggacraccctgaggcaaagagattaaggaagtcaccagggcctggcagcaagggcctgcaagggactcatctccagctcaactgtgtggacaccaagctccaccacctacttctagggccagggttggcttccatgggcacctcctcacccactctgagtgggcaattcacctgggcacctgcttagttatcacagctgattgattaagcagatcgattgtttcatgcttttttggactgtcctcatgctgggggctgggaggacccagacactgtagcatcacagactgctgctaactgctttc

SEQ ID NO: 29633 - DNA, 601 bp, Human
agcaaagctaagttgtccaggagtgggggtggggagagccagaacttgggccgccagacagcacggctcttccccgtggctggcgcaccacactgggggagacataatgagaccagacgggacagcccatgctgtggggctctgagccagcccctgccctccagcccccacccaccccacattttcccagagctagtgcccactgcaaaaatcccagggttggagggcagaagggcactgaggatgaagagactgcccccaccccactctgcaggaagcccatggggtggtgctcggagasggggcaggacctgggaccactcccactgtgggccaggtgaggacactcaggcacggggttcctgaatccattggcgcagctcacaggaaggagaggctagagctgtccagggccacccagacagggtcagacactacctttcctacccccaaagacccatcaccacagctgccttcccaaagcttagggcaattccacaggggctgctggcagtgagcagagccctgggctctggggccatccacatgtgccactcatggcaccacaaaggtgacccaccaacttctgagctccccagga

SEQ ID NO: 29634 - DNA, 601 bp, Human
cctgctaagctgagacctcaccaacgccctcactgcaaaatggcccaggctcccaacaggaaaagggtcttgctgccctccaggggcctgaaagtctcctcaggcctctctccgggggtaaaggaagcccctggtggctttttgggccctctccccagcacaacgccccctctgaagatgccccccgagaagcgagtaccccacaccaatggagcccatcagggacttgttacccacagggctgcaggcggctctgcctgacttaggtgtgggggctggagctccactgccctgggccacmcacccaggttatgtccagaagcgcccatggaagctcaccctggccctagtcacgagaggacactgaggcccacagggcggggcccctccccacagtcctgctgggtgctccgcaggcagggactcaccagcatccccttgggagggggacggcaatgccttccctccccagggcaccccgggctcctggacaagggtctctgcttgacagtgggggtgggaaaaggggctgctacaaactgagcaaagctaagttgtccaggagtgggggtggggagagccagaacttgggccgccagac

SEQ ID NO: 29635 - DNA, 601 bp, Human
gggaacggggtacagcaggttgctcaggtacacgaaggccctggggagaagcagaggcggcggtcatgggccacccctccacgcatgttctgaacggcagcggtggcagcatggcctggctcacgacacaacatggagctgcaaagcagagggaagccgccggacaggacagccaaggccaggacagcaagagcgggcggggacaggcagggcaggcactcacaggagacaggaggtggagggacagagaggaggacgaggaatgagctgcggagagcagaggcacagtccagctgggcccggacctggctgcctgagaagggagcagccgaggagggaggtttcagcctgcttcaaggaggacgggggccagaccaggacccagaccacactgcactgccccccttttcacactggcactgatggccagcatcgctctgcctcctgcccacttcccaggggtccctgatgctcacggaccccgcagaaccccttccccagacagaaactcggcaggtgggagctccgaggtgagttggccaagatgaggcacccccagcccagggcccagggaggtgctgaatggagccctgaggacacc

SEQ ID NO: 29636 - DNA, 601 bp, Human
caggggccagggactgggcctcacacgcctttcctggggctgcagagacagccgggtgggtggaatgtgttgacagagagcacttgctctgcagcaggctgggggagggatccaggtggtcttgggtccatatgggactgcctgatgggaaggtggaaacccccaaccagagcaggctcagatggcactgggctcagcctgcacagcccccaaggcacctccagctgaccctggggagtccagagccaagagctgggcagcaggggcttcccctccagggcccactgcggggcagcagccyggggcgccagcccaggacagcgtggaaaaacagcttcaggttgaccccagggagagtggagggccagctgaggccagcttcccactaaccactacatgatgccagaaggcccttcttgggcccacgcctctgcctgcaaaggtcagagccagccccaggggctccaatgccacacacggcctttggcccacacgcacctgagatggcctggacggccacgcggaggaagcccttcacctcgcccttctcgctgacgattgccacacggtgtaccaggggaacggggtacagcaggttgct

SEQ ID NO: 29637 - DNA, 601 bp, Human
agccgcctgttgccctgcagcttccaggcagccaagcgctctcacatctgtgttctcaagtacccttcaacattcctatcaggtggggagcattacaacggatcccgtttacatgtgagcaaaccaaggctcagacactctggggctgccctggtgcctctggccatccggagcaggctgagcagcaccagtctccacctcccacaagggaggggcttgtgtcttcaggcccagtgtggagggggacaggcctgtgcctgagagaccagggaatgcatcagggaaccagaagcaccccagrgagggctgccctgagcagggcccaggggccagggactgggcctcacacgcctttcctggggctgcagagacagccgggtgggtggaatgtgttgacagagagcacttgctctgcagcaggctgggggagggatccaggtggtcttgggtccatatgggactgcctgatgggaaggtggaaacccccaaccagagcaggctcagatggcactgggctcagcctgcacagcccccaaggcacctccagctgaccctggggagtccagagccaagagctgggcagcaggggcttcccctccag

SEQ ID NO: 29638 - DNA, 601 bp, Human
cccccctgcagccatggatgcacgtcctctctgcatccatctgcctgtctgtgtgtctgtctgtctgtactactccctccctagggtgcccaggcagccaaggcctttgagaggaaaaagagtgctccttggtgaggggagaccttggtggaggagcccggggcaggcagggaagggagtgggaccttccctcacggcacaagccgcctgttgccctgcagcttccaggcagccaagcgctctcacatctgtgttctcaagtacccttcaacattcctatcaggtggggagcattacaacrgatcccgtttacatgtgagcaaaccaaggctcagacactctggggctgccctggtgcctctggccatccggagcaggctgagcagcaccagtctccacctcccacaagggaggggcttgtgtcttcaggcccagtgtggagggggacaggcctgtgcctgagagaccagggaatgcatcagggaaccagaagcaccccagggagggctgccctgagcagggcccaggggccagggactgggcctcacacgcctttcctggggctgcagagacagccgggtgggtggaatgtgttgacaga

SEQ ID NO: 29639 - DNA, 601 bp, Human
gtaactcagggtggagaatatgagccatctcggagttgggggacttgccatctggggaggggtatggccatctcagcctgctccaggtcgctcctctaagcagccccagcccggcagccaggagcccccctgcagccatggatgcacgtcctctctgcatccatctgcctgtctgtgtgtctgtctgtctgtactactccctccctagggtgcccaggcagccaaggcctttgagaggaaaaagagtgctccttggtgaggggagaccttggtggaggagcccggggcaggcagggaaggsagtgggaccttccctcacggcacaagccgcctgttgccctgcagcttccaggcagccaagcgctctcacatctgtgttctcaagtacccttcaacattcctatcaggtggggagcattacaacggatcccgtttacatgtgagcaaaccaaggctcagacactctggggctgccctggtgcctctggccatccggagcaggctgagcagcaccagtctccacctcccacaagggaggggcttgtgtcttcaggcccagtgtggagggggacaggcctgtgcctgagagaccagggaatgc

SEQ ID NO: 29640 - DNA, 601 bp, Human
gggccccctgattctcagcactgtggtatcacagtgactggatgacaagcaatgacatggccagtgggaggtgctataaacagcatttagaaattatgggctaggctgggcagggtggctggccaggcgtggtggctcacgcctgaaattccagcactttgggaggccgagatgggcagattacttgaggtcaggagttcgagagcagcctggccaacatggtgaaaccccgtctctactaaaaataaaaaaattagctgggcgtgatgacgcacccctgtagtcccagctactctactcrgcaggctgaggcaggagaatcgcttgaactgggaggcagaggttgcacagtgagccgagatccagccactgcactccagcctggcgacagagcaagactttgtccaaaaaaaaaaaaagaaaagaaagaaattatgggctaaggagaatttaacattagagtcaaattaacttcattaattaggtgggattaaaatcacccaaggcagccaggatagcagagccgggagaaccagacatcttgcatcttgcaggggatatgaggtaactcagggtggagaatatgagccatctcggagtt

SEQ ID NO: 29641 - DNA, 601 bp, Human
tgccatggtctgtgacagtcagcgcctgctcatgcaggagtcagtgctgagggaacagcaaactgacctcgcccgggtcacgggcagggctgatgagacttctgacaccaccagtgcaagggccggtgccttttctaagttcccttctccaccaccacagccattagacagggaaacaattaggtatcacccaacataaaatgatccagttgtaggatggccggcaggaggcctggcgacgcagcccaggataggagcacttcctaggcactatcccagtctggtttcccagtatatgacmtgggatagcaggggctgtggacctgggcacacagacctgggctcagagctgctgtacaccttcctaactggcgacactcatctgagaggtgggggtacctctcaaccccatagggtgcaggacaaaggtagagctttgcactgagcttgaactcggatcctgggaaatgggaaacctccatgtggaccccagagagctcctctgaccaagggcagaccaggacggcagctgccctcacaaggacatgggccggccccacggcctctggtgcagccccactctcaggaagtggctgtcagg

SEQ ID NO: 29642 - DNA, 601 bp, Human
tgtggatgtgtgtctttggattctacagcctatggctatgggagttctgagctgtcctggaaacaactcaccacctgcctctctgctctggtcttcagttcagccggacccccgcctgccagggccccttgtccagcaggttagctctctcccctccccttcttgggcatccccaatactgacagcccctccaagagaaaaggcattgggcagacagaccaccctcgctcagggagtagggcacccaggttccaggtgacggcacggccaggtgggcaggggtgagaagcgagtctaagaaggtggggacaggagccacctgagtgtggcatggggtgcactttggggaccttcctccaccactctctcaagagcagaagaggagactgagtggtccaggtgccactggacacagcgccggcccttcacatgaggaccgcaggtaggcagcctcaggggggcagcccaggagcaggcgaaggagcaggcgaagggggcagtgggaacgcgccgtactgtggggacccagaggagagctggtccagagaagggagacagggtgggggtggctgcacctcagtgtctgttctggaggctcgtg

SEQ ID NO: 29643 - DNA, 601 bp, Human
gttttccctgctgtggatgtgtgtctttggattctacagcctatggctatgggagttctgagctgtcctggaaacaactcaccacctgcctctctgctctggtcttcagttcagccggacccccgcctgccagggccccttgtccagcaggttagctctctcccctccccttcttgggcatccccaatactgacagcccctccaagagaaaaggcattgggcagacagaccaccctcgctcagggagtagggcacccaggttccaggtgacggcacggccaggtgggcaggggtgagaagygagtctaagaaggtggggacaggagccacctgagtgtggcatggggtgcactttggggaccttcctccaccactctctcaagagcagaagaggagactgagtggtccaggtgccactggacacagcgccggcccttcacatgaggaccgcaggtaggcagcctcaggggggcagcccaggagcaggcgaaggagcaggcgaagggggcagtgggaacgcgccgtactgtggggacccagaggagagctggtccagagaagggagacagggtgggggtggctgcacctcagtgtctgttct

SEQ ID NO: 29644 - DNA, 601 bp, Human
tctccatcatcctagcagcccagctgccatcactctcctgcctggagttttccagacctctcgggacgttgccggcaccctgtagcccctgtggccctgcctccttcccattcccaacacccaagccagggctgccctggctgagcacccccggccctcagtacaaatcccaggccccactgcacctgcatccggctccccatcggctctatgctcactatgagcagctcccaggggctctgagcggcccccatgccccagctgtaaacccatcaagggtctcccactgcccagaaatcgytcctacaccctgcctggcactggagttcccggtgcacaaggcagtcctggcccacaactggtgttcagaagagggagaatgagccatgctcagagaggccctgggagggtcagtcagtggcagggatggggagaagtgcccaggaacgtacgttctggacgtggtagaagccaagtggggggcctctgcctgtgttcttcaggggctctgtggagaaggcctcgtcgtggcggtggatgaagctgcaaagcagaggagatgctttggtgtggggtgggggacttgggatgagaccttacc

SEQ ID NO: 29645 - DNA, 601 bp, Human
agaaggagctgctccgccttaaaggcccctcctctccatcatcctagcagcccagctgccatcactctcctgcctggagttttccagacctctcgggacgttgccggcaccctgtagcccctgtggccctgcctccttcccattcccaacacccaagccagggctgccctggctgagcacccccggccctcagtacaaatcccaggccccactgcacctgcatccggctccccatcggctctatgctcactatgagcagctcccaggggctctgagcggcccccatgccccagctgtaaayccatcaagggtctcccactgcccagaaatcgctcctacaccctgcctggcactggagttcccggtgcacaaggcagtcctggcccacaactggtgttcagaagagggagaatgagccatgctcagagaggccctgggagggtcagtcagtggcagggatggggagaagtgcccaggaacgtacgttctggacgtggtagaagccaagtggggggcctctgcctgtgttcttcaggggctctgtggagaaggcctcgtcgtggcggtggatgaagctgcaaagcagaggagatgctttggt

SEQ ID NO: 29646 - DNA, 601 bp, Human
cttcagaatgagagtatatcctgggatagggcctttacagagaaaacggagttaacgagaggtcatcagagtaggtcccaatccaacatggctgctgtccctatgaaaagcggaagtttgggcccaggcacacgcagagggggagggccatgtgaacagacacaaggaagaggcggctgttctataagccaaggatagaggcctaagaagggggcaatcctgcccacaccctcatcccgggcttccagcctccagagccatgggaggccacatttctgttgtttttagatgcccccacctrtggtgctttgtgacagaagtcccagccaactaacccactgagtctccaggttatcacccctgccaaatccacacccgtggcctggcactcaaggcctggctccctggtagctttccttatcaccgttaggcactctttcccctgctgccccaggagcccagttctcccgcctggagaaggagctgctccgccttaaaggcccctcctctccatcatcctagcagcccagctgccatcactctcctgcctggagttttccagacctctcgggacgttgccggcaccctgtagcccctgtgg

SEQ ID NO: 29647 - DNA, 601 bp, Human
gtcccctcaccaaattcgtatgttgaagtcccaaccccaggacttcagaatgagagtatatcctgggatagggcctttacagagaaaacggagttaacgagaggtcatcagagtaggtcccaatccaacatggctgctgtccctatgaaaagcggaagtttgggcccaggcacacgcagagggggagggccatgtgaacagacacaaggaagaggcggctgttctataagccaaggatagaggcctaagaagggggcaatcctgcccacaccctcatcccgggcttccagcctccagagcsatgggaggccacatttctgttgtttttagatgcccccacctgtggtgctttgtgacagaagtcccagccaactaacccactgagtctccaggttatcacccctgccaaatccacacccgtggcctggcactcaaggcctggctccctggtagctttccttatcaccgttaggcactctttcccctgctgccccaggagcccagttctcccgcctggagaaggagctgctccgccttaaaggcccctcctctccatcatcctagcagcccagctgccatcactctcctgcctggagttttc

SEQ ID NO: 29648 - DNA, 601 bp, Human
aggggcagcagcctcctctaggcccttcagcccagcccctcctcccaccacgtgccccagacagactctggagtgtgtccctcgggctctctctccaggacgaacaggggccgcgtggctcagctgccctttcagaacacggagctgggaaaggtgacaaagggcagcgctggtctcttcaggactccccttcttaggtcctgccccactcagcaagagttatgggttggaccatgtcccctcaccaaattcgtatgttgaagtcccaaccccaggacttcagaatgagagtatatcctgrgatagggcctttacagagaaaacggagttaacgagaggtcatcagagtaggtcccaatccaacatggctgctgtccctatgaaaagcggaagtttgggcccaggcacacgcagagggggagggccatgtgaacagacacaaggaagaggcggctgttctataagccaaggatagaggcctaagaagggggcaatcctgcccacaccctcatcccgggcttccagcctccagagccatgggaggccacatttctgttgtttttagatgcccccacctgtggtgctttgtgacagaagtccc

SEQ ID NO: 29649 - DNA, 601 bp, Human
caggtcctcttctagcaagtcccctcctctgcctctcctacaaatatggatctacaggtctttcttgcaggctgtggggaggactgaatctcagggaactcatactgcgggccacaaagcctgtacagaccagggactggctctgcagcagctggagggtgtcctcccacagtgtcctcagcccgcaaaccttcatcttacaggggttccgaggacagggtccttgcaaggcaggcacaagaggctgacacctggtcaccatgtgtgcagacccagtgcctccacccaccagctgcagaarcagcttctcacacaggcccctaccctctggggtgctggtgcccgggaccacactccctccttcaggagggtttctgggctatgagagactcggccacacctgctgggcctcagtctggctgtcttcagctctcccccgaccatgtccctgggttttggtcttgcaggaaataaactccactcttttaactaaaagccagtggatctcaagtgctattccatgacccacctgttcccacaggcagaggctccaggctccaggcaaaagctctgacaaatacttctccccgactgaccccac

SEQ ID NO: 29650 - DNA, 601 bp, Human
tcaaaagtcccttgatcactttgtaagtgctgtctgcctccctgccctgcccctgagccataccctggtttgctgtcctagtgctcaggaccatggggacactaattcaggtgcttatctgtccagcacctccctgcccctcatgccagctcctccaggactttgtctgcttttactccccaagacctagatgaggccgggcccacaagaggtctgcagtgaacacccgctggaagaacgactctggatgctggcaaccctcaggcagctcaagtcctcgtccctctccgcgcaccccccsacacacactcacgccctgggggccccagcaccagcactcactcgccgttggcctccagctcacagatctcgaagtagaccagcaggtcgtacttgcagtggcagggtcccggacagggccgcgtcagtgtgctgagcttggtggcgggcactgtagggacaggagggaggcatgcatggatgggagacctgacctatcacgtgccaagggcacactcaaggaggagatgccggggccaaagggactcagaggcagcaagggcacctccccctcctcaagggaaacaaccagccaacccca

SEQ ID NO: 29651 - DNA, 601 bp, Human
tcccacctccctcaaaagtcccttgatcactttgtaagtgctgtctgcctccctgccctgcccctgagccataccctggtttgctgtcctagtgctcaggaccatggggacactaattcaggtgcttatctgtccagcacctccctgcccctcatgccagctcctccaggactttgtctgcttttactccccaagacctagatgaggccgggcccacaagaggtctgcagtgaacacccgctggaagaacgactctggatgctggcaaccctcaggcagctcaagtcctcgtccctctcckcgcaccccccgacacacactcacgccctgggggccccagcaccagcactcactcgccgttggcctccagctcacagatctcgaagtagaccagcaggtcgtacttgcagtggcagggtcccggacagggccgcgtcagtgtgctgagcttggtggcgggcactgtagggacaggagggaggcatgcatggatgggagacctgacctatcacgtgccaagggcacactcaaggaggagatgccggggccaaagggactcagaggcagcaagggcacctccccctcctcaagggaaacaacc

SEQ ID NO: 29652 - DNA, 601 bp, Human
accttcaaaggggaccttatttggaagtagggctttgcagaggtgatcaaactgagtaaagatgcagtcaaccctggagcaggatgggcctctaatccaacctgcctggtgtccttaggagaaagggccacaggaagacacaggacaggagaagcctgcgaaaatgcagtgatgcgtctgcaggccagggtcgcccaagatgctggccaccaccaggagctggaagaggcagggagggattttccccaacaggtttcagagagagagagcgcgcctcttgccggcaccttgattttggacytctggcctccagaagtgtgagatgataaatgtctgctgttttaagctacctggtttgtggtattttgtcatggcagccccagaactccaatacactgattaaacagaaatttgcagatcgtcacccaggtccaaggctctccttttcaggtgaggaagtgagtcacagagagattatgtgacccggccagggtcacgcagcaacagacgcagaggtgtggttagaacccgggtatccagctcagggcctgtactcttcccaccagctcagccccacccaccaaggcagcccccacaccgc

SEQ ID NO: 29653 - DNA, 601 bp, Human
tttcaaccatgcagatccagcttcccctcttccttctctcctgtctgccttgagggaagtgagaccagggctcagaatgtgagggcagtgctgccccagggatcgttcctcaactaccgtgtggccgggtccataaaccagctgtgtatttgcttacgttctgcctataaatcaattcactcttcttaggcttgccctaaacaacctctgaaaggagggtttgggtgcttgttccatgactttctgattcatgtgaaattagacacaaaacttgtaaaacataagcatgtatcctggtgtrcctggaacctcctgtctacagtcctgcactgggacacaaggtgacgggtccagcctcagggaagtgaccttgagcagccacccagcccggccatggcaatgtctggggcaaggcagggctgggctggcctcatgctagtgacacacttgaatggatgactgtctgcctccttgaatgaaaactgagaagacaaattctttccgctttagcaaaggaaacatttggcggacccgaattcgaaacatgaggtcatggaagaaaagagtgtaagatccttggtgatggttatgggaggaattg

SEQ ID NO: 29654 - DNA, 601 bp, Human
ctgtgccccggacagattctgagagcacctcggccaccctcccacagacaggtcggtggcatcccacaattactgagtgacctccagaatgaccacagccagccctcaaggacactggatcctgacccccaagctctttcctcccagctgtgcccagtgtgaacctggacaccaggtccatgtggcagaccacagggagacccactgaaggtggccacgggtgcccggtagcctcggcagccctgctgtcagggccctgacattccggctcattctcccccacccccaagaatcaggagcktgttcagcacgcaagcacggctggtcctggtgttcggtgtgtggctccccaaggtgctgacagcctccaagaagagccacccagcaggtcctgtgggaagctgtgtccagagcccccttccagccaccgcccacttatccagctcctccttcagtgccttgtgggcagtcagtcccatggcacaggttccgtggtcctcagggaagaaggtcaccggcgggggggggggggggggggaacggtgtggccccaggatcacccacaggaggccccaggtgggcaccctgggcctgcccctcc

SEQ ID NO: 29655 - DNA, 601 bp, Human
aagtgggagcttgactgactgggccagaggccacagggtgatggccagacagggtgggggccaggaagacagcagaagcctgcaagtgcatgggtgcatccaaggccacaggacccacccggcccctcactcacatccccacctcccatggaccccaggccgacccagggaaaccagccacttaggtatgaggtgtccctctgcactgagacgtgttcctaggaaactcttaactgccttttcccacttggaatgggagttttcctcagggaccactgcctatgggagcccgagccctgcrgggcagcctggtgcagcccctctgcacccaccttgctctcgctggcactgacgcagacgtggctgtgtgtgtactctctgttgaatgtgtgcgtgagcaggcgcaagcactgtggacagagcacacgcgtggtcaggggccaggcctcccgggaccctgctcagacagccttgcaggctcttctacccacccctccccagacacaggtgggttccgacgccagagcacagtgggtcaaggtgggcagcacctccaccccgcccaggtcatcgggtgagcccaggaagtctcccagggtca

SEQ ID NO: 29656 - DNA, 601 bp, Human
agctccacgcataatgcagcacagcagcagtttcccaggctacaggggtggggtcggtcccaggaggaggagggacagccaagtgggagcttgactgactgggccagaggccacagggtgatggccagacagggtgggggccaggaagacagcagaagcctgcaagtgcatgggtgcatccaaggccacaggacccacccggcccctcactcacatccccacctcccatggaccccaggccgacccagggaaaccagccacttaggtatgaggtgtccctctgcactgagacgtgttcctrggaaactcttaactgccttttcccacttggaatgggagttttcctcagggaccactgcctatgggagcccgagccctgcggggcagcctggtgcagcccctctgcacccaccttgctctcgctggcactgacgcagacgtggctgtgtgtgtactctctgttgaatgtgtgcgtgagcaggcgcaagcactgtggacagagcacacgcgtggtcaggggccaggcctcccgggaccctgctcagacagccttgcaggctcttctacccacccctccccagacacaggtgggttccgacgc

SEQ ID NO: 29657 - DNA, 601 bp, Human
acccaggcagccaccctgccaatgcctcgaggagtgggctgggtaagctctgccctgccgcctcctgcccatgccagcgtgaggtggcgctgggtgatgccatggggacaaggaaggccatgggccagggctggagctccacgcataatgcagcacagcagcagtttcccaggctacaggggtggggtcggtcccaggaggaggagggacagccaagtgggagcttgactgactgggccagaggccacagggtgatggccagacagggtgggggccaggaagacagcagaagcctgcaagygcatgggtgcatccaaggccacaggacccacccggcccctcactcacatccccacctcccatggaccccaggccgacccagggaaaccagccacttaggtatgaggtgtccctctgcactgagacgtgttcctaggaaactcttaactgccttttcccacttggaatgggagttttcctcagggaccactgcctatgggagcccgagccctgcggggcagcctggtgcagcccctctgcacccaccttgctctcgctggcactgacgcagacgtggctgtgtgtgtactctctgttgaat

SEQ ID NO: 29658 - DNA, 601 bp, Human
gcaacctgtctgtctccccaagtatgagggtccctgtgcccccagtatggggagcagggtggcctgcctgtcccctgtcagcacagagctggtggcggtgctttccagggaggccccacacacctgactcggatctcctggatgtcagggaccagcaggcgctggggctccttgtctgtctctgttgcccgggcaggggaagggagcttcttggagtcggcctctggcagcagctcgggctctgggctggctggccgggagcagggctgcggggtcctgggaagcagagggaagtgctgcmcactgcaggcctccctgggcctggggccgtcttcccccaggcttcaccctcctcagagcacctcagaaggtgcagtagggcaccttcgcagggtctctccagctgtgcccacagtgggagctcccggggcccgtccaccaggatagccaagcttgtgcccgattccaggaagtgctgggcttggtgggcagggtcccccaggaacctcggggcccagccagggagcctgtgccccactccacgcccttctcccagtggctctcctgcccccacctccaccctgtgaaagcaagtccagca

SEQ ID NO: 29659 - DNA, 601 bp, Human
aaccacctccccagccagaaagtgggtcgaggcatcgaagggcacctggcagaaccccaacccagcaggccggagaccagaccaccaagccagctctgggcctcagtttccccaccataaaatggaaaaacttaaagaaataagctaaagttgctgaaggctgtcacactgtacccagtgaccacgagttccccacctgggccttggctctgaccccacccactcccctgtgctctgtgctggttcccagcctaggcatgtgggtcacagggccctgcctgacctcccagcatggagctgyccctccatgtgggtcaggggcagcctgcctgaacctccagtatgggcatcaggcaacctgtctgtctccccaagtatgagggtccctgtgcccccagtatggggagcagggtggcctgcctgtcccctgtcagcacagagctggtggcggtgctttccagggaggccccacacacctgactcggatctcctggatgtcagggaccagcaggcgctggggctccttgtctgtctctgttgcccgggcaggggaagggagcttcttggagtcggcctctggcagcagctcgggctctgggct

SEQ ID NO: 29660 - DNA, 601 bp, Human
aggctgacccagccagggctgtgactgccttctggacgcatctgcggccggtggtcccaggacaccctcaccactgctatgcctccccacgggacgtgactgcccctcatggcccctgctccctgggaccctggctgggctgctggtgcagatgtgggttcacaccacccactcccaccacagggaatcaaaaaaccatctcgtagacactggggccgcctccagatggctcagagaaacttctcctccagccagcctgaaggagtccaggctcctgaacttgtccagggccattccagayggaggggctgggcagagtgggggcaggagggctcctctgagccctgtggctcgcccattcctgcagggctggtgccacccaccttgggtgactccggaggaggggacatggctgtggccatcacacaggagaatactaatgcttgccctgaccggagtccatccccactagctgtcaccaggaatatgcgcctcatgggcaggcagagaggcctggggcaaggacagaggatccctgaggctgagtccctgagcccagcctccgtggaacaggacggagtctggggtgagcagatgggcc

SEQ ID NO: 29661 - DNA, 601 bp, Human
aagtgctgggccctaggtctggagcaccagacccgatgtaactgctcccacgggccacggcgggagaggggctctgttgcttggctactgtctttccttgagctaaaaagagaccaaatcgacctgtgggtgtgggtggggagggccctaaaacctccctaggcctctggacatgactcctatgaccagactctcagcttggggctgacccccgtcctgtcctgggtggccctcggacattggtgtctgcagagggggtgaaatgggacaagaacaaagggacaccgcagatgcagcagcraagagctccttgaagacaataaccaccaagccagccaccctccattgccgaccgaccaggatacccccaccccatgggattttctcagtgggactcacagaaactctctgccctgggaacaaagagaggaaagtctttgcaagaaacctgctaatggcagcatttcttcccagaagctaccttgactcactccatttctcgccgcagctgaagaggctgcgccacagccctcgacacctagaccgtcgccctgaattccgatcttccctgacttcctggtctcaacccaccaccctaccc

SEQ ID NO: 29662 - DNA, 601 bp, Human
cgcctcccaggttcaagtaattttcgtgcttcagcctcccaagtagctggaattatagtcatgtgccaccaaccctggttaacttttgtattttatagagacagtgttttaccatgttggccaggctgatcttgaacacctgacctcaggtgatgcgcccgccttggcctcccaaagtgctgagattacaggcatgagcaaccgtgcctggcttaactttatcttatattcagtgttgtcctctttcttagacaccagacttatttagtgacaaaacctgacctgaacggatgtgaggtgkgtattgcccttatccagttgaggaggactatcggacttagtgttttgctgtagacacagtactgagtactgagttggattaagagtgctgccccaaccctgctgaggatgtcatgtagtatgtagcatgtatttaaagaaaaatctgaaaaatgctaaattccacaatgcatctggccccaaggagaaaaagaagcttttataaaataggacaaaaatacaagataaactattttatttttggccctcaacttggaccttggctttcttttgtttcagtgacacaaatgaagttgatgtg

SEQ ID NO: 29663 - DNA, 601 bp, Human
gtagccgggaccacaggcacttgccaccatgcccaactaatttttgtatttttagtagagacggggtttcgccctgttggccaggctggtctcgagctcctgacctcaagtgatcctcctgccttggcctcccaaagtgatacaggtgtgagccaccacacccagcatatatgatctttttcttaatcctattcactttcatgattattaagattattataaatttattgtagaagtacagttatatgtgtaaatgtagaaatataatttttagtaacacattcacgacttggtgtcaggygaattaaagtttcactatctgcacatgatacctaagtttttctcagtatccagaatgagcattacttctccctagcctatctctgatgataactaaccttttaaactcatcaactggacaggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatt

SEQ ID NO: 29664 - DNA, 601 bp, Human
ttggctcactgcaacctctgccgccaggttcaagtgattctcttgcctcagcctccagagtagccgggaccacaggcacttgccaccatgcccaactaatttttgtatttttagtagagacggggtttcgccctgttggccaggctggtctcgagctcctgacctcaagtgatcctcctgccttggcctcccaaagtgatacaggtgtgagccaccacacccagcatatatgatctttttcttaatcctattcactttcatgattattaagattattataaatttattgtagaagtacagwtatatgtgtaaatgtagaaatataatttttagtaacacattcacgacttggtgtcaggcgaattaaagtttcactatctgcacatgatacctaagtttttctcagtatccagaatgagcattacttctccctagcctatctctgatgataactaaccttttaaactcatcaactggacaggtttcatagcggcagacattaaaggtacaggttcctggactcagctctatttgattactgattaccatgaaaatggatctctctatgacttcctgaaatgtgctacactggacaccagag

SEQ ID NO: 29665 - DNA, 601 bp, Human
agaaaggaaaagagcaggactgtgggcctggcagtcaacgagccagactgaaaaggcagctgtgatgagtcactgatgggcaaatgggagttggcttaattaggagctaactcttagttgaacattcttaattttataaaagtgtccactttttgctttgaaattgagagccttttctactagagaatcatgtaggttgataatattctccaggttatttgtataatatgtcatctttttcttttctttccttttcttttcttttttttttttttgagacggagtctcattctgtcgctcrggctggagtgcagtggcgccatcttggctcactgcaacctctgccgccaggttcaagtgattctcttgcctcagcctccagagtagccgggaccacaggcacttgccaccatgcccaactaatttttgtatttttagtagagacggggtttcgccctgttggccaggctggtctcgagctcctgacctcaagtgatcctcctgccttggcctcccaaagtgatacaggtgtgagccaccacacccagcatatatgatctttttcttaatcctattcactttcatgattattaagattatt

SEQ ID NO: 29666 - DNA, 601 bp, Human
ttcaccatgttggccaggctggtcttgaactcctgacctcaggtgatccacccgcctcggcctcccaaagtgttgggattacaggcgtgagccaccacgcctggccaaaaagtgagaatttttttacgttattaaaatattctgtatcttaattgtggtattggtgattacatgatatagatttgtccaaggcttgttgaacttttctcaaaaagggtacattttatataaattatacctcaataatcttgacttaaaaacttacaggctgaggcaggcagatcacttgaggtcaggcgtycgagaccagtctggccaacatggtgaaaccctgtctctactaaaaatacaaaaattagctggacgtggtggcagatgcctgtaatcccagctgctcgggaggctgaggcaggaaattgttttaactggggaggcagaagttgcagtgagctgagattggccgccgcactccagcctgagcaacggagcgagactctgtctcaaaaaaacagaacaaaatttacaaaaggattctataataaatgatacataaagtcactttagctttgcactaaatctagtccattttagaagcatttcc

SEQ ID NO: 29667 - DNA, 601 bp, Human
gagcaaacttttatagcaattgatgtatattctaacatttatatggaaatgcaaaggactagaagagccaaaacaattttgaagtagaagaacaaagaggaatcactacctgatttctggacttaccgtaaaactcaataatgatctcaatttggtactggcataaggatagatgtattgatgaatggaacagattatggagtttagaaaggaacatgcacttaatatggttaattgattaaaaaaaaaaaaacaaaaagatgcccaagtaattcaattggaaaaaggcagtccatttaasagatggtgcaggaaatatcaggaatccatttaccaagaagttaatctcagtccttacctcctcactctataccaaattaacttgaaatgtagcatagacctaaatgtaaaagttgaagtataaaacctctaaaagaaaatgtctgaaaaaattattctgaccttgggcagacttcttcagtacataaaaaacacaaatcatttttttaatgataaatcaggctttatcaaaatttaaaacttctgctatttagaagacaagaaaatgagaagacaagtcacagattggcaaaacagatct

SEQ ID NO: 29668 - DNA, 601 bp, Human
tactcagttttgggttgaaggaactcttatttgagaggacctgtattatgaacactagatatccagataggtttaagtttttaattgtattagttgaaagaaactgatctcttcttattttattttattttactttattttattttaatcgtatcgagatagtcttgctctgtcacccaggctggagtgcagtggcccagtcttcggctcactgcaacccctgcttcccaagttcaagcaattcccgtctcagcctccgaagtagctggaattaccagatgcaccaccacaccaggctaatttttttttttttttttttttgagggatgaggtttctccatgttggccaggctggtctcaaactcctggcctcaactgatccttccaccttggctcctaaagtgctgggattacaggtgtgaaccaccgcacccaccctgatctctaattttgaaattcatcttattaaataactctaattgaattggaaaggtaaaagtaaaactgccttcataggcagacaacatgattgtttacgtagaaaatcccaagaatggtacaataaaactactgcagccagtaaatgactttatcaggttgc

SEQ ID NO: 29669 - DNA, 601 bp, Human
atattcttagagaggatgcttctctcaatatactactaccaaaacacatagttcaataaaaaataattttaaagggaattacaaataaattccaacaaatttggatggattcttggtatcagggaaaaaaaaataatcccagcaggttcatttatatatggaaatactcagttttgggttgaaggaactcttatttgagaggacctgtattatgaacactagatatccagataggtttaagtttttaattgtattagttgaaagaaactgatctcttcttattttattttattttactttrttttattttaatcgtatcgagatagtcttgctctgtcacccaggctggagtgcagtggcccagtcttcggctcactgcaacccctgcttcccaagttcaagcaattcccgtctcagcctccgaagtagctggaattaccagatgcaccaccacaccaggctaatttttttttttttttttttttgagggatgaggtttctccatgttggccaggctggtctcaaactcctggcctcaactgatccttccaccttggctcctaaagtgctgggattacaggtgtgaaccaccgcacccacc

SEQ ID NO: 29670 - DNA, 601 bp, Human
taaaaagacatatcagtttaaaataccaaaccatttctaattttatcattactcttcttttaggattctccaaaagcccagctacgccggacaatagaatgttgtcggaccaatttatgtaaccagtatttgcaacccacactgccccctgttgtcataggtaggttagccgagaaaagtcggagcatgcttctcaaatatcttctctggttttacagtaaccaggctacctagaattgaacacgtcagattattttttcatttcaattgtttacattgtttacttttattgtcaggtccrttttttgatggcagcattcgatggctggttttgctcatttctatggctgtctgcataattgctatgatcatcttctccagctgcttttgttacaagtaagaagatatttattttgaagcaaaatattttgtcaaatattagatgtcaaccgctgtttgtaaagccagttgcagaaaccattaacttgtattctctggttgtatatctcctttatgtaactagactatagttctcttaagggaaaaggaccttactaccaattaattaattgggcacaatttcatacttcttgtatgttca

SEQ ID NO: 29671 - DNA, 601 bp, Human
actgaaatagaaattgtattttatgaatactaaaaagacatatcagtttaaaataccaaaccatttctaattttatcattactcttcttttaggattctccaaaagcccagctacgccggacaatagaatgttgtcggaccaatttatgtaaccagtatttgcaacccacactgccccctgttgtcataggtaggttagccgagaaaagtcggagcatgcttctcaaatatcttctctggttttacagtaaccaggctacctagaattgaacacgtcagattattttttcatttcaattgwttacattgtttacttttattgtcaggtccgttttttgatggcagcattcgatggctggttttgctcatttctatggctgtctgcataattgctatgatcatcttctccagctgcttttgttacaagtaagaagatatttattttgaagcaaaatattttgtcaaatattagatgtcaaccgctgtttgtaaagccagttgcagaaaccattaacttgtattctctggttgtatatctcctttatgtaactagactatagttctcttaagggaaaaggaccttactaccaattaattaatt

SEQ ID NO: 29672 - DNA, 601 bp, Human
gtcacaggctcatgtttacctttttaaagtcatagctgattatactgaggcttttccttaatttccgcttacattcttgttacttgtgtagtgacaaacagttctttgctattcacatgttggtcagaatggcagttctccccaggctgcagcattcaacttgtcagatattgtgttgttaatccaataaaacatcacatgcaagtgctgctgcgcttccagtgactgtgtccttctctgtgctagctttctgctctcttagggacagtctccttgctggctggtggtctgtaatcagctytcaagaatgctttctgtagtttgtccttccctcaccatggatgctcaacttgcctctgcatcaggctcatgacttccgacgtggctggggtaggcagggtctgcagcgcctctgcacgctcagctgccttgctaaccagccttttctttggactacgacaccctccactttttagtctgatcttaaatctcatccacatctcagtaccacagtgagattatatgtaccagaccagtttatgattgtaattacctaagttcgggtttggtgttctaatctagtgtctaacacaccatccac

SEQ ID NO: 29673 - DNA, 601 bp, Human
cccttgtattttctgtaatactatgctccttaatctgttggcagagtctatttttggcttctttttaaaaattattatttttagagatagggtctcactacattgctcaggctggacttgaactcctaggttcaagtgatcctcatgcctcagcctcccaagtagccaccacacccagtttaaagtctactttctttcccttttaaagaaaagggacgtatataacacatatatatataacatatatataaacatatatacatgtttatatgaaatgtttatataaaaatataacattccrttatctattgtagtttccaacactccatctttctaaagtctttaaattacacctgtctttcagccatctctcttacaagggctttcatcttcctgggatataattcacctaggttagaatataggaactcataaggaatacaaacgcatcgtaagatctcttcgtacatttgggatgtcgtttcccacttagtagtgtttgagctaccttcgtcatccctgtcagcatccttcatagagaagaaaaaacaagacaggagttgaagaattgttcgtttttctccttatcatccactgtcat

SEQ ID NO: 29674 - DNA, 601 bp, Human
gataaattacttgctcaagttcacaaagtgaacaactggcaaagctaggattcagactgtttgattccaaaacccttgtattttctgtaatactatgctccttaatctgttggcagagtctatttttggcttctttttaaaaattattatttttagagatagggtctcactacattgctcaggctggacttgaactcctaggttcaagtgatcctcatgcctcagcctcccaagtagccaccacacccagtttaaagtctactttctttcccttttaaagaaaagggacgtatataacacttatatatataacatatatataaacatatatacatgtttatatgaaatgtttatataaaaatataacattccattatctattgtagtttccaacactccatctttctaaagtctttaaattacacctgtctttcagccatctctcttacaagggctttcatcttcctgggatataattcacctaggttagaatataggaactcataaggaatacaaacgcatcgtaagatctcttcgtacatttgggatgtcgtttcccacttagtagtgtttgagctaccttcgtcatccctgtcagcat

SEQ ID NO: 29675 - DNA, 601 bp, Human
aaaattagctgggcctggtggctcacgcctgtaattctagcactttgggaggccaaggcaggtggatcacctgaggtcaggagtttcagactagcctggccaacatggtgaaaccccgtctctactagaaatacaaaaattagccgggcgtggtggcacactcctgtaatcccagctacttgggaggctgaggcaggagaatcgtttgaacccaggagttggaggttgcagtgagccgagatagcaccactgcactctagcctgggtaacagagcgagactccgtctcaaaaaagaaaagaaaaaaaaaaaaaaaagctgaggtgggaggatgacttgagcctgggaggcagaggttgtagtgagctgagatcatgcaactccactctagtgtgcggagtgatagctagatcttctatcataaaaaaaaagaaaaagaaaaaatgccctttccaataacattttcttaagtttgtatttaatgaagattgtaacatatatattgttttgatcaattttatgctaataatgattatgataaactagaataattttctaagacttaaagacatacagttataggaaataaaagaatttttatg

SEQ ID NO: 29676 - DNA, 601 bp, Human
gaattcaccattataagttagttgttaaacttgacaagctgttcaaatctatatactatatatgtgaaccttcggacaaggtgctctgctctcgttttctcatccatgaaggaattactatgaggatcaaatgagatacatgtaaatagtttagcacaattagcacatagtaagggcttaatagatgttagctttgaccatattgattctttaatagagcagtcttcatgctgttacccatatccctgggtacactcagactgtgttatacaagggtaacgggcacgttgatagttttaarggaatcagtttttggatcctaaacttcagtaggtcctgttgctgaatatttctctgcctgagaacagaacttctcaagcagttctctttcccttagtcacttttcatagtcaacccctcctagtttacaaatagaaggcctgaggtgtaaaacttcaaggttccaaacggtgttgtaattcgaagtaaaggcatcagtgtaggctatgtcgggatatcaaataagtgtttacatgacagatggttttcaattgtttgctttcaaccaagttgctggatcattgaaaataattttcgatga

SEQ ID NO: 29677 - DNA, 601 bp, Human
agactacaggtgcatgccactatacctggctaatttttgtattttttgtagagacaaggttttaccatgttgcccaggctggtctcaaactcctgggctcaagcagtctgcccgcatcggcccgcaaagtgctgggattacaggtgtgagccactgtgcccagcctgattacagttttctttgttctctacttgggaggctgaggcagaagaattgcttgagccggggaggccaaggttgcagttagccgagatcgttccacggtactgcagcctgggccacagagcaagaccctgtctcaaaaaaaaaaaaaaaaaaattcttttttctttttttaaattttaaccgtctttggctactgattacaattttcaatgagaaaaagtttctaaactttcttatcacaataattgcagctaacgtttctttaaaaataaaaattttattcaagtaatatgattatggtaatttaagttccaggttattttaccttaaaaaaagttttaaatcatcctaggttgtcatgactgcaaaaaaattatattgtcacacttatttgtagattataaaatttactgagaagacttttaagatagtggca

SEQ ID NO: 29678 - DNA, 601 bp, Human
gcaacctcaagccagcctcctgcctcagccttctgaatagctgagactacaggtgcatgccactatacctggctaatttttgtattttttgtagagacaaggttttaccatgttgcccaggctggtctcaaactcctgggctcaagcagtctgcccgcatcggcccgcaaagtgctgggattacaggtgtgagccactgtgcccagcctgattacagttttctttgttctctacttgggaggctgaggcagaagaattgcttgagccggggaggccaaggttgcagttagccgagatcgtyccacggtactgcagcctgggccacagagcaagaccctgtctcaaaaaaaaaaaaaaaaaaattcttttttctttttttaaattttaaccgtctttggctactgattacaattttcaatgagaaaaagtttctaaactttcttatcacaataattgcagctaacgtttctttaaaaataaaaattttattcaagtaatatgattatggtaatttaagttccaggttattttaccttaaaaaaagttttaaatcatcctaggttgtcatgactgcaaaaaaattatattgtcacacttattt

SEQ ID NO: 29679 - DNA, 601 bp, Human
caggagaaacatgcctggtgtacacatcgctgtatgttcacatcagtaaatatattggaggaatacctactgtctagattctgtcctgtattcatatgtagaatttataactaaatcatttctgaaaagctaattgtttgattacaatttccttttttatttccatagacagcacctggctctgttgcccaggctggagtgcagtgctgcgatctccgctcactgcaacctcaagccagcctcctgcctcagccttctgaatagctgagactacaggtgcatgccactatacctggctaatttttgtattttttgtagagacaaggttttaccatgttgcccaggctggtctcaaactcctgggctcaagcagtctgcccgcatcggcccgcaaagtgctgggattacaggtgtgagccactgtgcccagcctgattacagttttctttgttctctacttgggaggctgaggcagaagaattgcttgagccggggaggccaaggttgcagttagccgagatcgttccacggtactgcagcctgggccacagagcaagaccctgtctcaaaaaaaaaaaaaaaaaaattcttttttcttttt

SEQ ID NO: 29680 - DNA, 601 bp, Human
aaaaaaaaagcaaggatacctttaatcttttaaaatgtatttcattgtttaaaggtgtgtttgggcatttgtttcccttttagtttttgaaaaatttccaaaattcagttgtattccttaccttttaaatatttttgtctttcaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgmctcagctatacatttacatcagattattgggagcctatttgttcatcatttctcgtgttcaaggtaaatcagtgttcattttagtaatgtatgtgtgtatataaaaagcactatttcttgcttctgttctttcaactcatccctgtttgaatagttaggcccagcctactagggcagcttttaggaaagaagcaaagatgaaacacgtgccaaataattttttaacttggctgtgatggaaacattttcaagtatttttgaaatctcagtctgagtctgtcttctccttcacaacatagg

SEQ ID NO: 29681 - DNA, 601 bp, Human
gtttctttgttctgtaccaggacggacgctggtcataaatactgaaccatcgtagcccagccacttcacccacaccagggtaaaagggtgggggagcggaggaggggcaaggttccatcccgagcacaactaccagaaacggaaaagcgacggggtggggggccaaactgccaaatacaaacaggacccaagccaagggcggggacctaagcagggcggggatccaggaagcacctcccgagcaggttctatggctccccctaccaagggtaactctctgggtttcctctccccggacgtygtgggcacgcgcccgacagactttcgcccctaggccggttcccagtccagctccggagccaccgtgccgagttctcccaggccgcactcaccccggaggaagccttggccccctcgtcctcttcgcccctccaggccggcgacgtggggctgacggccaggtcgcaaaaagcagggccgagcggagcccgctcccctcggtcggcggtggagaccccggcccaatcccccggccgcagcggtacggcgtcggcggcagcagctgacccggacacagtgagaagccccggcggaagtgata

SEQ ID NO: 29682 - DNA, 601 bp, Human
tataacacaattttacacagtgattttactatatgcagtttaatactggtgctgcaataggtgccagtaatgaccgtttatgcggaaatcaattacagtaggcagatggaaacgcccgggcaagcctttcacttccccatttaaacaaaaaggtttcattctaaacatttatgttcactttttaaccaacagcctgtatgtttaggagatcaccaaacatgcttgaaaaaatcctagacatgtgcttgtcattgctcccatgagggtagttttcaaacaatgaaatgaagtgctctatcasaaatgttaacacaagccgggcgtggtggctcacacctgtaatcccaacactttgggaggctgaggcggacggatcacctgacgtcaggagttcaagaccagcctggccaacatggtgaaaccccatctctaccaaaaatacaaaaattagccaggagtggtggcactggcctgtaatccaagcgatcagggaggctgaggcaggagaatcgcttgaacctgggaggcagaggttgcagtgagccgagattgcgccattgcattccagcctgggtgacagagcgagactgcatctcaaaaa

SEQ ID NO: 29683 - DNA, 601 bp, Human
actgtttagattataacacaattttacacagtgattttactatatgcagtttaatactggtgctgcaataggtgccagtaatgaccgtttatgcggaaatcaattacagtaggcagatggaaacgcccgggcaagcctttcacttccccatttaaacaaaaaggtttcattctaaacatttatgttcactttttaaccaacagcctgtatgtttaggagatcaccaaacatgcttgaaaaaatcctagacatgtgcttgtcattgctcccatgagggtagttttcaaacaatgaaatgaastgctctatcagaaatgttaacacaagccgggcgtggtggctcacacctgtaatcccaacactttgggaggctgaggcggacggatcacctgacgtcaggagttcaagaccagcctggccaacatggtgaaaccccatctctaccaaaaatacaaaaattagccaggagtggtggcactggcctgtaatccaagcgatcagggaggctgaggcaggagaatcgcttgaacctgggaggcagaggttgcagtgagccgagattgcgccattgcattccagcctgggtgacagagcgagactg

SEQ ID NO: 29684 - DNA, 601 bp, Human
aaggcaggagaatcgctggaaccccagaggtgaaggttgcagtgagctgagattgcaccactgcactacagcctgggtgacaaagggagactctgtctcaaaaaacaaaacaaaacaaacaacaacaaaaactaaatagctcctcgaaacacaggcagcccaagtctttcagctatctcagcctatttattccatttttaccttaatatcatattgaatcatgtgttaatacctcagcacatagacatggatatttagtttgaggataatcaattatctagttaaacagaacttggggagrgagatatagatagatttactctaccatttcatcatgaattttaggggaaaagtacactaggtagatcaaaacaatttaaacaattgagggagtactgtttcttggaagcactttatcatcaaacagctgttaagaacaggaaacaaacaagaaaggagttaatataaccacaacctcttcgaagaaaatcaggatactgctgactcacaagttaactgttgttgcttcccatttcttgttcatgtatttttttttggaaattagaatgggaaataacactttaagatgatatttgttaaa

SEQ ID NO: 29685 - DNA, 601 bp, Human
gctgcttaaccaatggaacaagtttgtctctgtgaaaacagctccttgaggccggacgtggtggctcacacctgtaatcccagcactttgggaggctgaggtgggcggatcacctgaggtcaggagtttgagaccagcctgaccaagatggtgataccccgtttccacaaaaaatacaaaaaatcagccaggcgtggtggcgcctgcctgtaatcccagctactatggaggctaaggcaggagaatcgctggaaccccagaggtgaaggttgcagtgagctgagattgcaccactgcactmcagcctgggtgacaaagggagactctgtctcaaaaaacaaaacaaaacaaacaacaacaaaaactaaatagctcctcgaaacacaggcagcccaagtctttcagctatctcagcctatttattccatttttaccttaatatcatattgaatcatgtgttaatacctcagcacatagacatggatatttagtttgaggataatcaattatctagttaaacagaacttggggagggagatatagatagatttactctaccatttcatcatgaattttaggggaaaagtacactaggtagatc

SEQ ID NO: 29686 - DNA, 601 bp, Human
atcttgggaaattctagaagacaatccattcctttcagctgcttaaccaatggaacaagtttgtctctgtgaaaacagctccttgaggccggacgtggtggctcacacctgtaatcccagcactttgggaggctgaggtgggcggatcacctgaggtcaggagtttgagaccagcctgaccaagatggtgataccccgtttccacaaaaaatacaaaaaatcagccaggcgtggtggcgcctgcctgtaatcccagctactatggaggctaaggcaggagaatcgctggaaccccagaggygaaggttgcagtgagctgagattgcaccactgcactacagcctgggtgacaaagggagactctgtctcaaaaaacaaaacaaaacaaacaacaacaaaaactaaatagctcctcgaaacacaggcagcccaagtctttcagctatctcagcctatttattccatttttaccttaatatcatattgaatcatgtgttaatacctcagcacatagacatggatatttagtttgaggataatcaattatctagttaaacagaacttggggagggagatatagatagatttactctaccatttc

SEQ ID NO: 29687 - DNA, 601 bp, Human
ttctattatcttgtcgtacctttttattgtgtgttgaaaaaaacaccaggatgttgtctgggtgtctttttcaaatatctcaaatactcagaaaaatatttagcatttcaaaaataaaagcagaaactgaaagttgtacccaatatattcccaacacctaccatggtgcctagcacataacaggcctataaaaattaagtaaataatacttacctgtagggtatggacactggtcagcaaacctttgctcaatctcttaggcttattttgcttattaaactacatgaataggatttgtcaygtgttaccccataaaaatgtaacaaaaatattctgtgggaaactacacaccagcaatattaatttctatttgtaaaattgttcctcactggtaagaggaaaggtttatcttgggaaattctagaagacaatccattcctttcagctgcttaaccaatggaacaagtttgtctctgtgaaaacagctccttgaggccggacgtggtggctcacacctgtaatcccagcactttgggaggctgaggtgggcggatcacctgaggtcaggagtttgagaccagcctgaccaagatggtgatac

SEQ ID NO: 29688 - DNA, 601 bp, Human
tcccctctgtttagaacagaaatagtagaaaggagcccacaattacaatcaacaagcccaaatggtgaaaatacttactactctagaattacaatgctcaagtgagaccaaagcattctatgactaaaggctgaaaactgctaagtcttttctagatgtttaatttactgtatttcccaatgtttaacttttcttaagtctttggtactcactctaaagcgaatgatgtattttcctaaattcaataatcagaaaagctttctattatcttgtcgtacctttttattgtgtgttgaaaaamacaccaggatgttgtctgggtgtctttttcaaatatctcaaatactcagaaaaatatttagcatttcaaaaataaaagcagaaactgaaagttgtacccaatatattcccaacacctaccatggtgcctagcacataacaggcctataaaaattaagtaaataatacttacctgtagggtatggacactggtcagcaaacctttgctcaatctcttaggcttattttgcttattaaactacatgaataggatttgtcacgtgttaccccataaaaatgtaacaaaaatattctgtgggaa

SEQ ID NO: 29689 - DNA, 601 bp, Human
acttatttgcttgaaaaagtcatttacatataggagtaaggtttttaattctctgggaaaacaatgatctaggcagtttttataagttaatgaaaaacatttaaaataatctttacttatttagcactttctctgttgggagggaaaaataaacaaaaagagggacacctaccttaccaaacaatcccctctgtttagaacagaaatagtagaaaggagcccacaattacaatcaacaagcccaaatggtgaaaatacttactactctagaattacaatgctcaagtgagaccaaagcatkctatgactaaaggctgaaaactgctaagtcttttctagatgtttaatttactgtatttcccaatgtttaacttttcttaagtctttggtactcactctaaagcgaatgatgtattttcctaaattcaataatcagaaaagctttctattatcttgtcgtacctttttattgtgtgttgaaaaaaacaccaggatgttgtctgggtgtctttttcaaatatctcaaatactcagaaaaatatttagcatttcaaaaataaaagcagaaactgaaagttgtacccaatatattcccaacacc

SEQ ID NO: 29690 - DNA, 601 bp, Human
ttgatttttaaaacaatactatctgtgactttaaaagatatttattaaataaaatcaattatgtcagccattcacatcaaccagtcttctaaaagaaaaatgtggtcatgtcctatagctatcttatctgctacgtcaacattcaaaagatgcacaaagttacaaagaaaaaagccttatgttccgtaatgacaaaattacaatggaaatatcctgaagtgttagatttcacaaggtaaactaaatttgtatctctgccaaggctggaagactctcttcccagtttgaatttttacttacmctcaagagaaggttttaaacattcccaaaaggtttcaatgtttgatgatacacttgttaccacagaaaaaaaatggtagatgctgacttttccacaccaacttatttgcttgaaaaagtcatttacatataggagtaaggtttttaattctctgggaaaacaatgatctaggcagtttttataagttaatgaaaaacatttaaaataatctttacttatttagcactttctctgttgggagggaaaaataaacaaaaagagggacacctaccttaccaaacaatcccctctgtttagaac

SEQ ID NO: 29691 - DNA, 601 bp, Human
tttgatttttaaaacaatactatctgtgactttaaaagatatttattaaataaaatcaattatgtcagccattcacatcaaccagtcttctaaaagaaaaatgtggtcatgtcctatagctatcttatctgctacgtcaacattcaaaagatgcacaaagttacaaagaaaaaagccttatgttccgtaatgacaaaattacaatggaaatatcctgaagtgttagatttcacaaggtaaactaaatttgtatctctgccaaggctggaagactctcttcccagtttgaatttttacttaycctcaagagaaggttttaaacattcccaaaaggtttcaatgtttgatgatacacttgttaccacagaaaaaaaatggtagatgctgacttttccacaccaacttatttgcttgaaaaagtcatttacatataggagtaaggtttttaattctctgggaaaacaatgatctaggcagtttttataagttaatgaaaaacatttaaaataatctttacttatttagcactttctctgttgggagggaaaaataaacaaaaagagggacacctaccttaccaaacaatcccctctgtttagaa

SEQ ID NO: 29692 - DNA, 601 bp, Human
tgcttttcatagtaagtccgtctataccatttgatttttaaaacaatactatctgtgactttaaaagatatttattaaataaaatcaattatgtcagccattcacatcaaccagtcttctaaaagaaaaatgtggtcatgtcctatagctatcttatctgctacgtcaacattcaaaagatgcacaaagttacaaagaaaaaagccttatgttccgtaatgacaaaattacaatggaaatatcctgaagtgttagatttcacaaggtaaactaaatttgtatctctgccaaggctggaagrctctcttcccagtttgaatttttacttaccctcaagagaaggttttaaacattcccaaaaggtttcaatgtttgatgatacacttgttaccacagaaaaaaaatggtagatgctgacttttccacaccaacttatttgcttgaaaaagtcatttacatataggagtaaggtttttaattctctgggaaaacaatgatctaggcagtttttataagttaatgaaaaacatttaaaataatctttacttatttagcactttctctgttgggagggaaaaataaacaaaaagagggacaccta

SEQ ID NO: 29693 - DNA, 601 bp, Human
gaggtggaggttgcagcgagccgaggtcacaccattgcactccagtctgggtgacagagcaaaaccagtagcagaggaaagagggtgaaatgcagaaaatgactaatgcttttcatagtaagtccgtctataccatttgatttttaaaacaatactatctgtgactttaaaagatatttattaaataaaatcaattatgtcagccattcacatcaaccagtcttctaaaagaaaaatgtggtcatgtcctatagctatcttatctgctacgtcaacattcaaaagatgcacaaagttacawagaaaaaagccttatgttccgtaatgacaaaattacaatggaaatatcctgaagtgttagatttcacaaggtaaactaaatttgtatctctgccaaggctggaagactctcttcccagtttgaatttttacttaccctcaagagaaggttttaaacattcccaaaaggtttcaatgtttgatgatacacttgttaccacagaaaaaaaatggtagatgctgacttttccacaccaacttatttgcttgaaaaagtcatttacatataggagtaaggtttttaattctctgggaaaacaat

SEQ ID NO: 29694 - DNA, 601 bp, Human
atttctgttcttttcttttctttttgcagtaacatatttaagagatacggagcatcactagcagtactaaaaataaagttaaaagtcgttgacactaggccgggcgcggtggctcacgcctgtaatcctagcactttgggaggccgaggtgggcggatcacttgaggtcaggagttcaaaaccagcctggccaacacggtgaaacccagtctctactaaaaatacaaaaacattagccggatgtggtggcaggcgcctgtaatcccagctacttgggaggctgaggcaggagaatcgcttraacctgggaggtggaggttgcagcgagccgaggtcacaccattgcactccagtctgggtgacagagcaaaaccagtagcagaggaaagagggtgaaatgcagaaaatgactaatgcttttcatagtaagtccgtctataccatttgatttttaaaacaatactatctgtgactttaaaagatatttattaaataaaatcaattatgtcagccattcacatcaaccagtcttctaaaagaaaaatgtggtcatgtcctatagctatcttatctgctacgtcaacattcaaaagatgcacaa

SEQ ID NO: 29695 - DNA, 601 bp, Human
gaaatagaagttgaggtaaggtaaagatcaactggttaacaatgcaacaaaacagtgaaaactatagaaggaaagaggtatacacgagtatttagttcatttacattcaagtcaatagatgtctaaagttattcaacaaacagcagtaacatatttctgttcttttcttttctttttgcagtaacatatttaagagatacggagcatcactagcagtactaaaaataaagttaaaagtcgttgacactaggccgggcgcggtggctcacgcctgtaatcctagcactttgggaggccgagrtgggcggatcacttgaggtcaggagttcaaaaccagcctggccaacacggtgaaacccagtctctactaaaaatacaaaaacattagccggatgtggtggcaggcgcctgtaatcccagctacttgggaggctgaggcaggagaatcgcttgaacctgggaggtggaggttgcagcgagccgaggtcacaccattgcactccagtctgggtgacagagcaaaaccagtagcagaggaaagagggtgaaatgcagaaaatgactaatgcttttcatagtaagtccgtctataccatttgat

SEQ ID NO: 29696 - DNA, 601 bp, Human
gcccttttatgcaactacgtattttaacatatgccatgaactttagttttagtttttccaaggaatcacgtgagtgccaatatcctcattttaaaagtaagaaatctagagatactccctctggtgatggagtaagaaatagaagttgaggtaaggtaaagatcaactggttaacaatgcaacaaaacagtgaaaactatagaaggaaagaggtatacacgagtatttagttcatttacattcaagtcaatagatgtctaaagttattcaacaaacagcagtaacatatttctgttctttycttttctttttgcagtaacatatttaagagatacggagcatcactagcagtactaaaaataaagttaaaagtcgttgacactaggccgggcgcggtggctcacgcctgtaatcctagcactttgggaggccgaggtgggcggatcacttgaggtcaggagttcaaaaccagcctggccaacacggtgaaacccagtctctactaaaaatacaaaaacattagccggatgtggtggcaggcgcctgtaatcccagctacttgggaggctgaggcaggagaatcgcttgaacctgggaggtg

SEQ ID NO: 29697 - DNA, 601 bp, Human
gatcgcgccactgcactccagcctgggcaacagagcaagactccgtctcaaaaaaaaaaaaagtaacatctcgataaagaaattttgaagttttgctctaaaattgttttcttttaaaagcattgctcacatcggaaaatcttcatcttgccattcttctttaagttccacaccttccatcctcagcctggattcaatgtcaactacaaactcttgataatccagggagccaatgtcctatgaagagagaaaaatgtataacttaatttccactttactttttatccactgaaaaggcgtrataatcttatatattagttcatacttgatgtttagtacaatggtctggtcatgaaattcatttacagggttgcaatttttttttttttttaaagaaaagagaatactcagactacatatattctgggaaagttaaatactgtttatagtaaggatactgttcagtgaaaatacttgttttcagttgcatgtatagtatctcaggttatgattgaaaatatatttcatactatggattatattaaaaaatttgaagtggggtaagaaataaaaatgttctttattacagactcataattaa

SEQ ID NO: 29698 - DNA, 601 bp, Human
ccgaagaaactttacttcctagtatcaaatgatcgccttgtattactgagtttctcagtgacatctcagctgtgcagtggctcacacctgtaatcccagcactttgggaggccaaggcaggcagatcacgaggtcaggagtttgagaccagcctggccaatatggtgaaacaccgtctctattaaaaatacaaaaattagccaggcgtggtggcgcacacctatagtcccagctacctgggaggtggaggcagaagaattgcttgaatccaggaggcggaggttgcagtgagctgagatckcgccactgcactccagcctgggcaacagagcaagactccgtctcaaaaaaaaaaaaagtaacatctcgataaagaaattttgaagttttgctctaaaattgttttcttttaaaagcattgctcacatcggaaaatcttcatcttgccattcttctttaagttccacaccttccatcctcagcctggattcaatgtcaactacaaactcttgataatccagggagccaatgtcctatgaagagagaaaaatgtataacttaatttccactttactttttatccactgaaaaggcgtgataa

SEQ ID NO: 29699 - DNA, 601 bp, Human
acaagagaatcaatctaactgttccgaagaaactttacttcctagtatcaaatgatcgccttgtattactgagtttctcagtgacatctcagctgtgcagtggctcacacctgtaatcccagcactttgggaggccaaggcaggcagatcacgaggtcaggagtttgagaccagcctggccaatatggtgaaacaccgtctctattaaaaatacaaaaattagccaggcgtggtggcgcacacctatagtcccagctacctgggaggtggaggcagaagaattgcttgaatccaggaggcrgaggttgcagtgagctgagatcgcgccactgcactccagcctgggcaacagagcaagactccgtctcaaaaaaaaaaaaagtaacatctcgataaagaaattttgaagttttgctctaaaattgttttcttttaaaagcattgctcacatcggaaaatcttcatcttgccattcttctttaagttccacaccttccatcctcagcctggattcaatgtcaactacaaactcttgataatccagggagccaatgtcctatgaagagagaaaaatgtataacttaatttccactttactttt

SEQ ID NO: 29700 - DNA, 601 bp, Human
acctgattatgcactaggatgtcttctgacaagtacggcacggaagcactatttaaacttaaggtctgcctttgctctctttttcattagcctacctggtgccaatataattgtaaatacaaatgcaaacatgtcaaggtggctggccagataagctagaaaatccttattaatttacttagtaaggtttttttttttttggtgggggggaacccacaaatttttttttttttttttgagatagagccttgctcggtcgcccaagctggagtgcagcagcgcgaccttggctcacggcaamccctgcctcctgggttcaggtgattcttgtgcctctgcctcctaagcagctgggactacaggcgagcgccaagcctggctaattttttgtatttttagtagagacggggtttcaccatgttggccacgttggtctcaaactcctggcctcaagtgatctgcctatctcggcctcccaaagtgctggggttacaggcgtgagccaccgcacctggccacaaaattaaagaaacattttaaagacaactaaagacctccttctctgaggaatccctcagatcttgtttaaatgaaaacaaaa

SEQ ID NO: 29701 - DNA, 601 bp, Human
tttactatcaccaccatatgcaacagtgactcaggtctccgatcagctgtccaactgctaagctatccaactgctaaggcacctgattatgcactaggatgtcttctgacaagtacggcacggaagcactatttaaacttaaggtctgcctttgctctctttttcattagcctacctggtgccaatataattgtaaatacaaatgcaaacatgtcaaggtggctggccagataagctagaaaatccttattaatttacttagtaaggtttttttttttttggtgggggggaacccacaaatttttttttttttttttgagatagagccttgctcggtcgcccaagctggagtgcagcagcgcgaccttggctcacggcaacccctgcctcctgggttcaggtgattcttgtgcctctgcctcctaagcagctgggactacaggcgagcgccaagcctggctaattttttgtatttttagtagagacggggtttcaccatgttggccacgttggtctcaaactcctggcctcaagtgatctgcctatctcggcctcccaaagtgctggggttacaggcgtgagccaccgcacctggccacaa

SEQ ID NO: 29702 - DNA, 601 bp, Human
taaagcctcagccttctgagtagctaggactacagtggcacaccaacatgcccagctaattttaaaagtttttttggtagagaccgggtattgctatgttgcccaggctggtctcaagcaatccttctgcctcggcctcccaaagcactaggattataggcgtgagctgctatgcctggctacactttcaaagtaaaaattctgactgtcagagctgacttatacacttattatatataagtaacacataaaagtagatataaattccttatgcaacagctcttatacaattataaaacakgtaacaattttaaacaaatatgactgaaatgcacaaatataatgtgatgtatgatgcaatgtatgaagctcaatttttactcacgagactacagtaacaatggttcaattcttctgagatcagcattcctatatttactatcaccaccatatgcaacagtgactcaggtctccgatcagctgtccaactgctaagctatccaactgctaaggcacctgattatgcactaggatgtcttctgacaagtacggcacggaagcactatttaaacttaaggtctgcctttgctctctttttcat

SEQ ID NO: 29703 - DNA, 601 bp, Human
acaggtgcgtgccacgacgcttggctaatttttagtacagacagggtcttgctatgttacccaggctggccttgaacttttgggctcaaacgattctcgtgcattgacctccctaagtgttgggattacaggcatgagccactgtgcccagcctagcagtgtttaagataaagcctcagccttctgagtagctaggactacagtggcacaccaacatgcccagctaattttaaaagtttttttggtagagaccgggtattgctatgttgcccaggctggtctcaagcaatccttctgcctyggcctcccaaagcactaggattataggcgtgagctgctatgcctggctacactttcaaagtaaaaattctgactgtcagagctgacttatacacttattatatataagtaacacataaaagtagatataaattccttatgcaacagctcttatacaattataaaacaggtaacaattttaaacaaatatgactgaaatgcacaaatataatgtgatgtatgatgcaatgtatgaagctcaatttttactcacgagactacagtaacaatggttcaattcttctgagatcagcattcctat

SEQ ID NO: 29704 - DNA, 601 bp, Human
gccttaactcctgggctcaagagatcctcccgagtatctaagactacaggtgcgtgccacgacgcttggctaatttttagtacagacagggtcttgctatgttacccaggctggccttgaacttttgggctcaaacgattctcgtgcattgacctccctaagtgttgggattacaggcatgagccactgtgcccagcctagcagtgtttaagataaagcctcagccttctgagtagctaggactacagtggcacaccaacatgcccagctaattttaaaagtttttttggtagagaccggrtattgctatgttgcccaggctggtctcaagcaatccttctgcctcggcctcccaaagcactaggattataggcgtgagctgctatgcctggctacactttcaaagtaaaaattctgactgtcagagctgacttatacacttattatatataagtaacacataaaagtagatataaattccttatgcaacagctcttatacaattataaaacaggtaacaattttaaacaaatatgactgaaatgcacaaatataatgtgatgtatgatgcaatgtatgaagctcaatttttactcacgag

SEQ ID NO: 29705 - DNA, 601 bp, Human
agcagtgttgttgtttttgagacagggtcttgctgtctgtcacctaggctggaatacaatggcacaatcatggctcactgcagccttaactcctgggctcaagagatcctcccgagtatctaagactacaggtgcgtgccacgacgcttggctaatttttagtacagacagggtcttgctatgttacccaggctggccttgaacttttgggctcaaacgattctcgtgcattgacctccctaagtgttgggattacaggcatgagccactgtgcccagcctagcagtgtttaagataaagyctcagccttctgagtagctaggactacagtggcacaccaacatgcccagctaattttaaaagtttttttggtagagaccgggtattgctatgttgcccaggctggtctcaagcaatccttctgcctcggcctcccaaagcactaggattataggcgtgagctgctatgcctggctacactttcaaagtaaaaattctgactgtcagagctgacttatacacttattatatataagtaacacataaaagtagatataaattccttatgcaacagctcttatacaattataaaacaggtaac

SEQ ID NO: 29706 - DNA, 601 bp, Human
atactatcatcttctggtaaaggtctagaagacacaggcatactttttaatccagaaattaagaaagaatttttttttgaagttcaatctattaaacatacagcttatagaaataattatttggaaaatggaataaagcagtgttgttgtttttgagacagggtcttgctgtctgtcacctaggctggaatacaatggcacaatcatggctcactgcagccttaactcctgggctcaagagatcctcccgagtatctaagactacaggtgcgtgccacgacgcttggctaatttttagtasagacagggtcttgctatgttacccaggctggccttgaacttttgggctcaaacgattctcgtgcattgacctccctaagtgttgggattacaggcatgagccactgtgcccagcctagcagtgtttaagataaagcctcagccttctgagtagctaggactacagtggcacaccaacatgcccagctaattttaaaagtttttttggtagagaccgggtattgctatgttgcccaggctggtctcaagcaatccttctgcctcggcctcccaaagcactaggattataggcgtgagctgc

SEQ ID NO: 29707 - DNA, 601 bp, Human
tcctttgaattacaagtaataaggaatactaggttcgggggctaaaagtatacattaatttaagttggtcatttcacaaagtagagcaatgtcaggcaaacctacttaaaaagtcaccccaaatgcctcctttcagaactcccttcccacaaactgttaactatatgtctcttcaaaagtttcttacttgattgactaaaaaagagcatgccataattatcaagaaatatttttgaaacagctatgaaaaaaacatgagagcagtgggcaaataagaggggaaaaaagccactggtgtacyctatacacactttttaagtccttgagaatattcaagggttagcacaatttcctatcttagtaacaaatatatgaactttagaaagaatgatgtatttcaaacaaaatcccttagtacattaataaagatcagattaaaaacagtgaaacatttaccttcccactcaaactcattactattctctgacggtgtgtctaagccatctaagtcaatctccccactttcatccaaatcatctgacaatacagagccatcactaggatccagtgtcaggctaatgtctggagccattagtttctt

SEQ ID NO: 29708 - DNA, 601 bp, Human
gcaaagtaaaacagcacaattcctttgaattacaagtaataaggaatactaggttcgggggctaaaagtatacattaatttaagttggtcatttcacaaagtagagcaatgtcaggcaaacctacttaaaaagtcaccccaaatgcctcctttcagaactcccttcccacaaactgttaactatatgtctcttcaaaagtttcttacttgattgactaaaaaagagcatgccataattatcaagaaatatttttgaaacagctatgaaaaaaacatgagagcagtgggcaaataagagggsaaaaaagccactggtgtaccctatacacactttttaagtccttgagaatattcaagggttagcacaatttcctatcttagtaacaaatatatgaactttagaaagaatgatgtatttcaaacaaaatcccttagtacattaataaagatcagattaaaaacagtgaaacatttaccttcccactcaaactcattactattctctgacggtgtgtctaagccatctaagtcaatctccccactttcatccaaatcatctgacaatacagagccatcactaggatccagtgtcaggctaatg

SEQ ID NO: 29709 - DNA, 601 bp, Human
ttttcaagatggaaaaaaatatgtaaaaattataacaactatatataagatactgtagacaattttgtaattaaagaaagcatgcaaagtaaaacagcacaattcctttgaattacaagtaataaggaatactaggttcgggggctaaaagtatacattaatttaagttggtcatttcacaaagtagagcaatgtcaggcaaacctacttaaaaagtcaccccaaatgcctcctttcagaactcccttcccacaaactgttaactatatgtctcttcaaaagtttcttacttgattgactraaaaagagcatgccataattatcaagaaatatttttgaaacagctatgaaaaaaacatgagagcagtgggcaaataagaggggaaaaaagccactggtgtaccctatacacactttttaagtccttgagaatattcaagggttagcacaatttcctatcttagtaacaaatatatgaactttagaaagaatgatgtatttcaaacaaaatcccttagtacattaataaagatcagattaaaaacagtgaaacatttaccttcccactcaaactcattactattctctgacggtgtgtcta

SEQ ID NO: 29710 - DNA, 601 bp, Human
tcacatgcacataaaaaaaaatggataagcaaattatggtttatccaagcaatggaaaactactcagcaataagaaggaatgtactgtggatacgtgcaacaacatggatgaatctcaaaaacttcatgctgaaaagtaaacaaaagagtgcataggatgattttagttactatatatgaaattctagaagaggcaaaactaatcagggggtagatatgacagtggctaccgaaggtgagtattcattgcacaggggtactaaataattcttctgggacaatgaaaatgttctacattttyaggggtatgggttttatatatatgggtatatatggttatataggcatttgtcaaaactcattgaactgcacacttaagatcagagcatttcactgtttataaattagggagactgttcagtcccagttttgggtagcctagagacagtttaaaaaattttttaattttgagacagggtcaaaaaccaaaacaaaacaaaaaactagagtgcagtgggatgatcacggccactgaagcctcatcttcccaagctcaagctctctctcctcccaccccagcctcctaagtagctgggactac

SEQ ID NO: 29711 - DNA, 601 bp, Human
catctggcagagagtaaatcaagtggaaatgaccctgaaaaaaaatcaatctgcttgacccatatgccctccgtcctgtgttaggaggatttaaggtagtatgtcatgctctacagtgagttgtgttctgacttaccactaacattctagcactatttacaatgtgcctaggttaacttctatatatggtactgttagattgaaaggatttataacttaaacttttatggcttttcctatttcttaagggcagggacttaagccttgtatttttgtatatcccataagtatggaaagtggstgctgtatagaagtgtggagtgaactagttctctattaaaaaataatttggcctgggcactgtggctcatgcctgtaatcccagcactttgggaggctgaggcgggcagatcacaaggtcaggagttcgagaccagcctggccaatatggtgaaaccccgtctctactaaaaatacaaaaattagccaggcgtggtggcgtgcacctgtagtcccacctacttgggaggctgaggctggcgtatcgcttgagcctgggaggcagaggttgcagtgagccgagattgcgccactgcactcc

SEQ ID NO: 29712 - DNA, 601 bp, Human
aatgcaactacaaatattcatgtgatttgctttcagatgaatgaagactgtagaaataagcaggggaatgcatctggcagagagtaaatcaagtggaaatgaccctgaaaaaaaatcaatctgcttgacccatatgccctccgtcctgtgttaggaggatttaaggtagtatgtcatgctctacagtgagttgtgttctgacttaccactaacattctagcactatttacaatgtgcctaggttaacttctatatatggtactgttagattgaaaggatttataacttaaacttttatggyttttcctatttcttaagggcagggacttaagccttgtatttttgtatatcccataagtatggaaagtgggtgctgtatagaagtgtggagtgaactagttctctattaaaaaataatttggcctgggcactgtggctcatgcctgtaatcccagcactttgggaggctgaggcgggcagatcacaaggtcaggagttcgagaccagcctggccaatatggtgaaaccccgtctctactaaaaatacaaaaattagccaggcgtggtggcgtgcacctgtagtcccacctacttgggaggc

SEQ ID NO: 29713 - DNA, 601 bp, Human
gatttaagccataaatcaggtcttataatttgattcctgtgaactagctgaataatgtatgtctgtggacttcctgatgcagattacgccattttcttcatctgagtacgattaaattaggcagaagaatgcaactacaaatattcatgtgatttgctttcagatgaatgaagactgtagaaataagcaggggaatgcatctggcagagagtaaatcaagtggaaatgaccctgaaaaaaaatcaatctgcttgacccatatgccctccgtcctgtgttaggaggatttaaggtagtatgwcatgctctacagtgagttgtgttctgacttaccactaacattctagcactatttacaatgtgcctaggttaacttctatatatggtactgttagattgaaaggatttataacttaaacttttatggcttttcctatttcttaagggcagggacttaagccttgtatttttgtatatcccataagtatggaaagtgggtgctgtatagaagtgtggagtgaactagttctctattaaaaaataatttggcctgggcactgtggctcatgcctgtaatcccagcactttgggaggctgaggc

SEQ ID NO: 29714 - DNA, 601 bp, Human
tcagtaatggaaaacagcgctaaaatatgtatgtttcaacagcagtctttagatattaagccaatatttagtagcaaatacttctgctttaaccttcatttctattgcttacaaatttgcacatgaaaagatttgaacatttcaagaacatcagaatcttcactacctttcttaatcactcagtcacaaaatatattaagtgtggtaatgcaataaaataaggtggtcttattttcccctataaaaaaagtgctatttctgaaagataagagatttaagccataaatcaggtcttataatwtgattcctgtgaactagctgaataatgtatgtctgtggacttcctgatgcagattacgccattttcttcatctgagtacgattaaattaggcagaagaatgcaactacaaatattcatgtgatttgctttcagatgaatgaagactgtagaaataagcaggggaatgcatctggcagagagtaaatcaagtggaaatgaccctgaaaaaaaatcaatctgcttgacccatatgccctccgtcctgtgttaggaggatttaaggtagtatgtcatgctctacagtgagttgtgttctgact

SEQ ID NO: 29715 - DNA, 601 bp, Human
cactccagcctgggcaacagagcaagacttgggtctcaaaaaaaaaaaaaaaacaaaaacaaaaaaacaaactaaattacatctctgacataattttcagtaatggaaaacagcgctaaaatatgtatgtttcaacagcagtctttagatattaagccaatatttagtagcaaatacttctgctttaaccttcatttctattgcttacaaatttgcacatgaaaagatttgaacatttcaagaacatcagaatcttcactacctttcttaatcactcagtcacaaaatatattaagtgtgrtaatgcaataaaataaggtggtcttattttcccctataaaaaaagtgctatttctgaaagataagagatttaagccataaatcaggtcttataatttgattcctgtgaactagctgaataatgtatgtctgtggacttcctgatgcagattacgccattttcttcatctgagtacgattaaattaggcagaagaatgcaactacaaatattcatgtgatttgctttcagatgaatgaagactgtagaaataagcaggggaatgcatctggcagagagtaaatcaagtggaaatgaccctg

SEQ ID NO: 29716 - DNA, 601 bp, Human
ttggccagactggtctcgaactcctgacctcgtgatctgcctgcctcagcctcccacagtgctgggattacaggcgtgagccaccgtgcccggcaaagtgggtgcttttttaaatttttttttagaggatagcatcttgctccattgcccaggatggagtgcagtggcacaatcacagctcatgcagccttgaacttctgggctcaagggatcttcccacctcatagcctccagaggagctggggatacagcgcacacaaacatgcctggttaacctttataaaattttttttgtagagayagggtttcactgtgttgctcagactggtcgtgaactcctggccttaagcaatcctcctcctttggcctcccaaagcactgggcatgagccacatcgccagagccataagtgggtgatttttaaaaggtaagtttatatttaaaaatgctagcattttgtagaaattaggacattaaaactaaattaggccgggcgaggtggttcatgcttgtaattccagcacttcgggaggctgaggtgggcagatcacttaaggccaggaattttgagaccagcctggccaacatggcgaaaccccat

SEQ ID NO: 29717 - DNA, 601 bp, Human
ataaataagagtttacttttcacagatttctgtattaaatgtatgttttgtaaatcttatatggtcttatatagaattttaatgtcttcttcccaaaaagagaacagtaaaatttaaagaggacggtggacagaaaaaacaaaaaaacccaagaccacttaaattcgcatatttaaaaagccagccctattttagcaggtagacaaatatagtgatataacccaatacaatacagacacaatacaataactgcaatgtatttttatttatttctatgatgcttatggttaaagtgggtgctttttttttttttttagatggagtctcgttctgtcgtccaggctggagggcagtggcacaatctcggctcactgcaacctccgcctcctggcttcacgcgattctcctgcctcccgagttgctgggattataagcgcacaccaccgtgcccggctaattttttgtgtatttttagtagagatggggtttcactaagttggccagactggtctcgaactcctgacctcgtgatctgcctgcctcagcctcccacagtgctgggattacaggcgtgagccaccgtgcccggcaaagtgggtgc

SEQ ID NO: 29718 - DNA, 601 bp, Human
tctccaactcctggactcaagtgatctgcccacttcagtctcccaaagaactggaatatttataatttttgaaaaggttaagtttcttaaggtgtagatctaattagctcagaattctgtccaaatgtttttgtttaatatatacttacttaaaaagattgtccatcaggtatctatagttaggctgactactttcaggcatgaaacagacagcaaacacaacaatggcatttaatccatccccataatatcctaaaaaagaaaccaaagacagtatcaccagcacgattttactcttagrcatttttagaagacatctgtatgattagtaaattataaataagagtttacttttcacagatttctgtattaaatgtatgttttgtaaatcttatatggtcttatatagaattttaatgtcttcttcccaaaaagagaacagtaaaatttaaagaggacggtggacagaaaaaacaaaaaaacccaagaccacttaaattcgcatatttaaaaagccagccctattttagcaggtagacaaatatagtgatataacccaatacaatacagacacaatacaataactgcaatgtatttttat

SEQ ID NO: 29719 - DNA, 601 bp, Human
tgatacatgaagatttgatatacttctctttacccctgtgtatgtctgaaactttccacaatacggtttttaaaaactgcactaacctgagaaatagaatgaccttgtggaaaaagaactgatttggctcaattatattggccttctaggggtaaatgtaatttagccacatgattttgagacaaaaatcacttctttacacttaatgtgcctgcaaatgttaacataaaacagttgggacaggtaaggcatggtggcttacttgagcccaggagtttgagaccaaccctggcaacatagwgagactctgtctctaccaaaaattaagaagtcagcaggatgtggtgacatgtgcctgcagtcccagccactagggaggctgaggtaggaggatggcttgagcccgtgaggtcaaggctgcagggagccgtagttgtaccactgcactccagcctgggtgacagagtgaaactccatctcaaaacaaatcgatacaaagttggaacaaataatctgagatatatttcccagttttaaaatgacaatttttctcttgaattggaaactatcgttcataatatcaaagaataaggctcatcta

SEQ ID NO: 29720 - DNA, 601 bp, Human
acatttcctgagccatcccagactgggcatttttcttcgagttgttgcaccatttaaataaactatcatgtagttttctgctactaatagctccaaagtgccaataacatatctgtaaaaaacaaattaagtttaagccttaaaaatcactgtgcataactgaactaggttctctaaattgtaccattatacaattccttcctctctcctacaatgagagcaacaatgaaaatgctcaaaccgcattagctagtattacgattatcttattttttagagatatattttgaaatgtttctargtgaaatgatttgctcctgggatttgcttcaaacttgtaaactgggggttagaagtgggaacaaagtataaattggtaattgttgaagtgactgatacatgaagatttgatatacttctctttacccctgtgtatgtctgaaactttccacaatacggtttttaaaaactgcactaacctgagaaatagaatgaccttgtggaaaaagaactgatttggctcaattatattggccttctaggggtaaatgtaatttagccacatgattttgagacaaaaatcacttctttacacttaatg

SEQ ID NO: 29721 - DNA, 601 bp, Human
cttgaacctgggaggtggaggttgcggtgaaccgagattgtgccattgcactccagcctgggcaacaagagtgaaactccgtctcaaaaaaaaaaaaagttaaaaaaaaaaaatagcaacgaaaaacaaagtttgatttcctaaagccattataaaattttttcagactagctttcaacttgtatttgtattaccttctatcaatttgctgataacatttcctgagccatcccagactgggcatttttcttcgagttgttgcaccatttaaataaactatcatgtagttttctgctactartagctccaaagtgccaataacatatctgtaaaaaacaaattaagtttaagccttaaaaatcactgtgcataactgaactaggttctctaaattgtaccattatacaattccttcctctctcctacaatgagagcaacaatgaaaatgctcaaaccgcattagctagtattacgattatcttattttttagagatatattttgaaatgtttctaggtgaaatgatttgctcctgggatttgcttcaaacttgtaaactgggggttagaagtgggaacaaagtataaattggtaattgttga

SEQ ID NO: 29722 - DNA, 601 bp, Human
tcttcaggactctgtaaacagggaaagaggccaatactgaatgtaaaagtaaactattctcattttccaagactagggagaaattggtgctaagttcttcaaaaccatgaaaagcactgtgcaggcagagaagtgtgagtggagaagatgaccacaggaacaaaaacaaatcagatctaactcctattcttaaggaatttaaagttttgattaaaaattaaaggttttatcctagacttctcctttttaaatgactaaatactctttgtattatgcatatttcacacataaagtgagatayatatataatcataagagctagccaatgtcaaatttagatgtgaagagaaacctattaatgggtctgacttgatttaaattagccacagcaagatcaaaccaatcggaagatcacattccttccattaagtactgatgactaactcccaagacaaaacacttctaaagcttgttccaaagaaagattacaactaaataagcaccattaaaaaacataaatactgagcgctgtggctcatgcctgtaatcctagcactttgggaggctgaggcaggtggatcgctttagtccaggagttcaa

SEQ ID NO: 29723 - DNA, 601 bp, Human
agtcaatggctctcaaaaattacctaataaatggtcttgtaacagccagaagtgttctgataaaccaagaaggatgtacaatgattagggattttagatttttccgtaacctggagtttaaaaaaaaaacacacacacacaaagaaaattaaaaatttctataaattctaatgctgcaagtttatacaaaataatagttgaaaaatctcacccaaaagttctcaattaggtgtgatacccctgtagacaagaaaatgcactcttaaattcttatggtccctcctactgctatgaaatgaaytttacttcatttggccagatttacgtccacagtatagcctgttactaaatgtctcctagcatacacattcacttgtcttcaggactctgtaaacagggaaagaggccaatactgaatgtaaaagtaaactattctcattttccaagactagggagaaattggtgctaagttcttcaaaaccatgaaaagcactgtgcaggcagagaagtgtgagtggagaagatgaccacaggaacaaaaacaaatcagatctaactcctattcttaaggaatttaaagttttgattaaaaattaaaggt

SEQ ID NO: 29724 - DNA, 601 bp, Human
tcattatacaatgtatacacatatcaaaatatagctctgtatcccataagtatgtatagttattatgtgttaactaaaaataaataaataaaaaaaataaaattaaagtcaatggctctcaaaaattacctaataaatggtcttgtaacagccagaagtgttctgataaaccaagaaggatgtacaatgattagggattttagatttttccgtaacctggagtttaaaaaaaaaacacacacacacaaagaaaattaaaaatttctataaattctaatgctgcaagtttatacaaaataayagttgaaaaatctcacccaaaagttctcaattaggtgtgatacccctgtagacaagaaaatgcactcttaaattcttatggtccctcctactgctatgaaatgaactttacttcatttggccagatttacgtccacagtatagcctgttactaaatgtctcctagcatacacattcacttgtcttcaggactctgtaaacagggaaagaggccaatactgaatgtaaaagtaaactattctcattttccaagactagggagaaattggtgctaagttcttcaaaaccatgaaaagcactg

SEQ ID NO: 29725 - DNA, 601 bp, Human
tttaaatatttttatttatttagcaatatgattattcaataataatattgatgatcagtttactcaaatttgttgagcactatgttcaagtttggagaatgctctttagtactgatcaattagagaaatcatctcttagattataagtagtctataaaagtataacatgaatcacaaccggaaataatttatcctagttcttcaactgacagcctgaagaaaatgctaacttagggggatggtgtgggaaaatggcttcttcctctttttctttgttacacacacacacacacgcgcgcgygcgcacagttataaaatataatacataaagaatgagtattgaaaagtattatccattgcacatcaaaatgttaagatccaatacaattaaggaaataaaacaaaacatactgttttatgcattctggtatgccaacgtattccatggggacaagttctgctagttctgccaaattaaacacgtatctaattttttggctgaatttcgagctatggaagaaaataaaaataattacttccatatttctgacaaatacaatggatacaatgtttacaagatacaaaaatcatgtcattttga

SEQ ID NO: 29726 - DNA, 601 bp, Human
ggaaaacattaaggttatgatgatttaaatatttttatttatttagcaatatgattattcaataataatattgatgatcagtttactcaaatttgttgagcactatgttcaagtttggagaatgctctttagtactgatcaattagagaaatcatctcttagattataagtagtctataaaagtataacatgaatcacaaccggaaataatttatcctagttcttcaactgacagcctgaagaaaatgctaacttagggggatggtgtgggaaaatggcttcttcctctttttctttgttacacacacacacacacgcgcgcgcgcgcacagttataaaatataatacataaagaatgagtattgaaaagtattatccattgcacatcaaaatgttaagatccaatacaattaaggaaataaaacaaaacatactgttttatgcattctggtatgccaacgtattccatggggacaagttctgctagttctgccaaattaaacacgtatctaattttttggctgaatttcgagctatggaagaaaataaaaataattacttccatatttctgacaaatacaatggatacaatgtttacaag

SEQ ID NO: 29727 - DNA, 601 bp, Human
aatttcagtcactggaaaacattaaggttatgatgatttaaatatttttatttatttagcaatatgattattcaataataatattgatgatcagtttactcaaatttgttgagcactatgttcaagtttggagaatgctctttagtactgatcaattagagaaatcatctcttagattataagtagtctataaaagtataacatgaatcacaaccggaaataatttatcctagttcttcaactgacagcctgaagaaaatgctaacttagggggatggtgtgggaaaatggcttcttcctctttttctttgttacacacacacacacacgcgcgcgcgcgcacagttataaaatataatacataaagaatgagtattgaaaagtattatccattgcacatcaaaatgttaagatccaatacaattaaggaaataaaacaaaacatactgttttatgcattctggtatgccaacgtattccatggggacaagttctgctagttctgccaaattaaacacgtatctaattttttggctgaatttcgagctatggaagaaaataaaaataattacttccatatttctgacaaatacaatggata

SEQ ID NO: 29728 - DNA, 601 bp, Human
aaaatggtgaaacagataaagtcttaaaattatttggtgttccaaataccatttttagtaatttctctggtttcaccattagtacttagactaagaaggagagagaagggtctgtggtttttaattgctaattggcatcatatatggcaataaaacatggtgaatccaagtcatattcagccttaggaactctgggttcaccctgtatttggaagttggggtacatttatatttgcaaatgctattatctttgtctacaagctaaccaaccaataaggaagagttagtctgcaatgcaaayggactagtctagatgcaacccagtcaaggtgtgcatataccttttttgtttctttttaaacttttcttcttcatacctttgtagggaagagttatttcagtaaatatacatgttatgaaaatgaataaaaacttgaaaaaagctactaaaaataaactcatttaaattttccagcaaaaccaaaaatatttactacatgatgtagaaagtaaaaatttacttaataaatctgactttcatacattaaatagactaaaacctcaggtgagcagaacaaagaaacttttccacatgcattgt

SEQ ID NO: 29729 - DNA, 601 bp, Human
aagtatatatgcattgcaaatataataatcaaccccagggaaataaattgagaacttttaaaaagtctgcaaaaatatttcaaaagcacaagttagcgatttaaagaaaatggtgaaacagataaagtcttaaaattatttggtgttccaaataccatttttagtaatttctctggtttcaccattagtacttagactaagaaggagagagaagggtctgtggtttttaattgctaattggcatcatatatggcaataaaacatggtgaatccaagtcatattcagccttaggaactctgsgttcaccctgtatttggaagttggggtacatttatatttgcaaatgctattatctttgtctacaagctaaccaaccaataaggaagagttagtctgcaatgcaaatggactagtctagatgcaacccagtcaaggtgtgcatataccttttttgtttctttttaaacttttcttcttcatacctttgtagggaagagttatttcagtaaatatacatgttatgaaaatgaataaaaacttgaaaaaagctactaaaaataaactcatttaaattttccagcaaaaccaaaaatatttact

SEQ ID NO: 29730 - DNA, 601 bp, Human
actacttatcatatcatgcagttgtcaccttaaataagctcccttgcacctagcttctgtaaagtttggtttaggctgggcgtggtagctgacgcctgtaatcccagcactttgggaggccgaggtgggtggatcacttgagatcaggagttcgagaccatcctggccaacatggtgaaacccagtctctactaaaaatgcaaaaattagccaggcatggtggtgggtgcctgtaatcccagctacttggggggctgaggcagcagaatcgcttgaacccgggaggcagagattgcagttrgctgagactgggccattgcactcctgcctgggtgacaagagtgaaactctgtctcaaaacaaaacatgcctctctacctaaatttaatttaaaaattaaattttatcattttcagattgacaaaaatttattattttttaagactaaagaaactacaaaaaacagaacgtttttgaaagatacatgtaatcattctatttatggttaaacacaagtaaaaaaaaaatcaagataaaatagtgacaggtttcaaacaatatatttaaataaaaagtacaaattccatattttttctgatgt

SEQ ID NO: 29731 - DNA, 601 bp, Human
ctgccatagggactcatagcttcatactcttcttagcaccactacttatcatatcatgcagttgtcaccttaaataagctcccttgcacctagcttctgtaaagtttggtttaggctgggcgtggtagctgacgcctgtaatcccagcactttgggaggccgaggtgggtggatcacttgagatcaggagttcgagaccatcctggccaacatggtgaaacccagtctctactaaaaatgcaaaaattagccaggcatggtggtgggtgcctgtaatcccagctacttggggggctgaggyagcagaatcgcttgaacccgggaggcagagattgcagttggctgagactgggccattgcactcctgcctgggtgacaagagtgaaactctgtctcaaaacaaaacatgcctctctacctaaatttaatttaaaaattaaattttatcattttcagattgacaaaaatttattattttttaagactaaagaaactacaaaaaacagaacgtttttgaaagatacatgtaatcattctatttatggttaaacacaagtaaaaaaaaaatcaagataaaatagtgacaggtttcaaacaatat

SEQ ID NO: 29732 - DNA, 601 bp, Human
taactgatgaagggacctttaaaacaatccggtattagataaagaaaaatatttttcatatgtttttattctcatcacccattactatgcccacctgaatattagtgaaacagacctaaaagccctggtctgtggtaaagccaaagtaacattttaaaatatttaaaatattgttataaaaaatttggaatgtatttctgataaggcatgcaaaatatatcaaatcctcttaacatctgaaatatccttaccaactaatttcataattatttttaaactcccctgaaacattttaacaatctgtatctgcatggccacacttgcatccagttgtttgaaagaaacattttaaacatttaaactgctatcctttttctgtcactggggacactggatctccctgttgtcaacatttcttcaaccctcttccccacaagcccctcaagaaaatggttttgccccttcttcccctgctccccaaaaacctgccatagggactcatagcttcatactcttcttagcaccactacttatcatatcatgcagttgtcaccttaaataagctcccttgcacctagcttctgtaaagtttggtttaggc

SEQ ID NO: 29733 - DNA, 601 bp, Human
tttacgcatgtgggcattagaaggattacataattaccacataataattacagacaacccttcaaagctaacagtctattactattacatttgtagtggtctgaataactgatgaagggacctttaaaacaatccggtattagataaagaaaaatatttttcatatgtttttattctcatcacccattactatgcccacctgaatattagtgaaacagacctaaaagccctggtctgtggtaaagccaaagtaacattttaaaatatttaaaatattgttataaaaaatttggaatgtatctctgataaggcatgcaaaatatatcaaatcctcttaacatctgaaatatccttaccaactaatttcataattatttttaaactcccctgaaacattttaacaatctgtatctgcatggccacacttgcatccagttgtttgaaagaaacattttaaacatttaaactgctatcctttttctgtcactggggacactggatctccctgttgtcaacatttcttcaaccctcttccccacaagcccctcaagaaaatggttttgccccttcttcccctgctccccaaaaacctgccataggg

SEQ ID NO: 29734 - DNA, 601 bp, Human
aaaccccatctctactaaaaatacaaaaattagccaggtgtggtggtacgcgtctgtagtcccagctacttgggaggctgaggtaggagaaccgcttgaacccaggaggcagagcttgcagtgagctgagaccatgccattgcactccagactgggtgacagagtgagactccgtcttaaaaaaataaataaaataaaaaaaaagaatttaacattcaaaaatatctaatataaattaattattggctagacacagtggcttacacctatgatcccagcactttggaaggccgaggcgggyggactgcttgaccaggagtttgagaccagcctgggcaacatggcaaaactccgtctctacaaaaaatacaaaaattagccaggtgtggtagtgtgcacttgtagtcccagctactcagaaggctgaggtggaaggattgcttgagccctggagacggaggcgacagtgaaccgagactgcaccactgcactccagcctgggtgacagagcaagaccctgtctcaaaaaaacaaaacaaaaacccatcaaaaagcttatttatttagtggtgggttggacatcagtcatatcaaaatttac

SEQ ID NO: 29735 - DNA, 601 bp, Human
gactagatgccaaacttactgttcatttttcggttcatcttgttttccattaagttcttgatcaactctgtttaatgaagaatatataaaataagaaaccagcaactgaacaattttctttctaaaaataatgactattttagcatagaatattactctgttaaagacaaagctttgcaaagaagcagacatagtaaaaacagttaccaaacatcatttccccaaccagaaaagagaatttttaaaggcaggaggacactggcaagaaatgtgaccgttgtttctttaaagattataaaayactttacatacaaatgcatataaactttttttttttcttatttttgagacggagtcttgctctgtcacccaggctggagtgcagtggcacaatctcagctcgctgcaatctccgcctcctgggttcacaccattgtcctgcctcagcctcccgagttgctgggactacaggcgcccaccaccatgcccggctaatttttcgtatttttagtagaggtggggtttcaccatgttagccaggatggtctcgatctcctgacgtcgtgatctgcctgcctcagcctcccaaagtgctgggatt

SEQ ID NO: 29736 - DNA, 601 bp, Human
tgtgacagtgaataactcatcacattctctgcaatactactcagcactcatatacactcaggggagcaataccctggacacatagcttatttcacattagtgaacaaactcaagatttttataaagttctgactttgggccagaagataaaatgtcccatatatacatatatacaaaccctaattcctaccctcttaaatcctctagttctaagaatggctttttgacttgtctttaagtttagaaaggaaaaagtgtgcaatgcgcttgcatctgtacttgctgaattatgaaacaaatrtgttaaatgagaaaaaaaccttgggatggtactaatacacttcgattatatacatgatctttgggtattcatgacaatcagtttaaccatctgttgccttatgaaaaacttaatttcctaagttacccaggaaatgtatttaaccatttacaaaaacaaaaattctaatatgcactttagaaaatcgtggtcttatatacctgcatatttcttccataagacaggtacacattaaaaaatattgctcaatgacataaaaatatatattatttctttcctttgccatttatgcatataaat

SEQ ID NO: 29737 - DNA, 601 bp, Human
catgatttcatacaaacttgaataaacaccacatctaactaggtcaaacaactaccgagttcaaataattgatatggaagtattttggtaaagtgcccatagtgagagtttaaaaagcagcccctgttttctatagaaaaagttgtgacagtgaataactcatcacattctctgcaatactactcagcactcatatacactcaggggagcaataccctggacacatagcttatttcacattagtgaacaaactcaagatttttataaagttctgactttgggccagaagataaaatgtccyatatatacatatatacaaaccctaattcctaccctcttaaatcctctagttctaagaatggctttttgacttgtctttaagtttagaaaggaaaaagtgtgcaatgcgcttgcatctgtacttgctgaattatgaaacaaatatgttaaatgagaaaaaaaccttgggatggtactaatacacttcgattatatacatgatctttgggtattcatgacaatcagtttaaccatctgttgccttatgaaaaacttaatttcctaagttacccaggaaatgtatttaaccatttacaaaaac

SEQ ID NO: 29738 - DNA, 601 bp, Human
tgggatgccctgccagagaatcagagactgtccttctgctgacgcttgccaccacgctgtatctggcagtcagagtgtggccccggtgcctgagccctcttaggactctgttcagccatgaggttagagaggaatcatggcctctggagttctaatggccccgtggccacttcctagctctgtgagtgtgggcagattgttcaacctctctgagcctcctgccttgcagcgtttttgtgaggatttgaaacaataaatgtaaaagcctggggatataataaacatgaagtaattagtaggsacaatgggaatatttatataatagtacaatatataagagatgtaaaaataattcatcaagattcatgcaaatttcaagccctgaaggtagcaaatactttattgtagataatggctacttcacaaaacatacacaaaagaaatagctgaacatacaatatgataatagcagtttctttttttttttttttttttttttttttgagacggagtctctctctgtcaccaggctggagtgcagtggcacgatctcggctcactgtaatcttcacctcccaggttccagcgattcccctgcctc

SEQ ID NO: 29739 - DNA, 601 bp, Human
tgatgcattcacaatactagatgccaaatactgatgattaattttagtgcttttttgaaatgttttcatatttgctacaatcaaacttaaatgacttagaaaagtaggtaactttctactgctgttcagaattggattttttattcctttagtaaagtacccagtttttcctattgcaagtactctgtgaaatcacagttgcccataatttgggagggtgacaggggtcaaggaaaggggtgtgggaagaaggtaaaggaggaacgtgagtgggtaatcagtcatcctagtttgcttggcrttgggggattttccaggatgtgggactttcagtgctaaaactagagtgaattgatcacttgttgtggttgataatatattccgttaaaataagaggtaagaaaaaaaaaacctcagtttgattctttttagaaatcagagttagattggcatattaccctctctcaatatatgggccataataaagcctactggatctcaatctcattttgcagaactggagttcagatgtagaaagttcaagggaaaaatttgcagtgattccagtacatccgaaatctggttttaagggtgttagtat

SEQ ID NO: 29740 - DNA, 601 bp, Human
ccagtggcactatcttggttcaccacaacctctacctcccaggttcaagcgattctcctgcctcagcctcctgagtagctgggattacaggtgtgcaccaccatgcctggctaattttgtatttttagtagagacgagatttcaccatgttgtccaggctggtctcaaactgctgacctcaggtgatctactcgccccggcctcccaaaatgctgggattacaggcatgagccacagcacctgtccccaatttaatttttttttatgtaaagtattagcatgattccaatattaaaaaaaatggaccagaggagattctctctcctgtcctatcctcagcacccagttcccctccccacaggcctctcaggtgttacatgctgataactatgtacatgtattccttaaatgtttttttaagttttatattcttggcactggtcttcaaatgtgtacatgtgtgccagggagcaaatgccttcttgtttctgaaattggtcttttagactgttcttttttcccatcttctcacctcctgcccctccttcagggtacttccgtggccagaacccctccaggtcagaggcagaagagaagcctc

SEQ ID NO: 29741 - DNA, 601 bp, Human
ctgagtagctgggattacaggtgtgcaccaccatgcctggctaattttgtatttttagtagagacgagatttcaccatgttgtccaggctggtctcaaactgctgacctcaggtgatctactcgccccggcctcccaaaatgctgggattacaggcatgagccacagcacctgtccccaatttaatttttttttatgtaaagtattagcatgattccaatattaaaaaaaatggaccagaggagattctctctcctgtcctatcctcagcacccagttcccctccccacaggcctctcagrtgttacatgctgataactatgtacatgtattccttaaatgtttttttaagttttatattcttggcactggtcttcaaatgtgtacatgtgtgccagggagcaaatgccttcttgtttctgaaattggtcttttagactgttcttttttcccatcttctcacctcctgcccctccttcagggtacttccgtggccagaacccctccaggtcagaggcagaagagaagcctcatgggtcacagcagcagatgtgggctggagatctattcatttggttttggcttgaattttctgaatggtt

SEQ ID NO: 29742 - DNA, 601 bp, Human
cagaggcagaagagaagcctcatgggtcacagcagcagatgtgggctggagatctattcatttggttttggcttgaattttctgaatggtttacttgatcttgggaaagatatatcttgccaggaaaaatgataggccttgacaatgttgaatgatcctgcaccaccttgaaagacattttctaatatggtttgtcaggcaaagtggttagtagtcatttgtggcctgaggtagaagtcctcagaaatcagcagacttcactgataaaatgctgacttgcccctggactgggctctgtgasagtggccttctgcactgtgcacagtaggtgtgaacacaccacacctacagggaccacgtggtgggctgtggactagcggccaagctccctgcaggcccactaatagaattcagcttttagcatgggctgtttcatactgttctgatgaaactgatttggtttctttcctccataccccttctgcatttcagtgtttttgtttagttttcctggtttttaattataactacaaaataaaatctttaggctattcaccttagcttagtaaaaaaaaaaaaaattaaaaatctggaattttag

SEQ ID NO: 29743 - DNA, 601 bp, Human
cagtggcgcaatctccgttcactgcaacctctgcttccctggttcaagcgatccgcccgccttggcctcccaaagtgctgggattacaggcgtgagccaccgcgcccggccccttttttttttttttttggagactgagtcttgccctgtgctcaggctggagtgcaatggcgcgatctgggctcactgcaacctccgcctcccgggttcaagcaattctcctgcctcagcctcctgagtagctgggactacaggcgcacaccgccatgcccggctacattttttttttttttttttttttgtattttagtagagatggggtttcaccgtgttgcccaggccggtctcgaactcctgagctcaggcagtccgcccgcctcggcctcccaaagtgctaggattacaggcgcacccggtcagcctgcctcctttcttcgagtggatggattaagtcattgcaaggctgctttcctgattacattctgaccactttgagtagaaactactttgcttttaagattgttattgcttctgttttcactgtaatgtgtttgatagtgaaagcgatcacctgagggtaaccaagtggctgtttttagga

SEQ ID NO: 29744 - DNA, 601 bp, Human
ttcaaataggtataaagaagaaagtagaaatagcccacagtccagctctctagagacactaccaaatcttggcggctctgctttctggccagtcttattacatcacaaacgcagtttcatattgatggcatcgtgctacacctaacgtttttctaacttactatttttgttgaacaatttttcaaggaaataactttcatgtcaataaatatgcatttatactagttgtatgataggcacatattattccattgtatggatgtactgtatcttatttcaccaattttctttttttttttttgagacagagtgttgctctgtcacccaggctggagtgcggtggcgcaatcttggctcactgcaacctctgcctcccgggttcaaacgattctcctgcctcagcctcctgagtagctgggattacaggcacatgccactatgcccagctaatttttgtatttttagtagagacagggtttcatcgcattagtccggatggtctcgatctcctgacctcatgatccacccaccttggcctcccaaagtgctgggattacaggcatgagccaccacacctggcctatttcaccagttttctaat

SEQ ID NO: 29745 - DNA, 601 bp, Human
cctcacctctcttctttccccacattctcctggtttaggccgctagcttcatatggtagtttgttctccataggagagtttcctttgtaaggcaaaaatctaatcacttaattccactagaggacttaaaatccttcactaaccagcaaagtccgtgcagtttggctggcccctcctgccagcccctccccggacattctcccatctcccctttctcctcatccttccggtgcctctcccacgtgggataaatggccattcctggaacaagcttccccctcatgcctcttcgcctttgcarctgctgctgtgccagcttgcaccagccttcccctcagccacatcctctgccagggcatattcacccctgacacagctccttgggcctccgcgtctgggatggcgtcccggagccctgagacctggcggtgctctccctcctggaccccgccacaccttgcacgtgcctgtgtcacggcccttcaaccccgggcactgtcagcacttactcccttgcctcggtcaccgcagtgggaactcactgtgtgcagttgctctgactttcctttcttgatgaaagcaagagtctctcagtagcgca

SEQ ID NO: 29746 - DNA, 601 bp, Human
tcagtaaccccttttagggtaactgtgttgcaagcacctcttcacagtgggtggcttttgcctttttctttatgggcagaactacttaatgtaaggaaatgccacagtgttttgtttttctttcctttttctttttcttttctttccttttttttttttttttttgagacagggtctccactattgcccaggctggagtgcagtggcaccatctcagctcactgcagcctgcttgctcaacatcaaactatccttctgcctcagcctcccaagtagctggcactacaggcgtgtgccaccrcacctggctaattttttttttttttttttttgagacggagtctcgctctgtcacccaggctgcgcagtggcgtgatctcggctcactgcaaactccgcctcctgtgttcacgccattctcctgcctcaacctcccgagtagctgggaatacaggcgcctgccaccacgcccggctatttttttgtatttttagtagagacggggtttcaccgtgttatccaggatggtctcgatctcctgacctcgtgatccgcctgcctcggcctcccaaagtgctgggattacaggcatgaaccaccg

SEQ ID NO: 29747 - DNA, 601 bp, Human
gcagtttttcctccatttggtgatttgaattcactaagcacacagtgagtgcctgccaggtgcctgacgttgtccgggactctgtagagattgttgctcatgtgagttcatgccattagtgttatatttcttccatgtgtaacgtgtagctctcaggaagcaatatttaatatgctcaagagcattagaatctttacttatcacagtgtatttaaagaaatatagaaaacattggcctaaggaattgcatttgttgattcatgttaatggttgtttttagctattcttccctactagtgartcatctataatacagtttgaagtttggtacttagccttttacacccatatttcttcggtagcagaaattagaatgaataatttgtgtgcatttttcaatgtccatacaaatgcaatgcagaaaaaaactcctcttttgcaaacattgtcgctcttcctcaggtgaccctgttagggtcatattttcttttatcttgtatctttaaaggaaagcggtaagtgcagctctaatttcatccacttggtaagcattgatttgtgggcctgtattgtgggaggcactagtgtaggccctggggta

SEQ ID NO: 29748 - DNA, 601 bp, Human
gggcagtcaatctggcttaacggagaggtaggactgcgtgtccaaaggttcacattgttgagtctttaatagcagactgctcttttttccttctaatccttggtgtgtgtgcgatgacaaaataattatccagaagccttaaaccgtttctattttctaattccagaatgagtaattcgaaaataaataggccacaatgtgtacaatattttttcctttttacacatttagatgtgtctccccacgaggacactgttaatctttaatctcaacggaattaatatgaggaagaaaatattcygttttttccatcttcagaactaagtgatatgactgtaaccatgaacaatgcacaaatgtctcctattcttttttttttagatggagtctcactctgtcaccaggctggaatgcaatggcatgatctcagctcactgcaatctctgtctcctgggttcaagcgattgctctgcctcagcctcccaagtagctgggaccacaggcgtgcaccaccacacaggcacattttttttgtattttagtagagacagggtttcaccatgttggccaggatggccttgatctcctgacctcgtgatcc

SEQ ID NO: 29749 - DNA, 601 bp, Human
tgtgtctccccacgaggacactgttaatctttaatctcaacggaattaatatgaggaagaaaatattctgttttttccatcttcagaactaagtgatatgactgtaaccatgaacaatgcacaaatgtctcctattcttttttttttagatggagtctcactctgtcaccaggctggaatgcaatggcatgatctcagctcactgcaatctctgtctcctgggttcaagcgattgctctgcctcagcctcccaagtagctgggaccacaggcgtgcaccaccacacaggcacattttttttgtattttagtagagacagggtttcaccatgttggccaggatggccttgatctcctgacctcgtgatccgcccgccttggccctcccaattgctgggattacaggcctgagacaccatgcccagcctcctattctttatctgaaaaattaacaagatttccagttaaagtaagaattgacatctttaagagaaattctgaattatagtttattttcatacagctgtttatgtttataatctcatttttttttaattactgagaaaatagagtagctaagatctaatcttggagtgcattgt

SEQ ID NO: 29750 - DNA, 601 bp, Human
ttctcacttagcaggcagtgacttcccactgaagaggagggaaaggcctggggcccgtgcagggcgggggagcactgccccgtcggggcagctcccagccttctcagagctgcagtgccttcctcttgacacacacggagagggaatggagaaggaaagagctagcttagggatgccaggaaccgcagacgcaactctctttttagccccacaacagccccggggaactgtgattgttcctgtttgtggctgaagctcccagtggttaaggagccaccacagcctcacagaggcaggaaamtgcagtacagggactagggcccaggctgtccatcattgcctcaggaaagttctcataaatgggggtaagtccttacagtctctccaaagtatgttagtcaggagtgtcacagatgcatcagcgataaggagaagctgctttaccgtgcgcaagttgtataattaattccttgtgaggttcatatgctttgagggctggccggggcccctacactcatctgaaacgtgatttccagggaaaagctctacaggtgtcaagcacctaccactgttttcacggtgggaaccgccactgtggaat

SEQ ID NO: 29751 - DNA, 601 bp, Human
gtagtcataaactccaagagtttcacgtgtctgactatattcttaggagattgatgggttacatttttctcctcgatagtggtcatgggggaaatgtgttaatttttcactttagatgtttgtgaaatgttggggagagtgaggggtttgttcttaagtggtgggccattgacccaaagtatttttaattccttttttaggctgcatttgatgccagaaggcaaacacaacctgcatttgcgttttgcagatgaattcaacaagttagcagaagacttcctacaatgagaatgcacactcsagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagcc

SEQ ID NO: 29752 - DNA, 601 bp, Human
atcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccagstgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggag

SEQ ID NO: 29753 - DNA, 601 bp, Human
gccccgcccgccccggcgccctcaccagctccgggaggctcctgcgcggcggccaccgggatgagcagcaggagcagcgcggcgccaccgaggcgcaacctccagtacggcgtcggcccgcgggccactccgggcgccatggtcggccggtcgctctatcagtcagtggagcgttacaactccgactccagcacaagcggtctccgcccggaacagccgcggcgccggaagtggacctgcgaggtggggccatgcgagtgcgcagcctcaaaaagcagctcgccccgctccctcgccatcygccccgcccctcgccaacgggctcgcctcccggcgcggctgaggttcagtgcgcctgcgcgatagaggaaaggagcctggtagcgaggagagcggctgaggctcagtgcgcctgcgcggcgcggatgggcgaggcgtgaccgaggggcgaggcgtgaccgaggggcgaggcgtgaccgaggggcgaggcgtgaccgaggggcgaggcgtgaccgaggggcgaggcgtgaccgaggggctcgccgcggctcctgcgcctgcgcggcggggaacggcgaccggctgaggggactaggggagc

SEQ ID NO: 29754 - DNA, 601 bp, Human
agggtcaggaaactgaagttaaggtggcactattccccaccactagtggtcacctggaaactccacacacggaagccagcatgacattgtgaaacaggtccaaccatgacactctccagcttagaacctgctggattttcccgcagcccaccaggccctggaggcccagccccacaggaagccaccctctataaacactgccggtttctggaactctgagtctcctgtcatgcactttcctcccccagcccccgcgccctcactgcttctttcttggtcagcctcccggggactcagctcytcttggataggagctctggctgtcggtcaccactgtggccgcagggcctggcgcagacgggataaacgatgaagaatgccacctgcgcgtctggacagcgtagaaccgcaatcagcttgcttcaaaatcagatgctacagcctggctttggggacgccttcctttctaaggcataagtgcgagcgttcgctgctgtgcgtggaactgcggccgggagggagtggcggcgtgaacgccggcggctgtagagacacaccggccgcggccccatcaccctgcaggggcctgcggccgccatcc

SEQ ID NO: 29755 - DNA, 601 bp, Human
cgtattcactgcacatttgcgcttagaactcaatctgggccaaaagttcccagtacagtcccactggcctccttgactaacaaacttcaaggcagctgcattgctaacgtcacaaaccctaagcacacttggaggcaggtaagaagaaacacaaataatcctgcatcggaataaacattccataaggtcacaaaaagaaaaggtgctctactatgctaaacagacactgacagagcctgggctaacaagagctgagaaaagtattagcccctcaagctgggcccaggtcaaccctaattgyaagggtcaggaaactgaagttaaggtggcactattccccaccactagtggtcacctggaaactccacacacggaagccagcatgacattgtgaaacaggtccaaccatgacactctccagcttagaacctgctggattttcccgcagcccaccaggccctggaggcccagccccacaggaagccaccctctataaacactgccggtttctggaactctgagtctcctgtcatgcactttcctcccccagcccccgcgccctcactgcttctttcttggtcagcctcccggggactcagct

SEQ ID NO: 29756 - DNA, 601 bp, Human
caaaacctcatggttgttttcctgacactcccgctttcacaatgcaagcaaacacacccccgagccactgatacagttgccagtgaatcacacactctgcctgcagacgcccattctgtttgtggaaacgtattcactgcacatttgcgcttagaactcaatctgggccaaaagttcccagtacagtcccactggcctccttgactaacaaacttcaaggcagctgcattgctaacgtcacaaaccctaagcacacttggaggcaggtaagaagaaacacaaataatcctgcatcggaatraacattccataaggtcacaaaaagaaaaggtgctctactatgctaaacagacactgacagagcctgggctaacaagagctgagaaaagtattagcccctcaagctgggcccaggtcaaccctaattgtaagggtcaggaaactgaagttaaggtggcactattccccaccactagtggtcacctggaaactccacacacggaagccagcatgacattgtgaaacaggtccaaccatgacactctccagcttagaacctgctggattttcccgcagcccaccaggccctggaggcccagcc

SEQ ID NO: 29757 - DNA, 601 bp, Human
gtgtccttgtaaaggagacaaaacgttttaaacatcagtactgcggtcacattcctgtaaccatgacaagcagtaaaaatctcacaccaagcaagtactctgtgggaagaggggagttctccaggctataaatagcccctctctccaaggacaaggggcacgcagacaccaaaggcgcctgggcagtgaatgccaacatgacacggcaccattcttcctattccaaggggtccccagtgagagaaacaacagtccacccaccaggacttggtgattaccataagtggaagcaagcaagtgyagcctccaagtgcagacacaccgaatggcttttcagctgacacaccgaatggcagttccggattaattcccacactgtccactccactcgtccacacccatctctgcacccttcagcagtgcagagcaggaggaatcacagtcaaacaaaacctcatggttgttttcctgacactcccgctttcacaatgcaagcaaacacacccccgagccactgatacagttgccagtgaatcacacactctgcctgcagacgcccattctgtttgtggaaacgtattcactgcacatttgcgcttag

SEQ ID NO: 29758 - DNA, 601 bp, Human
taaaaagatgcttaaaagtgttggatttggattggtataatgtattctctaaattcacacagtgtccttgtaaaggagacaaaacgttttaaacatcagtactgcggtcacattcctgtaaccatgacaagcagtaaaaatctcacaccaagcaagtactctgtgggaagaggggagttctccaggctataaatagcccctctctccaaggacaaggggcacgcagacaccaaaggcgcctgggcagtgaatgccaacatgacacggcaccattcttcctattccaaggggtccccagtgrgagaaacaacagtccacccaccaggacttggtgattaccataagtggaagcaagcaagtgcagcctccaagtgcagacacaccgaatggcttttcagctgacacaccgaatggcagttccggattaattcccacactgtccactccactcgtccacacccatctctgcacccttcagcagtgcagagcaggaggaatcacagtcaaacaaaacctcatggttgttttcctgacactcccgctttcacaatgcaagcaaacacacccccgagccactgatacagttgccagtgaatcacac

SEQ ID NO: 29759 - DNA, 601 bp, Human
ttctacgtgctgttccccatcagccggaagcagggctcctcggagaaatggctgattccagaagtggggcaggaagtgaacacatgagccacagacagtgtgcagtgcccgagagtggcacagacatgaacgaatggcaagaggacccagaagccagcctggagggagtctttctggccatatctgggccaagtgaacatcaaaataaatgataacagtcatgaactctaacccctagaagccacactgacatgaaataaagagaaggccgagtggcaaatgctgaagaaatgatgagttsagaagcctccattttacaatcatcacagccaacactaatgcaggcaagaattccccaaagatgccaagtccactgggtctgcccccgaagatgccaagtccactgggtctgcccccgaagatgccaagaccactgagtctgcctgtggactgacaagatagtctcaaagcacctccccacaggtgagtcattactcatggagaggaggtggcacttccaagagatcagttatctccaccataacccagaacaacatgatgatgggacaaagtgacagcatgtgcctcccacggaggatac

SEQ ID NO: 29760 - DNA, 601 bp, Human
ctgagcccctgctgataacaagccttcttcaagacatgtggaacgagtgttcaggaaccccgctgcaggcagggcacaaagagtataaacatgcggctcctatccacaagggctcttctgggagagaagagtgccaacacagaaggctgtgtttcagatctctctgtgagaggaagtgtgccctgtggctgtgtaatcactaaccacaaacctgctgggaccttctgctcatcagcaggcactcttttgggaacccaagagcctccatccgaggccacagcaacgccagcgacactgccaygcagcacacttgtgtcttcggactcacctacagatctcatgtgacaaagcaaggtcttagtcccctggtagcctcactccagactgggctatgctccctgtaccaacctgtaccaagggagaggcccggcacaccagcctgctccaaccacacagaacaccctgagactctgcccactactcaaagcgctgctactaaggaaggggtcaaactccacgcagccaacagctctggaactcaagccagtcagaagcaagagcgactgcatgagtaacttccaacatgcaaccaagctgactg

SEQ ID NO: 29761 - DNA, 601 bp, Human
aagagtttttaagaacatggctcatgccttagaatagaaatcatcgaatacatctttcccggcctcctcaaacctacgctacggtctcgtggaggaagaagagtttttaagaacatggctcatgccttagaatagaaatcatcgaatacatctttcccggcctcctcatatcatgaaacctcattgccggggaaaggaagcctctggccctgcagttctcaaaacctggtaaactcctgactggaaggggcaaggggtgggcgagatcaggaatcctaagaaaaaggccccacaggatgcygttttctgcctaaccacttcccgctgccgtgggccttccctcaggtttcccgtgctgatttcatagcgctgcgaggagacttgggtgctgccgaaccaagagctgcgtggcaaggcaagcccaagaggtgccagccaggctggcccaggcgcaggccaccacgcagagaaaaccaaaggaccctgttcacacgtttttgtttttgtttttgttttttaaagacagttttttgctcttgttgcccaggctagagtgcagtggcacaatcttggctcactgcaacctccgacttccggtttc

SEQ ID NO: 29762 - DNA, 601 bp, Human
caggaattgggccttctgaaagtcctggaagtcctacctactttgctgtgagtggtgataacctgtatacgtatgcaaaaatgcactgaatatatgtacgcacacacgtgtgcattatgtaggctataagccgcggtccatgtaggcacacacgtgtgcattatgtaggctataaactgcggtccatgcaggcacacatgtgtgcattatgtaggctataaagtccatgcagagagagacttcagatgtgtgcacttcatgagaagctacatgccattaaaaacacctccagaacaggtgytccaaagggcaaggctccccaggtccaggagctgtgtcttcagagtggtcattaagagaagttccatggaagggatgagttcacaaacacacatgcatcacacacagtacacacatcacacatgaaggtgcacacacaccaccaccaccccctgccagacatcccacactacaaccaccaccaccacacaaacttttgaattctctagggcctcaacaccagcaacaagttgtttcagatggaggctgatagattttgaaatggaaatcaattagaagagtggtaagtaagacgtaagtt

SEQ ID NO: 29763 - DNA, 601 bp, Human
agcctagcgtggggatgtcatttcacaagagaattgtcaaaaacacccaccacttgtaaaggtgctcagcacgatcggctagtcactgcagaaatgcaggtgagaagcacaagacaccactacacacccactagatggactgaacttagggtgactggttaccctaaacattgggaaggatgtggagcaaccaagtcccacattgcctgagggaggccaaactggtacagccactccaaaaacatttggcagacgtactaaggctaaacacaaatatgctccgtgacacagcaactccacycctacactcctccagacgtgagcgcctgtgccggcaccaacacaacaccgctcacagcagcaccagaaggacccaggcgtccctgagtggcagcatggctgaacagctgtagaacactgcacgagaaagataactggtgcaggcaattgacacgaatctcgggcacatgctgaataaaacatccaataaagcacaggatttcctccacataaaggcgggaaccagtaacattaatctgtggtgacgggaagtccagtcagtggctcccatgggggtcctgacaggaattgggccttctga

SEQ ID NO: 29764 - DNA, 601 bp, Human
aagatgtcattttctgactggagaactccaatgagatcaacaagatggctggccttaaaacatatctacccctcagatagcttttctgattagcagctaaaactagttaaaaacaaacagaaatcctgtcacaatgggaaacaaactctgggctccttttgctgattccatagggtaaaacccatgaacttgaacttgaaccaaaggatgtgggagaggcctgaaagagaggcatctttgcctctggacaaacggccaacgctgtagacatttcattttccttcaagtaagcatgtttatmaggccattacaattaaagctccaaaataattttggctagaactggataaaatggttctaaggttacctgtaagaataaacaaggacctgtggtgcaagacctaaaacgggtatcatgtgcgccgcggcatctggtgaaatcaggagggccctgagggcccggccacaactgctcctccccactctgctcccgtgggcaaggctggacaaggtcccagctcagacagcctcttcctcctcccggcagggccaggcacactttctgtttctcccggaggagcaggtgtcagttccctctcag

SEQ ID NO: 29765 - DNA, 601 bp, Human
tagtttattaaaatagtttgaaaatcaggaataggaggttacatctgatcaaatgccttttgagcttttaatcctgtgttttttcctcctctgacctgttctggaagcgtagaattgcaaaaattatagtaagagggagaactacagaggggaccttcattggcagaagatgtcattttctgactggagaactccaatgagatcaacaagatggctggccttaaaacatatctacccctcagatagcttttctgattagcagctaaaactagttaaaaacaaacagaaatcctgtcacaaygggaaacaaactctgggctccttttgctgattccatagggtaaaacccatgaacttgaacttgaaccaaaggatgtgggagaggcctgaaagagaggcatctttgcctctggacaaacggccaacgctgtagacatttcattttccttcaagtaagcatgtttatcaggccattacaattaaagctccaaaataattttggctagaactggataaaatggttctaaggttacctgtaagaataaacaaggacctgtggtgcaagacctaaaacgggtatcatgtgcgccgcggcatctgg

SEQ ID NO: 29766 - DNA, 601 bp, Human
gagatccgcatttcttagtttattaaaatagtttgaaaatcaggaataggaggttacatctgatcaaatgccttttgagcttttaatcctgtgttttttcctcctctgacctgttctggaagcgtagaattgcaaaaattatagtaagagggagaactacagaggggaccttcattggcagaagatgtcattttctgactggagaactccaatgagatcaacaagatggctggccttaaaacatatctacccctcagatagcttttctgattagcagctaaaactagttaaaaacaaacakaaatcctgtcacaatgggaaacaaactctgggctccttttgctgattccatagggtaaaacccatgaacttgaacttgaaccaaaggatgtgggagaggcctgaaagagaggcatctttgcctctggacaaacggccaacgctgtagacatttcattttccttcaagtaagcatgtttatcaggccattacaattaaagctccaaaataattttggctagaactggataaaatggttctaaggttacctgtaagaataaacaaggacctgtggtgcaagacctaaaacgggtatcatgtg

SEQ ID NO: 29767 - DNA, 601 bp, Human
cgcatgattcactgtttttaactacagttaatagctgtgccaccaccacaggtgacaccgtctcacctccaggggctgggagttgaacacttgctgcatgcctgggccctggcaaggaggccgacggccaggcctctggggctcccgcagcctcacccctctgctgccccggacgctgagatccgcatttcttagtttattaaaatagtttgaaaatcaggaataggaggttacatctgatcaaatgccttttgagcttttaatcctgtgttttttcctcctctgacctgttctggaagcrtagaattgcaaaaattatagtaagagggagaactacagaggggaccttcattggcagaagatgtcattttctgactggagaactccaatgagatcaacaagatggctggccttaaaacatatctacccctcagatagcttttctgattagcagctaaaactagttaaaaacaaacagaaatcctgtcacaatgggaaacaaactctgggctccttttgctgattccatagggtaaaacccatgaacttgaacttgaaccaaaggatgtgggagaggcctgaaagagaggcatctttgcct

SEQ ID NO: 29768 - DNA, 601 bp, Human
agttcaaaccagaggcaattaaaaaataccctaaaactacttttgcaaatgtgttttcaatcatgcagttcaaacagcctccttggctggacacagtggctcacacctataatcccagcactttgggaggccaaatcgggaggattgcttgagcccaggagttcaacacccgcccagccaacaaagtgagacccagccctgcccatctctacaaaactgtttaacaaattaactgggtgtggtgcatgcacctctggtcccagcgacatgggaggctgaggtgggaggatcgcttgagctygggaggttgaggctgcagtgagccgtgcctgcactattgcactccagcccgggcaacacggcaagacaccatcttgaaacaaacaaaaaacacccagccagcctcctgaagatggctttataagcaaactcccctgggcagtagattaccgcatgattcactgtttttaactacagttaatagctgtgccaccaccacaggtgacaccgtctcacctccaggggctgggagttgaacacttgctgcatgcctgggccctggcaaggaggccgacggccaggcctctggggctcccgcagc

SEQ ID NO: 29769 - DNA, 601 bp, Human
gatctatacattgaaatcagccaagatttttccattcagttcaaaccagaggcaattaaaaaataccctaaaactacttttgcaaatgtgttttcaatcatgcagttcaaacagcctccttggctggacacagtggctcacacctataatcccagcactttgggaggccaaatcgggaggattgcttgagcccaggagttcaacacccgcccagccaacaaagtgagacccagccctgcccatctctacaaaactgtttaacaaattaactgggtgtggtgcatgcacctctggtcccagygacatgggaggctgaggtgggaggatcgcttgagcttgggaggttgaggctgcagtgagccgtgcctgcactattgcactccagcccgggcaacacggcaagacaccatcttgaaacaaacaaaaaacacccagccagcctcctgaagatggctttataagcaaactcccctgggcagtagattaccgcatgattcactgtttttaactacagttaatagctgtgccaccaccacaggtgacaccgtctcacctccaggggctgggagttgaacacttgctgcatgcctgggccctggca

SEQ ID NO: 29770 - DNA, 601 bp, Human
attaaccataatgaactgaagtgacagggtagtctgtctcagctgagtttgaaaaggtatttcaagcctgagaaaagttaactaaccaaaattccaagctacatactcagactctcgtaagacattctaaactcacagaaatggaggttaagcctgatgcagctttctttttttttatttaaaccaaagtcaagaatattacaatgatttacaagagaaatagactctcagggcacatactggcggccaggttcgaaaagaatgaccgtggaggagcggacgagaccacggaacaagacgrgatcatcttcaaatctgagtgttttgaggaccttggggctgaagaacggctggctaatcggtcccaaaccctgttatgatttccttaaccagccttcagacacacgtgcacatttaaaacagatcttactatccttttaaacttcttttgaagatctatacattgaaatcagccaagatttttccattcagttcaaaccagaggcaattaaaaaataccctaaaactacttttgcaaatgtgttttcaatcatgcagttcaaacagcctccttggctggacacagtggctcacacctata

SEQ ID NO: 29771 - DNA, 601 bp, Human
ccatggccttgcagatctgaatcccctcgaagtaaccttcccagcgggcatcaccaccacctcaccgttcctcctgccgtatccgcctctcctcccgctcacgcatggccttctcctcactcctgtccggcttccggctcctcttcctcctgcagcagcagcagcagcagatggcaatgcccaggaggagggttcccccgactaccgacatggtgatgatcagcgcctcaaagttcactggagattcaagcacctggagttagggccgccccagacacagaacccacccagcacagcagcyttccctcgcccctggggaacaacctcaggacacaggagcataaggaggaaagccgcctcggccaggctgctggctcctggcgtgtggagagcctgtggccctgcctccaccccacagggtcccgccctctccaagtctcctttcagccacacgttcctatctgtgacttagaatttattaacaatttataatattaaccataatgaactgaagtgacagggtagtctgtctcagctgagtttgaaaaggtatttcaagcctgagaaaagttaactaaccaaaattccaagctacatactc

SEQ ID NO: 29772 - DNA, 601 bp, Human
gcaacgctcccgaggatgagagggccgccctgaaactcacagcacctcggctacgcaggcgtgcccacaggaagccaaacacgacggcagaacagctgcagacttccagcccagaagtcttgggactcgataagcaaacagctatctgagaaaacagacttcatgaagacgactggctgagataaagatattcttaggagtgagttcaccacagaaccgctggggacaaccgccagctgctcctctctggagagacgtccttctgttccgatgggtgaacccacagccccatctcaggccmcactggcactaacgaggaccgagacagcgtgccatcgcctcccaaccagacaaaaaggaggcgtgaccagtccttaccatatttttttctgatttcatcatgtcttgtcttcatctctgctctcctaaaacacagaggaacattatgagcaccaaacgacagcgcacggtggtgtaactgctagacacgcccttccgtgtccctcagtgggggcgccaggtttcttctggtggcttccctccagttcccagagtgaaaccagggtgaggacaagcttggtcatcaggccacatacccacc

SEQ ID NO: 29773 - DNA, 601 bp, Human
gccaaattaaccaccaaaatggcaagtgcaagtcaatcagggccctgacacagaagacaccactccaagagcctggccggccacccacagcctcacacccgctgggagtcagggcacagtaaaggtcgagcaacttaaacacagcttgtgcttggtgataacaggtgctgggcagtgtgtgcgtgtgtgcgcgtgtgcgtgtgtgtgtatccaccttgtcttttatttacattaacattagtctggctgggtgtggtggctcatgcctataatcccagcactctgggaggccgaggcgggmggatcacgaggtcaggagattgagaccatcctggctaacacagtgaaaccccatctctactaaaaaatacaaaaaattagctgggcgtagtggtgggcacctgtagtcccagctactcaggaggctgaggcagaagaatggtgtgaacctgggaggcagagcttgcagtgagctgacatcgcgccactgcactccagcctgggcgacaaggtgagactccgtctcaaaaaaaaaaaaaaaaaaaaattaggtgccaaaaagctcttgactcttccatttcaaggaaagcacaatgcctcc

SEQ ID NO: 29774 - DNA, 601 bp, Human
ctctcccatcaggaattcctaggaattcttctaactagccgaggctttccaaagcacaggccattcaatggctttattacaaactggcacaaaaagctcatttcatcaatgcaattaaagggccaaattaaccaccaaaatggcaagtgcaagtcaatcagggccctgacacagaagacaccactccaagagcctggccggccacccacagcctcacacccgctgggagtcagggcacagtaaaggtcgagcaacttaaacacagcttgtgcttggtgataacaggtgctgggcagtgtgygcgtgtgtgcgcgtgtgcgtgtgtgtgtatccaccttgtcttttatttacattaacattagtctggctgggtgtggtggctcatgcctataatcccagcactctgggaggccgaggcgggcggatcacgaggtcaggagattgagaccatcctggctaacacagtgaaaccccatctctactaaaaaatacaaaaaattagctgggcgtagtggtgggcacctgtagtcccagctactcaggaggctgaggcagaagaatggtgtgaacctgggaggcagagcttgcagtgagctgacat

SEQ ID NO: 29775 - DNA, 601 bp, Human
ataactgcaccaggtggactcacatgctttctcgcactctcccatcaggaattcctaggaattcttctaactagccgaggctttccaaagcacaggccattcaatggctttattacaaactggcacaaaaagctcatttcatcaatgcaattaaagggccaaattaaccaccaaaatggcaagtgcaagtcaatcagggccctgacacagaagacaccactccaagagcctggccggccacccacagcctcacacccgctgggagtcagggcacagtaaaggtcgagcaacttaaacacascttgtgcttggtgataacaggtgctgggcagtgtgtgcgtgtgtgcgcgtgtgcgtgtgtgtgtatccaccttgtcttttatttacattaacattagtctggctgggtgtggtggctcatgcctataatcccagcactctgggaggccgaggcgggcggatcacgaggtcaggagattgagaccatcctggctaacacagtgaaaccccatctctactaaaaaatacaaaaaattagctgggcgtagtggtgggcacctgtagtcccagctactcaggaggctgaggcagaagaatggtg

SEQ ID NO: 29776 - DNA, 601 bp, Human
gagaatgacagccacagcgctgggtgccgtcaggcggcttcgtgtgcagttagcgtttcacaaactgagaagagtataaaaaagcccaaaccccaaagatttcttatttcaagtgactaaatctagaaacagagatgaacagggaatagaaggtcaccagtctgcaagacgagaggactgtccttcaggggcagctctccggccgcctgtcctggaaggctggcaggttcactggccaaggtcaggagaccgcaatggccacgtggtctcccggctgggctgggctgcggagtgtgcaccycacaggaagcgtcgggactgatgtgctggagcgctttagttgttttcaaatctagcatacgggttttcttctttaaacaggcctgaaacaaaataaacttgaatcataacttcattcattcaaccagaaacaaaatcttagaaagccatacaaaccaagctttataagaagatttactgaggctatagcaacaacgggcgttgtaagcaggctctcatacagtgcttaaccttttttgaagtcaaaccactttaaactttaaaactgaaataaaatttactagaaacaagaactctaaca

SEQ ID NO: 29777 - DNA, 601 bp, Human
tgccctgggagaatgacagccacagcgctgggtgccgtcaggcggcttcgtgtgcagttagcgtttcacaaactgagaagagtataaaaaagcccaaaccccaaagatttcttatttcaagtgactaaatctagaaacagagatgaacagggaatagaaggtcaccagtctgcaagacgagaggactgtccttcaggggcagctctccggccgcctgtcctggaaggctggcaggttcactggccaaggtcaggagaccgcaatggccacgtggtctcccggctgggctgggctgcggagygtgcacctcacaggaagcgtcgggactgatgtgctggagcgctttagttgttttcaaatctagcatacgggttttcttctttaaacaggcctgaaacaaaataaacttgaatcataacttcattcattcaaccagaaacaaaatcttagaaagccatacaaaccaagctttataagaagatttactgaggctatagcaacaacgggcgttgtaagcaggctctcatacagtgcttaaccttttttgaagtcaaaccactttaaactttaaaactgaaataaaatttactagaaacaagaa

SEQ ID NO: 29778 - DNA, 601 bp, Human
gtggaaatttcagcctaggaatgttattcccggtacagatgtacacagtcaaaaaggcttatcgagctgtttgacgagttcttgaagtgttctggatcagtgatctgcctgtgaactttagttcacgctgaagacagtcttctcagttttcatgactgtgaagtgtgaaaatggaacgcatccttgatcttaggtgctgctgacctactttcccaaagcaaaatgttttaaaattcaaggcaatctggaacggggactatttccaaacttccttaggcagcacttttcagtgacttccccrcacgctgctttccctgccacgaagcgcttggtctgcttactaaagccacgtatcctgattttacagaaacgtgggcaggtccagcagtgccactggagagctcccagagaagcccactcagaaggaagtgctcagaccaccctcgagccagagcggctggaagctggactggtcccatgaggcagaaggagcaccagcgcctgctgggtggtgtggggagagccctcagctgactctggacacacctgcttccggggcacgtggcccagagccgggcctgtggacgggcctttctttctt

SEQ ID NO: 29779 - DNA, 601 bp, Human
agcggtcatgtcgacaccactgagatggaacacaggaacacgcggcatactaaacacacgcaggtagtaaaccgttttattggaaactggttaaaaattaaggcactccaagctttatggtttccttgaggttacagttttgtggctgctcttagtgtatttcagaaaaaagcagatggacgaagaccgaccttacagacgtgggtttctacactgagcgcaagggctgactacgctgtatttcacaaccgagccctagcgccagctcagcaccctacgctcaggaagcggattttgcacrcacactactgcattcatacagagttcactgaagtctattaccaagtgtcttttatgaataaacaatacaaagtccaattttgatggctgctataaaatacttaggaatctctgcaatactttactacaaatacaaatgcccaagaggtcagggaaatcagcctgaagaactgggtacaggttctattctttgtggaaatttcagcctaggaatgttattcccggtacagatgtacacagtcaaaaaggcttatcgagctgtttgacgagttcttgaagtgttctggatcagtgatctgcc

SEQ ID NO: 29780 - DNA, 601 bp, Human
gcccactttacccaaaaaagcctacctgcctcccagcattccaagcggtcatgtcgacaccactgagatggaacacaggaacacgcggcatactaaacacacgcaggtagtaaaccgttttattggaaactggttaaaaattaaggcactccaagctttatggtttccttgaggttacagttttgtggctgctcttagtgtatttcagaaaaaagcagatggacgaagaccgaccttacagacgtgggtttctacactgagcgcaagggctgactacgctgtatttcacaaccgagccctmgcgccagctcagcaccctacgctcaggaagcggattttgcacgcacactactgcattcatacagagttcactgaagtctattaccaagtgtcttttatgaataaacaatacaaagtccaattttgatggctgctataaaatacttaggaatctctgcaatactttactacaaatacaaatgcccaagaggtcagggaaatcagcctgaagaactgggtacaggttctattctttgtggaaatttcagcctaggaatgttattcccggtacagatgtacacagtcaaaaaggcttatcgag

SEQ ID NO: 29781 - DNA, 601 bp, Human
tgtggtggtttggaagtgaaaattgaatgtgagcacaggccatgtaaaggaaggagaaagtgtaaatgttaataacaggaaaactgaatttagctctcatgaggcagtcaaggaaatcattcattgaacatgttgggaaatacttttcatttggtgaccaaatacctacaaattcatttacaaaaaagaaaaatgaaagttacctcagaactaaactcagaaatatgtcccacatgggttcttgtaatgtttcttggtgaatgtctttatagaaagaagtgggcatgaaatgatgactcastaattaaacacatgggggaagggaggctgtagaaaacactggattctatatttaaaatttcattcagttcactaatttgtttttactgaccaaagctttctatacctatgtagagtgtctgagaactagaagggcccatcagttgccactcggatgatccttttgtctcttttcagataaggccccagttcaacagcgtcctctgtgtcaatcagatactcccaggaatgagtgagccctgccgttttcccaagttgcccctcagcacattccagccagttccaaaacttttggcttgtt

SEQ ID NO: 29782 - DNA, 601 bp, Human
tcatgacccatgaggacccaagagggaaatgacaggatgaaaaattcggaaggaatcatctggtccaaccgcattttttcacgtacttgggaccagcatcccagagcagtcaagtgatttgtccaagtaacacaactagtttgttgtcagcactggagccaaaagtcaggtttcctgatttacagacaaagctcttgcagagaatggcaaagtacagcccccattttcagtgtgtccgagggacatcctaggtatataccccatggtgaaagattgaagtcttaactaattagggcagcakagaagtgaatccctagtaattaatcagataatacccaaagaagacaatcaaatgacttaaaacttatcaataaagagcaaaaaactgtgctctgctttgtaaaacatgcactttaggccaggtgcagtggctcacacctgtaatcccagcactttgggaggccgaggtgggcagatcacttgaggtcaggagtttgagaccagcctggccaacaaggtgaaacccattctctactaaaaaatacaaaaattatctgggtgtggtgttgcatgcctgtaatcccagctactcaggatgcta

SEQ ID NO: 29783 - DNA, 601 bp, Human
aaaattcggaaggaatcatctggtccaaccgcattttttcacgtacttgggaccagcatcccagagcagtcaagtgatttgtccaagtaacacaactagtttgttgtcagcactggagccaaaagtcaggtttcctgatttacagacaaagctcttgcagagaatggcaaagtacagcccccattttcagtgtgtccgagggacatcctaggtatataccccatggtgaaagattgaagtcttaactaattagggcagcatagaagtgaatccctagtaattaatcagataatacccaaakaagacaatcaaatgacttaaaacttatcaataaagagcaaaaaactgtgctctgctttgtaaaacatgcactttaggccaggtgcagtggctcacacctgtaatcccagcactttgggaggccgaggtgggcagatcacttgaggtcaggagtttgagaccagcctggccaacaaggtgaaacccattctctactaaaaaatacaaaaattatctgggtgtggtgttgcatgcctgtaatcccagctactcaggatgctaaggcgggagaatcccttgaacccgggaggtggaagctgca

SEQ ID NO: 29784 - DNA, 601 bp, Human
aacctctgttttgtcactggttgctgtgccagatgtgccggagaggagtcttgggtccctgcaatgtggatttccccgggcttgttccttggctgcaggcttgcctagtgaccctgtttttctgaacacttcaaataagaaagtcatcaagcaggtttgagggagaaatctgacatgctcctcacaccaaagcctttgtaatattcaaaagcaggcggagctactagggatggatatttcagtctcatccaagaggctaagatggataaatacggttgccccaaaacaatttttttgtacrtaaatttaagcagaaacctattcatatttatccaaaggagaacctaaagctcacagaagaaaaggtgtacataaaagatctaaataaaatgatgaaggtgtaagaaaggtagaatctatagatattacttgggattgccaagagaatagatgtgaaaattaagtttattgaacattcatagaaaatctacaaagcgagttgattcaggttggtaagttgagtctaaaacttgctgaagtgtctgtagtttaatgttttaaagccctagaatagtgttaggttcatgaaaagtgttcaatg

SEQ ID NO: 29785 - DNA, 601 bp, Human
tagtagagacagggtttcactgtgttgcccaggctgtcttaaactcctgagctcaggcaatccgcccgcctcggcctcccaaagtgctaggattacaggcgtgagccactgcacccggcctctccttcctttttaaggctgaataatattccatggtatggctagaccaccttttatttatccattcctgctatgatggacacttgggttgcgtccatctcttggtccttgtaaataatgctgctatgaacacgggtatacaaatgtctcttcaagaccttgctttccattcttttagaartgtatcagaagtgggattgctggatcacgtggtagttctcttgttgattttttgaggaacctccatactgtttccatagcagctgcacaactttacaatcccattttacagtgcatatttgtcccattttacagctgaggaaacgaagcacaagtggaagagcagaggctcctggactctgtgattccgggcagaccccttccccagcctaccccctgggctaatgagaggcagtgggtatttagtcggggatgcagaagccgcagaccgacctccccttcctccagggagactacaggc

SEQ ID NO: 29786 - DNA, 601 bp, Human
attgaaaggcgaagagcagaagctgctgagaaacgccagaagatgccagaagatggcttgtcagatgacaagaaaccattcaagtgtttcactcctaaaggttcatctctcaaggtatttttttccccagaaaacttctattagaatatgatagagactggattttagccccttgtttagttattgattatacagggcctttgttcatttatctttttgctatccttccaagttaatctgttcaggctgctataacaaaatactttagactggggccaggcacggtggctcatgcctgtartcccagcactttgggaggcagatgtgggcagatcacctgaggtcaggagttcgagaccagcctggccaccgtggtgaaaccccatctctaccaaaaattcaaaaactagccggacgtggtggcacacacctgtaataatctcagctacttgggaggcttaggcaggagaatcacttgaacccaggaggcagaggttgcagtgagctaagataatgccactgcactctagcctgggcaacagagcaagattccatctcaaaatttatcactcacagttttggaggctggaaagtcaaagat

SEQ ID NO: 29787 - DNA, 601 bp, Human
ctctcaaggtatttttttccccagaaaacttctattagaatatgatagagactggattttagccccttgtttagttattgattatacagggcctttgttcatttatctttttgctatccttccaagttaatctgttcaggctgctataacaaaatactttagactggggccaggcacggtggctcatgcctgtaatcccagcactttgggaggcagatgtgggcagatcacctgaggtcaggagttcgagaccagcctggccaccgtggtgaaaccccatctctaccaaaaattcaaaaaytagccggacgtggtggcacacacctgtaataatctcagctacttgggaggcttaggcaggagaatcacttgaacccaggaggcagaggttgcagtgagctaagataatgccactgcactctagcctgggcaacagagcaagattccatctcaaaatttatcactcacagttttggaggctggaaagtcaaagatcaaggtgccagcagatgtggtgtctagtgagggcctattcctcataggtggcaccttctccctgtgtccttacatggtggaaggagaaagggagaaaacaggcttc

SEQ ID NO: 29788 - DNA, 601 bp, Human
aaaaaaaaaaactctgtggtatttattaattgctcatgaatcccagaccagtctgggtcagaaagaacccctcacatcttggagaattgtgtgtatcccctcaaaattcatatgttgaaatcctaatctgcaatatgatggtattaggaggtgggatctttggaagacaattaggtcatgagggtggaggcccccttaatgggattagtgcccttgtaagaagagacacagaaccttatttgctccctctctattctgcactatatgaggacacagcaggaaggtggccatctgcaaaccrtgaagagaggtctcaccagaccccaaccatgctggcaacctaatcttagacttcccagtctccggaactgtgagaaatgtttgttgttttaaggcacccagtctatggtaatttctcacattaaccaagactcactgagacaaggggccactcaaacatactagcctagggcaactaaaatccagtagatttcttgactgtcctgaacagggaagaaaatggaacttttcagcgtgcatgtgctttggcacatgcagtcataagcaaagaaggtatttgctcatggtattgataggtgat

SEQ ID NO: 29789 - DNA, 601 bp, Human
gcctgcacacccatcagtgtctaaaagaccagtacataacacagtgaaatgaaaagcgcattgcaagtttgtcagtcatacaacataaacggcccaaatccatggaatggttctcagtaggacattctcaatacaccacagtggtaggaacattggcagcagaaggccgtatgggataccatggtctacgtttccttacaaggtcccagcttagtgccacagtcatttaaaaatcacttggggaaaacatctgtctccctgagtgtttccaaaactgctttctggaaccattttagattayattgccactgccagcagcctaagactcagggttgctatggcaaaaaaaaaaaaaaaaatattcaaaagtaaggcaaccatttaccaccctgtgaaaatgaatgattaagaatgattgggttcctcttacttttagtcttctggtcaaaggatatggtcattcttcagaaaggaggctctgaagaacatctaaatgatgcttacactgcaaatgggaccctttgtggtacaatgagctcattcaactcccaactgtagcctttccccatttcaagtaatagacctcgtgttctccttcaat

SEQ ID NO: 29790 - DNA, 601 bp, Human
attgcaagtttgtcagtcatacaacataaacggcccaaatccatggaatggttctcagtaggacattctcaatacaccacagtggtaggaacattggcagcagaaggccgtatgggataccatggtctacgtttccttacaaggtcccagcttagtgccacagtcatttaaaaatcacttggggaaaacatctgtctccctgagtgtttccaaaactgctttctggaaccattttagattacattgccactgccagcagcctaagactcagggttgctatggcaaaaaaaaaaaaaaaaawattcaaaagtaaggcaaccatttaccaccctgtgaaaatgaatgattaagaatgattgggttcctcttacttttagtcttctggtcaaaggatatggtcattcttcagaaaggaggctctgaagaacatctaaatgatgcttacactgcaaatgggaccctttgtggtacaatgagctcattcaactcccaactgtagcctttccccatttcaagtaatagacctcgtgttctccttcaataaaaagaaaattaaaaagggagaaactggagaccaacaataagcaaggttagaacaggc

SEQ ID NO: 29791 - DNA, 601 bp, Human
ttgttattttttaaacaaagaatgagcttgttgacctaagcttttatgacctctctagcctatgctattagcgcattgcaggtttgtcagccatgcaatgtaaatagcccaaacccatggaatggttcccaggaagacattctccacacaccactgtgggaggaacattgacagcagaaggctctcctctcagacctctgagaggtatctgacttctcagaatggcagtcccagtgtttatataggttcctgtctgaaaagcagatgtcagctggccatagaccatcatcaccagtataayggagtctctctggataacattcctcctagccagagctctggaaagtggaacaaagatgatgtggaatggtcagactcagagaacaccactcacatacaaacatgaatggtactccctggagttatgtagcaccagggcagtacaaggtaggagggtgacagtgtgagttttcatgtgccactaacttctttctacagtagtaataatataaccaccagacccagaactagtttatgaggtagcagattaggtacctcttttgctccaaactgtcaaactcatttcttgttactcagtcat

SEQ ID NO: 29792 - DNA, 601 bp, Human
tggcagtcccagtgtttatataggttcctgtctgaaaagcagatgtcagctggccatagaccatcatcaccagtataacggagtctctctggataacattcctcctagccagagctctggaaagtggaacaaagatgatgtggaatggtcagactcagagaacaccactcacatacaaacatgaatggtactccctggagttatgtagcaccagggcagtacaaggtaggagggtgacagtgtgagttttcatgtgccactaacttctttctacagtagtaataatataaccaccagaccsagaactagtttatgaggtagcagattaggtacctcttttgctccaaactgtcaaactcatttcttgttactcagtcattccttagaaatgaatacaatgaacacccttgaaaattggaattcacaacactttaagatttcttaatagcttggcaaaaatttttagcaactagctgagggggagagaatggtgtaagaataggactataggtcagataagtctcgtggggtaggggtgtaagaataggagggagaaaatagagattgctagattaaaaatgggagaaaactaaagataaac

SEQ ID NO: 29793 - DNA, 601 bp, Human
ccctggagttatgtagcaccagggcagtacaaggtaggagggtgacagtgtgagttttcatgtgccactaacttctttctacagtagtaataatataaccaccagacccagaactagtttatgaggtagcagattaggtacctcttttgctccaaactgtcaaactcatttcttgttactcagtcattccttagaaatgaatacaatgaacacccttgaaaattggaattcacaacactttaagatttcttaatagcttggcaaaaatttttagcaactagctgagggggagagaatggtrtaagaataggactataggtcagataagtctcgtggggtaggggtgtaagaataggagggagaaaatagagattgctagattaaaaatgggagaaaactaaagataaacatcctccttcaccatcatacattgatgtggccctcactgagctattcagtcgcatgtgcctgttctggaatacacactgtagatttttggctcttacagtggggcttaaaaatgaaaaaaacaaagcaacttacttgactctaaatgctataagcaaggccaaaagttaagacaggaaaagagaacatcaag

SEQ ID NO: 29794 - DNA, 601 bp, Human
actgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttyatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatatt

SEQ ID NO: 29795 - DNA, 601 bp, Human
agatctggcagacatttacaaggtcgacaaggcttggcgactaagcaggaaaagaagtgggtgggcgagagggggctgcgaacgatgttttccggtttcctgcttgggtgccacttactgagaatgggggaagaggcaggtgcagggcacacccaccgaaaaccagagcgccgagtgtgagcagggctcgctaactcctcacggcctgggatttcaaggcgacgccaaccagctgtggccacggatacacagccacaggtatgagctgcgagcactcacgaaactctgcagggccgaaaakgaattggagtttaaaccctgcaactatctctctggaagagctaaaccacattgtcaacccgggataatccaggccccaggcatggaaggcagcagagacggaagcctcgtccaaaattggaaggatcagcccccagggcgagtatctcacagtcagcacccggccgccccagccctcgcagcaccgcttcccggggccactcctccgccggcggtagcgccgtccgtttcccagcttgccgctgccttccgccgcctgacccggccttccggcactcggccggccgccaggtctcccgcc

SEQ ID NO: 29796 - DNA, 601 bp, Human
ccttgaaccatgaatatcatagagaccaacttgccccatgcacatcaattcaaagcggacagaccacatacaaaatcattagccacctgtggttgagaaacaaattgtggttaacttgattaactgagagaacagtacagggtagctaacaagtctggaaacgtaggtgaacacataatagtttactgatattgcattataatccatgagaaaatatctttgtttcaagactttatggccaatctatagaaaatctaaagtgaaaatccagtgggcctcatcaaagatacacagactgcawataatgggaaatgctaattaaagcaacaatgaggtatcattacatacctagcagaatggccaaaaccagaacaccatcaacaccaaatgctggtgaggatgtggagcaacagggattctcaatcactgctcgtggaaatgcaaaatggtacagccaactcgaaagacagtttggcagtttcctacaaaactaaacatactcttaccatatgatccagccatatggtaaatacgcactctttggtatttacccaaaggagttgaaaacttatgttcacacaaaagcctgcacacagatgtt

SEQ ID NO: 29797 - DNA, 601 bp, Human
aaatactttgtgccaggtatcatcctgggaaataggacagagtggaagacaagacaaagttcctatcttccattagatcttactttagatagaagaataattatacagtagtatacctgtggggcaggggcagggggtacctcccaagtcccccagtagatgcttgaaaccaaatacagtactgagcctatatgcagcatattttttcctatacgtacatacctatgaaaaagtttagtttataacttgggcgcagaaagggattaacaacaataactaatacgggtacctgaacataaayactgccataccatgacagttgatctgataatcgagacagctactaagtgacctgccattagtcactcagtacatattacatattagtatgtcttcacatattaacatatttattaacagtggctgtctgggtgatggcattactgacaccttatttactccttaacattcctctatatcttctaatttttctataacatctgcattttttaaaagtgagaaaacagtaacaaatattattctataaaataatatcaacaaaggtcaggattgttctagccaatttcaactcttggccctg

SEQ ID NO: 29798 - DNA, 601 bp, Human
tgagtgaccttctccacactctagaaaccctgacaatgtcaaaaattccagtcaaaatacaactttaacctcactcctatgataaaatcagaaataccaaaataatacacaagcctataacagaacttgctcaccctcaaaagtccttctagaaagtcctaggtaacttcccccacttttaaaaattttaatctttaaaactgtggtgaaatagacataaaatttaccactcttaagcgtacagctcagtggcattgagtacagttacactgttggaatccatcccaggacttttttatcktcccaaactgaaacctttaccaaggtccccaatttcaaggtctcttggaaaacatcatttcttcccttctattaagacaaagctaagctccttcctcccctctctcccagttttgtgtgcacccctggtgaggaaaggtgcagcaataatatagaagacagccagtgccaccatctcaatttaaccacaggagagggtgatgtttgaccttctccaagagccagtctatgctctgcatttctacgaagactttgcttttctaccatcttacttcctgtaggctttctggaaaatcaaggg

SEQ ID NO: 29799 - DNA, 601 bp, Human
tggagcccaggagtgcagtgagccataatcagatcactgcactccagcctgtctcaaaaaagaaagaaaaaaaaaatagtaggaaaatgtgtaaatcactttcaaaggatttttttgaagagatggggtcttacttcactgtaacctctggcgtgtagctaggactgactacaagcacacacactatggtggactaattgttttttgtttttttgtagagacagggtctcgttatgttgcccaggctggtttcaaactctccacctcaagtgatcctcctgccacagctcccacgtagctrggattacaggagcaagccactgcactggctaaaatgatttaaatgacagcaacaactctctaaaatgggactgcattttaaaagtttactttctagaaaaatccctttgctaaacaaaattgtgaaatctttagtggtaacttgttaatagtatttctgtaatcatattgtttagtaataaaattagtttgtaatattcagggcagccgagaataacaatactgggtttcagaaataaactttcagaatttaaagtattacgagagatcccaaataaataataacagacaagaattaaaa

SEQ ID NO: 29800 - DNA, 601 bp, Human
cacaaacaaaactgctccttttgctgtgatcttctttagaaactggaaagacatttgcaaataaaaggaaaaaaaatccatgactttattcaacaacttcagatatactgtatgggaacatgatgaagaaactgagactaaaactaagaggtcatcttaacctaacctggggcacggcaacacatctcaaaccattttaggaagttggcataaataactttttttaaacttcttactaaagtatgtaagattagggttatgtacagtataattccacaattctcatattttattatacatwtaattattgctagaccatagtataaaattaattgtacaatgaagttcattctaattgtttcttcttaccatcacgcatcaattccacaatttcttcacgtgtaagatcatttttattcctgacttcatatttcaagtttctgaatgtttccctgaggtttgctgcatcgacatctgtaccagaccgagatgtcattccttggaacagaaagaattacttttaattgtatggaaaacaaagaataactactttgaaatgaaattaactactcagcaattcagaagtccacaataaattctt

SEQ ID NO: 29801 - DNA, 601 bp, Human
aaaaaactcaaagacattggtaattttaagtttgaatgtatattttgaaataaaaatggaaaataacaaatttgtacaaaattgtcacatagaaacacactttaagataccattacatgctatgtgtatttacaaaagttacaggtctagtaagaaaaaagaaactgtcattgacaaatgcgagctcattttttgagcaacaagaaatctcccgtgaaatgtcatactgacagccagtgagacttggtgcagtgacggctccgcacctgctgaggcctggagcctgcctcccgggctgagkgctcagctctggcctccggctggatgccgtctagagtcctatgtgctcataggtctttttctttcagtaaacagtataaaacattactattttcctttgattgtaaacttcaacagaaaataacatacttaagaattttgctacaaagagtactatgatttttattgcctcaccacctttagaacatttccacttcacaagtttctgatttgcttcactttcttacttggcgatggcgccctggcagcatcatccacacataccagtgcgtatggagaaatgggctgtaggcccttcctg

SEQ ID NO: 29802 - DNA, 601 bp, Human
catttccctccctgcaggcctggggaggggggctcaaggtctgtgggcatgaaaacccctaaaaaaatcattctcagtgtgcagaatggccagacaaggtctcggtaactcagaaaatcgtcgtctcttctctttctctcgcttcccaggagagagagtgggaagggagaatcaagttcctgatgccttgctgggctcccagatcgacagcaccttctgcccgcctcgcaacaggcagcagctatagtgctcctgacacatacctgggctagcagacctggccactgccccgcagtcagcrgagctcatcagccttgtctgccaccgaccaaggaccagtgactgtcctctcagggttgggattaagtcgcaaagggtttgagagattggggatgacaaaagggacttggagactaattaggagcagcaatgaaagcttaattcataaaagcaaacattttccatccatcaacctgcaaccagttaagggcaccgtttgaaagaaatctgtgtgtggggaagggagccaacaggaacaggaaatgtttgaaagaatgtaaactatttcagtttcataaaaagtaacaagtaaacagttatt

SEQ ID NO: 29803 - DNA, 601 bp, Human
gttcacaccttcagccctattgttaagagctctgtggtgttactgggtgcatgtctttcatggaaagccatcttcctggaattcagacagaatgtagaactaaaaattgaggcaacaagcagaggtttccatcagacttcttagttctggcagaagtcaagagacccaggcaagggttctgggtcccaacccccagtcttaactcccaaagtgtcccatctcctaaagtggcccagattgtcactgtcaaccactgactgttctctcaggtgggaatttcccagtcagcaggatgggcacygcagatgtgtgtctgcatgccagcggacccggcaccctccttcctccctgccaaccgcctccacctctcccactcagcagttcacaccttctgggtttcccccacccccgcccaaaccacacagtaatcagagaatcagtggctgtcaccgctcaaagggacctcaaagtcctcctccagtcccaggcatttgaagtaacaaaatctctaacatgtatccagctctcaatatgcgccagctgatacacttgtgtcaatttccctaaccttcccaaaatctcatgaggtaggtaccattat

SEQ ID NO: 29804 - DNA, 601 bp, Human
atattcaaatcagtgttttattataaattactttccctttttttctccatcatagctatggaataacatagtttgcaactgcatgtaaataggtaggtttcattatttatacatttcaacgtagaatagtaaggcttgatataaaatatgtattgtaagaaaggctcctcatgtctggcagggcagggacctcagccctaatcactgcaggagacagcaatgacctggttttcctcccttccttttcttggttcacaccttcagccctattgttaagagctctgtggtgttactgggtgcrtgtctttcatggaaagccatcttcctggaattcagacagaatgtagaactaaaaattgaggcaacaagcagaggtttccatcagacttcttagttctggcagaagtcaagagacccaggcaagggttctgggtcccaacccccagtcttaactcccaaagtgtcccatctcctaaagtggcccagattgtcactgtcaaccactgactgttctctcaggtgggaatttcccagtcagcaggatgggcactgcagatgtgtgtctgcatgccagcggacccggcaccctccttcctccctg

SEQ ID NO: 29805 - DNA, 601 bp, Human
acctcatggagtcctgtggccccaacgtttacatattcaaatcagtgttttattataaattactttccctttttttctccatcatagctatggaataacatagtttgcaactgcatgtaaataggtaggtttcattatttatacatttcaacgtagaatagtaaggcttgatataaaatatgtattgtaagaaaggctcctcatgtctggcagggcagggacctcagccctaatcactgcaggagacagcaatgacctggttttcctcccttccttttcttggttcacaccttcagccctrttgttaagagctctgtggtgttactgggtgcatgtctttcatggaaagccatcttcctggaattcagacagaatgtagaactaaaaattgaggcaacaagcagaggtttccatcagacttcttagttctggcagaagtcaagagacccaggcaagggttctgggtcccaacccccagtcttaactcccaaagtgtcccatctcctaaagtggcccagattgtcactgtcaaccactgactgttctctcaggtgggaatttcccagtcagcaggatgggcactgcagatgtgtgtctgcat

SEQ ID NO: 29806 - DNA, 601 bp, Human
gaaagtcatggtattggcagcaaggccaggttcagattgagccctgccaccctgcctgttccctctgctgtgggcttctgcatggagggcattcgtccacctcatggagtcctgtggccccaacgtttacatattcaaatcagtgttttattataaattactttccctttttttctccatcatagctatggaataacatagtttgcaactgcatgtaaataggtaggtttcattatttatacatttcaacgtagaatagtaaggcttgatataaaatatgtattgtaagaaaggctcctcrtgtctggcagggcagggacctcagccctaatcactgcaggagacagcaatgacctggttttcctcccttccttttcttggttcacaccttcagccctattgttaagagctctgtggtgttactgggtgcatgtctttcatggaaagccatcttcctggaattcagacagaatgtagaactaaaaattgaggcaacaagcagaggtttccatcagacttcttagttctggcagaagtcaagagacccaggcaagggttctgggtcccaacccccagtcttaactcccaaagtgtcccatct

SEQ ID NO: 29807 - DNA, 601 bp, Human
gcacccaacgctgcccagggtggtgaagattcaattcttcctgggagggaaaaacttgcttataaaagttctctggctggtcgcagtggctcatgcctgtaatcccaacactttgagaggctgaggcaggaggatcgcttgagtccaggagttcaagaccagcctgagcaacacagtgaacaacacccccatctctacaacaaataattttaaaaaatcagctgagcatggtggcgcatgcctatagtcccagctattgaggtgggaggactgcttgagaccaggaggttgagactgcagkgatcgcaccactgcaccctggcctgggtgacagagcgagaccttgtcccaaaaaaaagtaaaagaaaaaaaaattatctgagtcatgaacctaactcagttttacataaaacaagggtttttttttgtacttttaatatctactgaattttccagaaggaaagacagttctttttttttttttaattttgttcagcgctttgccaacaggtgttgacaacttcagaaagtcatggtattggcagcaaggccaggttcagattgagccctgccaccctgcctgttccctctgctgtgggct

SEQ ID NO: 29808 - DNA, 601 bp, Human
tgctgggcacgtcagcacagctgagatgggtggggtggaagtgggtgctggccgcctgatgggaaccccattctcaagacgaaggaaacaaatggggaccgcaggatacaacggcaggactgtgcccctcagagctcacgcgggctgcagggcgctgggctgggcctccctggacctgccaccatcccctccagcctctttcctcagggccaccacccctcctccggggtggtgggggaagtacctgccctcagcactccctcagaccccccagcagcttccttggagctcctgtaccccsaccctgcggcctcgcagccccaggaaacccgagctgcccggggcactgtcgagtggccaatcccaacagtggaaagaaatgtttattttcttctccagattgtccgggctgctgcatggtggctgaatgagccctttcagctgtgagaagcccccattgtgggcggctgcggctgggggctggggctggggtatgggaggtgctggggtctctgcactgcttgccagtgaccaatattggagggtcaaagcacttaacaggcaccgagggaagtggtggtggggtgtcccaagggggatc

SEQ ID NO: 29809 - DNA, 601 bp, Human
tgggcctgtgtctctggagccgactcgtggccacacagtgactggatgccaccctaacctgccttggcagcaaagtgagacagcagtcagacaaacttggggacccagaccccaacctggtcacagtgtccagcccagactctgcccctgctcccccaggaatgtggcttctcaatgggctccaaggcaagggtgttccatcctctgtccccaacttttgtcatcacagacccccaaaacctcagcattcaaaggggctcagggattgagtctaacacccttgatggggaaactgaggccyagacagggtgaggcacttccctcagggtcacacagcacattggacctggcacacaatcctagggcctctggtcctgagccccaacacgtacttgagagggagctgtcccgtctttgaggcagcacaggatcaaggcttactgtgtggcttctggagccggacagttatcctggtttggacacttactagctttgtgtccttgggcaagtcacttaacctctctgcgcatcagtttccccatataaaacatgagacgataacagttcatcaggattcagttaattcacatcgagtacttag

SEQ ID NO: 29810 - DNA, 601 bp, Human
ggagagggggcggggatgttgcttataatcacagagctatcataatcacggaactatacctgtaagagaccttgtgtttgaaaacgttagattaagcttctttttctaaaatcagttttaaaaactgttttgttttttttttgtttttttgttttttttttttttttgctcaggactatttgctttcagagcacaaaacaggttacagacaggtgtgtgccaggagtcgcaagatttggctggatcctcccaggaggcttgggggatggggcacagcttggctggacccaggggggacagrgacattgatgtctgacccaaaatgatccctcacctcaatgccttctgctaggacctatctatctggccctcctgttctctccacaaatggaattatgagaccacctaggggaaaggggacctcctatcccccctcccccgccctgccaagagaacagagagtggatgcgttgagctggtaaagtgcatggaggagccggtctgtaggtgctttcctgggtttaagaacctgatgccatagactcatcttctctggggcctgggacccgtgcggctgggggaaagccaacagttaggaacg

SEQ ID NO: 29811 - DNA, 601 bp, Human
gcgtctcatcagcgtttccctcgtcctcccaggggagcctgtggtgcaggctggtgggatgctgcctgatggggagtgtagccccttgagaaagtattgagaccctaataaccccacaccctcaggaggcagctgggggtccgcgggggggagagggggcggggatgttgcttataatcacagagctatcataatcacggaactatacctgtaagagaccttgtgtttgaaaacgttagattaagcttctttttctaaaatcagttttaaaaactgttttgttttttttttgtttttttgttttttttttttttttgctcaggactatttgctttcagagcacaaaacaggttacagacaggtgtgtgccaggagtcgcaagatttggctggatcctcccaggaggcttgggggatggggcacagcttggctggacccaggggggacagggacattgatgtctgacccaaaatgatccctcacctcaatgccttctgctaggacctatctatctggccctcctgttctctccacaaatggaattatgagaccacctaggggaaaggggacctcctatcccccctcccccgccctgccaaga

SEQ ID NO: 29812 - DNA, 601 bp, Human; identical to SEQ ID NO: 21272

SEQ ID NO: 29813 - DNA, 601 bp, Human; identical to SEQ ID NO: 21273

SEQ ID NO: 29814 - DNA, 601 bp, Human; identical to SEQ ID NO: 21274

SEQ ID NO: 29815 - DNA, 601 bp, Human; identical to SEQ ID NO: 21275

SEQ ID NO: 29816 - DNA, 601 bp, Human; identical to SEQ ID NO: 21276

SEQ ID NO: 29817 - DNA, 601 bp, Human; identical to SEQ ID NO: 21277

SEQ ID NO: 29818 - DNA, 601 bp, Human; identical to SEQ ID NO: 21278

SEQ ID NO: 29819 - DNA, 601 bp, Human; identical to SEQ ID NO: 21279

SEQ ID NO: 29820 - DNA, 601 bp, Human; identical to SEQ ID NO: 21280

SEQ ID NO: 29821 - DNA, 601 bp, Human; identical to SEQ ID NO: 21281

SEQ ID NO: 29822 - DNA, 601 bp, Human; identical to SEQ ID NO: 21282

SEQ ID NO: 29823 - DNA, 601 bp, Human
aggcctttaacctagcattcacagcccagctttagtgggatctcaaagcccctgcatagcatgtgaaactctagggagagaacccatgctctcttctgcttttcagaaggaggcggtgtgatgcaaggaaagttacaaactcctgctcttaaaggaaccccctcatttgacaagagagggagccggagcccagagcaggccaaagacttgctcaaaatcacccaaaaagtcaatgttagagtcagagcctgaatccctctttcctgtgactcctggccggtgcttcttcccagcacatgcrcacggctctgcagtccaggatcggtgtgccctttcctggtgctcacacatacctctccggggccccagggcgccggcccagcatgggcagttgctcattgttggagataaggtcgcgctggtcatccatgactggcttctgatcttcccgacagctcctgcttctcctcctgtgcatctgggaccctgaccccccggctcgcctcttaaagtcggtgctggagaggaatctgattcgtccacagaaggccactccgcccacttggtagatgtggaagtgaaagctacaaaggctggaaat

SEQ ID NO: 29824 - DNA, 601 bp, Human
ccaccaggcacagcctgttccaaggcctttaacctagcattcacagcccagctttagtgggatctcaaagcccctgcatagcatgtgaaactctagggagagaacccatgctctcttctgcttttcagaaggaggcggtgtgatgcaaggaaagttacaaactcctgctcttaaaggaaccccctcatttgacaagagagggagccggagcccagagcaggccaaagacttgctcaaaatcacccaaaaagtcaatgttagagtcagagcctgaatccctctttcctgtgactcctggccrgtgcttcttcccagcacatgcgcacggctctgcagtccaggatcggtgtgccctttcctggtgctcacacatacctctccggggccccagggcgccggcccagcatgggcagttgctcattgttggagataaggtcgcgctggtcatccatgactggcttctgatcttcccgacagctcctgcttctcctcctgtgcatctgggaccctgaccccccggctcgcctcttaaagtcggtgctggagaggaatctgattcgtccacagaaggccactccgcccacttggtagatgtggaagt

SEQ ID NO: 29825 - DNA, 601 bp, Human
ggagaggggcacaggcaaggacatgacccccgtcaaccctgagccccctccagaaatttaaccagagcctgtccctcctttcttgcctgcccccaacatctcacaatccctcctgtgatggcagatgtctccatctactctacagacacctgcaactatcattcccttgatccgtggtaattaggagggaactcctctgtgaagaactgcttctaccatcctcttttagaaactctttctccactgggatcttgaacattttcaaaatctggtgcaaggtctttatttatttatttatttwttttgagacagagtgtcactgtgtcacccagggtggggtacagttgcacaatcttggctcactgcaacctctgcctcccaggttgaagtgattctcatgtctcaacctcccaagtaggtgggattacaggtgtacaccaccacatctggctaatttttgtatttttagtagagatggggtttcaacatgttggccaggctggtctcgaactcctggcctcagctgatctgcccgcctcagcctcccaaagtgctgggattacaggcgggagccaccaggcacagcctgttccaaggcctt

SEQ ID NO: 29826 - DNA, 601 bp, Human
aaacagtctccctccttgccatgggattccctggggttttcacaggccacagctctaatggtctgcagcaggttaccttgttccccagaacatagcttgtcataacatctctgcagggttctcccaaacccctttctgcctggcaacagctgacatcacacctagctgtaagtccctgtagatcgcaaattactttttggagactgggggtagcaggggcattggggtaatagccttctagccctttttgagggaaacacatgggtgaggctattttggggctgggaagtgggggcctggkgtcccctggatggctgtgctggcctctggctgcaagggagaggggcacaggcaaggacatgacccccgtcaaccctgagccccctccagaaatttaaccagagcctgtccctcctttcttgcctgcccccaacatctcacaatccctcctgtgatggcagatgtctccatctactctacagacacctgcaactatcattcccttgatccgtggtaattaggagggaactcctctgtgaagaactgcttctaccatcctcttttagaaactctttctccactgggatcttgaacattttca

SEQ ID NO: 29827 - DNA, 601 bp, Human
ggtttggtttttgttttgttttgttttgttttgttttttgagacggagtcttgctctgtcgcccaggctggagtgcagtggcgcgatctcggctcactgcaacctccacctcctgggtttatgccattctccttcctcagcctctccgagtagctgggactacaggcacccgccaccacgcctggctaattattttgtatttttgatagagacggggtttcaccgtggtctcgatctcctgatctcgtgatccacccacctcagcctcccaaagtgctgggattacaagcgtgagtcaccrcgcccagccttttgttttgttttttttttctgctggcaggatcaaccaggtatgttattttttttaattgacaaaaccaaaaaaaattgtatgtgcttaccaagtaaggggaagagggttttcacccctctgcccaacctcccaccctcacagtgaaatcagatttaaggagaaaaggtaaggaagtgggaccgggacagcagaaaatgtagcccacctgggaagaagtggggcctggccattttaggagtgggctgggggaggcttggacaatgtcaggctgaagcagggccaggcacc

SEQ ID NO: 29828 - DNA, 601 bp, Human
taggacagacacgcagtacaaatttggggagaaaaaaagggtgtcttgagcaagtcacttccaaactttgagcctcagtttctttttttatttttattttattttattttttgaaatggagtctcactctgtcacccaggctggagtgcagtggcgtgatgatctcggctcactgcaacctccacttcccgggttaaagcgattctcctgcctcaacctcatgagtagctgggattacaggtgactgccaccacatccggctaatttttgtatttttagtagagactttcactatgttggycaggctggtctcgaactcctggcctcaggtgatctgcctgcctaggcctcccaaagtgctgagattacaggcatgagccactgcacccagccgagcctgtttatctcaaaaatgcagaggccagactacatataacatttaagggtcacccttgtattcagtaatccagagagcacatgttgaaagtctgccatgagccaggtatacaggccttggagcttggcccggccagggtcctgggtgggcaggcaggaccacccagctagctccctgcactcacctggagcaggtgcatcacat

SEQ ID NO: 29829 - DNA, 601 bp, Human
gaggaaagagagagttcccatgcagggaaacctgctgaccttccagtctatggtctccatggtgttcttaaggtgtctcaggttctccgggaagctccccttcagtggcgggtacaccttcagggggtcagcattctacagggtagcagggcaggaaggatggttcaagaagagctccctggcaggcagtgtgaaatgtgtagcccacgttcccttggtcttccattctgaggaatggaccagagctacaccaagcctaaaccctggacttcagccatgatgggaggggaggggagggtaygggtaagggtagtccagctgttcagctacgagactgcagcgttgcgagtcgagttccagattccaggccagctctaccaacaagccccagtgtcctccctgtggatggctgctcagctttcaggtcttacctgctccagcaggtgaggacccaaccttgactgcccccagctaggttgagtcctctgcctctttcttcacaaagccccctgcacttctgtcatcacctggtcacttgtctgtctcccacactagcctgggatccccatggcttcaggagctgggtccaattgctccccat

SEQ ID NO: 29830 - DNA, 601 bp, Human
ccttacctgggcccagatcctgcttggtcacacccagcccagaagacgggtcctccagttccagtgactctgcaaaggagcagcaagtccgtttgtcacttgaagtgcagcctacctgacccaagatgcctgagggcagtgcttcccacctagccacaggcttagtgcctgggaaagcaggtacccagggaaggacagctgcaagcagcaacaaagaggtgtaatgggggctcgagtgagaagggggtgatgaaatgagatgggtgggtctgtaggactcctggatgctagaggatggcgmgtggatggatgaaattcacagatgaaaggactgacggataagtgaacaaatatgagtgcatgtaagaggagagatgataaatggacaaataggaatgcacaggtgggtggatggataaagggctggacgcatgactacgtcactgcccccaggagctgccatcctgggtgtcctggtcccatgtgcttcagaggggacctcttgcccctcaaccttcctagtccttcctggtcctctgacactggcacagtgccactgcttaccactgcagttatggtgcccgcggcttctggtgttggg

SEQ ID NO: 29831 - DNA, 601 bp, Human
ggggagtgatgctggggaaagggaagagagtggctcagcctgcaggtaaataggctagaaaagccaaggccaaaggctggaggggagaggacagtcagcatgtccagcctggggtctgggtgtagggttatcccttctccctgtgccttcccatctcgtccatgagcctaggtcttggagccttgtgttggaggctgctgtgatgtcaggaacggggatctgtctagcttttggccacttcctgggacctcacgcccctgttgacagatggagattgggcagcagggccttgctgcattgytatctgctgttccgacttggtttgtcttgtccaagggtgacgaaagagccaggcaccagggtctcatgggatgaggtacagggtgggagatgggggaggggctgggggctgaagggagcaagaaagctgtagctgtgtggggctggcaggatgttgaagaccgcctctgctgctctcacatggggactggagagagaagcagcaggttgaggttggggtcacccatttgttgtccctgcccctttctaacatcctggacctgcagagcagttaaggactgtccaccctcccctgccccct

SEQ ID NO: 29832 - DNA, 601 bp, Human
ctttaaataaaaacataaccagggcatgaaacactgtcctcatccgcctaccgcggacattggaaaataagccccaggctgtggagggccctgggaaccctcatgaactcatccacaggaatctgcagcctgtcccaggcactggggtgcaaccaagatcacacaaatccctgccctcatgaagctcatgctctcatggggaggaagacagacatacaaagagatctagaatgtgaggtcaggtgttgacaagagccctggagggaatagagcagggaaaggtcagaaaaggaagacccarggtctctagaggaggtgtcagggaagggatctcccaagaatgccctgatgtgagcaggacctgaaggcaatggggagggagccgtgaagacccctggaaaagcagattccacacagggaaatgccaaggtcggaggtgctaaggaaataggagacacactgctgaccttgacctagtaggacacacacacacacacacacacacacactcactcactccagggctgggggatgaagagacctgctcaggacccaggaccccatttttccaccctaatgcataggtcccaatattgaccga

SEQ ID NO: 29833 - DNA, 601 bp, Human
ccttgacctagtaggacacacacacacacacacacacacacactcactcactccagggctgggggatgaagagacctgctcaggacccaggaccccatttttccaccctaatgcataggtcccaatattgaccgatgctctctgctctctcctagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggygaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtataccgtgagtgattcccccatgacctctgggtgttgggggtcagttctacttcccacacacaggattatcaggcctgggctgtgcctgtg

SEQ ID NO: 29834 - DNA, 601 bp, Human
cacacacacacacactcactcactccagggctgggggatgaagagacctgctcaggacccaggaccccatttttccaccctaatgcataggtcccaatattgaccgatgctctctgctctctcctagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattrtaggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtataccgtgagtgattcccccatgacctctgggtgttgggggtcagttctacttcccacacacaggattatcaggcctgggctgtgcctgtggccccctctgcattacgcaccatgttag

SEQ ID NO: 29835 - DNA, 601 bp, Human
cacactcactcactccagggctgggggatgaagagacctgctcaggacccaggaccccatttttccaccctaatgcataggtcccaatattgaccgatgctctctgctctctcctagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgyaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtataccgtgagtgattcccccatgacctctgggtgttgggggtcagttctacttcccacacacaggattatcaggcctgggctgtgcctgtggccccctctgcattacgcaccatgttagggtttgggca

SEQ ID NO: 29836 - DNA, 601 bp, Human
ctcagaagcggagattctggtctggagagtgataagtaaatggagaaataatcagttttactctagaactagatcacctcaacagtcagggtcagtgccgggattgtccaggcctctccctgagatccacagccccctcacatgacctcaaatcctgtgtttcccgatgtgtcagtgtcactcccacggaaggataaaggaaaggacttcgctttctctccccactcacaccctgtgccaacagaggcccaaagtgagacacacgcttgctcagtagctctctcatgaaggggggaatgartgaaggaatgatccataacctctatagagactggatcctggatgcagaatcctgggaggttctgaccacacctgttccgtgtccatcaggggctgagatccatgtaccattcctctgaccccctgtcccgaaagccaccctatctcatgtgactctggggttccttggccatgggagggttttcaaggctccctggtcctggtcgggacagccaagggactcctagtcctggggtctccgaggtcactataccccgcatggctcattgccatgggcatttctgactttcttctattcctc

SEQ ID NO: 29837 - DNA, 601 bp, Human
cactgactcaccagggggtcagaggcagaaggacaggtctgcagtccccaaagcccgcatgcttatttcactcacttcactacccactccatcttcatcctggtgtggggctcacatcctccagtggatcctgggacctcccccaggtggagctggccaggcaggtgctgtctgataggtttgctgcccattccacatacacctgtgtcctcatgatgatgccattgtcataaggtggagtcccttggactgagaagtgaaccagccactggcgtctcacttagactctacccagttacamaaacttaaactctagttgtgttttctgaggttgataggagaggaagaaaacctttcacatgcctgttttgaggcttctcctctttttgcctaactctgcacaggaactaggggcagggagcgctttctaaatttactaacatcacacacattgcttctcctaacttggcatcatttctccctttatgtaattgacacacctaagagttcctctctgaccggttctgtcctcttaacaggtctcacatccctctctctgttcagggagtcactgatttcaaaccactttcagcatcttcct

SEQ ID NO: 29838 - DNA, 601 bp, Human
tctacccagttacaaaaacttaaactctagttgtgttttctgaggttgataggagaggaagaaaacctttcacatgcctgttttgaggcttctcctctttttgcctaactctgcacaggaactaggggcagggagcgctttctaaatttactaacatcacacacattgcttctcctaacttggcatcatttctccctttatgtaattgacacacctaagagttcctctctgaccggttctgtcctcttaacaggtctcacatccctctctctgttcagggagtcactgatttcaaaccacyttcagcatcttcctttgagcataatgtgatcactttggaattcagagcagacctaaaccttagcataatattaaaagaagtactacttccagcaattgatcttagatctttaggccattgataagaatttccacttatggaaaaaatttaatgtttcccccaaatgtctttcacttttttaactatagtcagaaaataacatgagatctaaactcctgacaaatttttaagggcaaattatagtactacagattgagtatcccaaatccgaaaatccaaaatctgaaatgctccaaaatc

SEQ ID NO: 29839 - DNA, 601 bp, Human
ctgttcagggagtcactgatttcaaaccactttcagcatcttcctttgagcataatgtgatcactttggaattcagagcagacctaaaccttagcataatattaaaagaagtactacttccagcaattgatcttagatctttaggccattgataagaatttccacttatggaaaaaatttaatgtttcccccaaatgtctttcacttttttaactatagtcagaaaataacatgagatctaaactcctgacaaatttttaagggcaaattatagtactacagattgagtatcccaaatcckaaaatccaaaatctgaaatgctccaaaatccaacattttttgaccactgacatgattctcaaaagaaatgctcactgaaggccgggcacggtggctcatgcctgtaatcccagcacttcgggaggccaaggcgggaagatcacaaagtcaagagatcaagaccatcctggccaacatggtgaaaccccgtctctactaaaaatacaaaaattagctgggcgtggtggcatgcacctacagtctcagctactttggaggctgaggcaggagaatcgcttgaacccgggaggtggaggttgc

SEQ ID NO: 29840 - DNA, 601 bp, Human
aacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatggtaagtggatccacgaagcactgacatcatgttttgaggtggagtctgtctggttttcaaacaagagccaggaagacattttctatcccagcctgtgtccagtgggcacaagcaaatcccagattctcccactgaacctccccaatatgtctctacagactcttttcttcttgttctgatttctcatggcgggccccaggtccagcttggaatgtggggaggaggctccctcagccccacagccctgtgtagtggaggaagcttcacagagcgggaaggagcaagggttctcaaggtcaagttgcttctctctgtcaccaatgtgtccctttctgtcacctctttgtgttcttttgcctactccatgagctacaagca

SEQ ID NO: 29841 - DNA, 601 bp, Human
ggttctcaaggtcaagttgcttctctctgtcaccaatgtgtccctttctgtcacctctttgtgttcttttgcctactccatgagctacaagcaacattcaaggctttgaaacaagctcatacttttttcccaaatgagagaaggaagccccttgggtgagggagacacagctcagactgctccctgctctgctctgggctcccctgggtgactggccttgcctgactccacctaggtgggaacgaggtgtgtggagaaggagcccgggtggtctgtcctgaattcggctaaatcaagctgycaatcaacaccaaagcttcccttcgtcccagtcaggctgcaggaaaatggaaagagagggagcctcagggcagactcctgagctgcgtcctggctctgatgtcaccagctatatgaggctgtgggcacagcacatgggacacagcacaggggacagcaagtgacccacacttggagaaatcaggagattcaccacaggggctctgcacggcagggaatggcagtgtcaaaaatcgtgtgtttatacagatggtaacagtacatatctaacacaaacttaccatcttaacttttctacaca

SEQ ID NO: 29842 - DNA, 601 bp, Human
ttctacacatgcagttcagtggtattaaatatattccccttgttctgcttccatcaccaccatctacccacaggactcttttcttcctcccaaaatgaaactctgttcccatcaaactcctgggcagagctgccccatctatggcccacagtctgatccctgacttgtcacctctagacatgctcctagtctcctgcactatttctgctcaaacatccatctccatcatcacctatctctaggatgtccttaaatagcaaagcctcagagcaaacacaacttggctgggtggtgtgggacygtgcagctggaagaaacgcagctccttcaaattccaggtgaggaccccaatgggccaggcagccagccagtcaggaaaggaccagaagtgctgggggctgtgacccccagccctgtgtctgtccacaacccaatgctactgcccaattcacacttgagaaagtctgtgcttctcccacacaaaacagccagcctcatggtctctgagccctcagatcattgtgcatctgtcttgtgacgcacacacacctgccatgagcttttaaggactcagttgggctgagaggtgggagatgccaac

SEQ ID NO: 29843 - DNA, 601 bp, Human
ttgatagatgcccgtggaggaatcacaggtgccacacagggcaatcttctctctgttatctgcacagcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacraattaagtgttgaccacagcgacccagtcatcctgaatgtcctctgtgagtatcttctgttcctctgtggctcaggctgccagcccaaatccacatagccaaagtccaggcctctcagtccctctcaggcccaaggacagagacttttacccctggacatccaggctggccctacccccagcaaatccatgcaggcccagtcctgaccaagaataggaggggagggtctgctcctgtcctgtaacactcgggatccacagctagtgatgggagaaacagatgaatgtctcagactctggc

SEQ ID NO: 29844 - DNA, 601 bp, Human
tgggcaacctcagcctggaccaagaataggaggggagaggctgctcctgtcctaggaggctcagagtccacagcctatgatgggagaaacagatgaacgtctcagacccagactcagtggacatgagggttatggtttggacttttttttttttttttttttttttgagacggagtctcgctctttcgcccaggctggactgcagtggtgtgatctcggctcactgcaagctccgcctcctaggttcacaccattctcctgcctcagcctcccgagtaactgggattacacacacgtgccrccatgcccagctaatgttttttgtatttttagtagagacggggtttcaccatgttggtcaggctggtctcgaactcctgatctgcccgcctcggcctcccaaagtgctgggattacaggcgtgagccaccgcacccggccgatttggactttttaacacaggattgggacaggattcagagggacactgtggcccttctacaatcaggagcttcccctttcctctgatgacatcacctgtggctttgttctctttgttccagatgggccggacacccccatcatttcccccccagactcg

SEQ ID NO: 29845 - DNA, 601 bp, Human
agtgtgtgtttatagagagggtaagactatcagccactatatatatctaacataaaacttaccattaaccatttctaagtgtacaattaagtgaaacagcataaatatcaatcaagtatattgcccggtgtggtggctcatccctgtaatcccagcactttgggaggccaaggcgagtggatcacctgaggtcaggagttcaagatacagaaaaaaaaaaatagctaggcatggtggtgggtgcctgtaatcccagctactcgggaggctgaggcaggagaatcgctcgaacctgggcggygtagtttgcagtgagccgagattgagccactgcactccagcctgggtgacagagtgagactacatcacaaaaaaaaaaaaaaaaaggaaaaaataaatcaagtctttttatactcatgtctaaccatcacatcacactatccatttccagaactttttcatcttaccatactaaacctctgtacccaataaacagtaactccttctctcccctaaactctggtaatctccattctactttctgtctctaggtaatcaactattctaacgatcttacaaaaatggaattatataatagttg

SEQ ID NO: 29846 - DNA, 601 bp, Human
gctttgacttgcatatctctaagtgttagtgatgttgagcatatttgcatgtgcttgttggccatttgtatatcttcctaggagaaatctctactttagtcctttgtccatttattaattgggattttggatttttgtggttgttgatttgtaagagttcttcatatattctggaaattaatcccttatcagatatatgatttgcaaatatatttcccatttcataggttgccttttcactttctcgataatgttctttaatatataaaagtttttaattttcgaggccctgcacggtggytcctgtaatcccagcactttgggaggccgaggcaggtagattacaaggtcaggagatcaagaccatcctggctaacacagtgaaaccccgtctctactaaaaatacaaaaaaaattatccaggcgtggtggtgggcgcctgtagtcccagctactcaagaggctgaggcaggagaatggcatgaacccaggaggcatagcttgcagtgagctgagatcgcaccactgcactccagccagggtgacagagcgagactctgtcaaaaaaaaaaaaaaaaagtttttaattttcatgaagtcc

SEQ ID NO: 29847 - DNA, 601 bp, Human
gcatatttgcatgtgcttgttggccatttgtatatcttcctaggagaaatctctactttagtcctttgtccatttattaattgggattttggatttttgtggttgttgatttgtaagagttcttcatatattctggaaattaatcccttatcagatatatgatttgcaaatatatttcccatttcataggttgccttttcactttctcgataatgttctttaatatataaaagtttttaattttcgaggccctgcacggtggttcctgtaatcccagcactttgggaggccgaggcaggtrgattacaaggtcaggagatcaagaccatcctggctaacacagtgaaaccccgtctctactaaaaatacaaaaaaaattatccaggcgtggtggtgggcgcctgtagtcccagctactcaagaggctgaggcaggagaatggcatgaacccaggaggcatagcttgcagtgagctgagatcgcaccactgcactccagccagggtgacagagcgagactctgtcaaaaaaaaaaaaaaaaagtttttaattttcatgaagtccagtttatctatttttttcttttgttgcctatttgttgt

SEQ ID NO: 29848 - DNA, 601 bp, Human
tgccttttcactttctcgataatgttctttaatatataaaagtttttaattttcgaggccctgcacggtggttcctgtaatcccagcactttgggaggccgaggcaggtagattacaaggtcaggagatcaagaccatcctggctaacacagtgaaaccccgtctctactaaaaatacaaaaaaaattatccaggcgtggtggtgggcgcctgtagtcccagctactcaagaggctgaggcaggagaatggcatgaacccaggaggcatagcttgcagtgagctgagatcgcaccactgcrctccagccagggtgacagagcgagactctgtcaaaaaaaaaaaaaaaaagtttttaattttcatgaagtccagtttatctatttttttcttttgttgcctatttgttgttataaccaagacatgactgtgaaattaaatgtcattaagcttttttccctatgttttcttctcagagttttatacttttcactcttacatttaggtctttgatccattttaggttaatttgcatatatggtatcaggcaaagattcaacttgttcttgtgcatggatattcagctttccctatatcatttg

SEQ ID NO: 29849 - DNA, 601 bp, Human
ttttcgaggccctgcacggtggttcctgtaatcccagcactttgggaggccgaggcaggtagattacaaggtcaggagatcaagaccatcctggctaacacagtgaaaccccgtctctactaaaaatacaaaaaaaattatccaggcgtggtggtgggcgcctgtagtcccagctactcaagaggctgaggcaggagaatggcatgaacccaggaggcatagcttgcagtgagctgagatcgcaccactgcactccagccagggtgacagagcgagactctgtcaaaaaaaaaaaaaaaaagtttttaattttcatgaagtccagtttatctatttttttcttttgttgcctatttgttgttataaccaagacatgactgtgaaattaaatgtcattaagcttttttccctatgttttcttctcagagttttatacttttcactcttacatttaggtctttgatccattttaggttaatttgcatatatggtatcaggcaaagattcaacttgttcttgtgcatggatattcagctttccctatatcatttgttgaaaagactgtcctttccccattaaatggtcttggcaccgttatcaa

SEQ ID NO: 29850 - DNA, 601 bp, Human
tcatagcttactgcagcctcaacctccaaggctcaagtgatcttctgccccagcctcttgagaagctgggactacagacatgtgacaccaagcctggatagttttttaaagaaattttgtagacactgtgtctgcctatgttgcccaggctggtcttgacctcctgacctcaagtaatcctcttgcttgagtctcccaatgtgctgggattaaatgtgtgagccgctatacctccattttcatttctgattttagtaatttgaatcttctctcttttttcttagtcaatctaataaatgaytgtcaattttgttgatcttttttgaagaaccaacttttggtttcattgattccttctattgtttttcaattttccattttatttatttaaactctaatccttattatttccttcatgtactatctgtggtttgaggtggttctttttctgtatcctgaagttgtaaagttaggttgttgatttgagatctctctttatatttaatgtatttaccattaaatttctcacacaagattcttaacttctctgagccttcaattcttcaactgaaaattgtaataattctcatcaccaggaaat

SEQ ID NO: 29851 - DNA, 601 bp, Human
cagacatgtgacaccaagcctggatagttttttaaagaaattttgtagacactgtgtctgcctatgttgcccaggctggtcttgacctcctgacctcaagtaatcctcttgcttgagtctcccaatgtgctgggattaaatgtgtgagccgctatacctccattttcatttctgattttagtaatttgaatcttctctcttttttcttagtcaatctaataaatgattgtcaattttgttgatcttttttgaagaaccaacttttggtttcattgattccttctattgtttttcaattttycattttatttatttaaactctaatccttattatttccttcatgtactatctgtggtttgaggtggttctttttctgtatcctgaagttgtaaagttaggttgttgatttgagatctctctttatatttaatgtatttaccattaaatttctcacacaagattcttaacttctctgagccttcaattcttcaactgaaaattgtaataattctcatcaccaggaaatggaggaaaaatgaaaattgcaataagaatgactgtttaacagtattgttttaaagatttaatgtaatattcgat

SEQ ID NO: 29852 - DNA, 601 bp, Human
ttgaagcaacaagtagagactgcttcatgctgagagctggaacctggggcaccccactgtaaaataacatcacattcattccttctcttttctttccatgacggacgattcagcatctggaacttctcctggtctctcagctggggccactgtcggcatcatgattggagtgctggttggggttgctctgatatagcagccctggtgtagtttcttcatttcaggaagactggtaggtataatggcctttcctcttgttctgtttcctgcagtgctgactgccatgcttgggagagggaarggatttcttcacctgtatctgggactggatctcttcctcctacccccaagctcctgcttctcagcactaattcctgcaggtctcttcttccctggtcttcatgctccctgtacgccactgtctcttagatataattatccccaccctctgctcatttgtttcccagattcaatacattgtcaaagcctcttggtccttttttaacatctcacacttgtgtcattctctccattcccataaacctcaacaactgctcaaagtcctgcttgaccccttgttgccagtctttgaaatctttct

SEQ ID NO: 29853 - DNA, 601 bp, Human
aattggttatcagccataatgtcatatgccacagaagtaactaaatttctatgtgagttgtgttcttattataataaattatcatcagatttttaactgtactcattttaaatctttgtcattcacagacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcrcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatg

SEQ ID NO: 29854 - DNA, 601 bp, Human
ttaaacggataacaaagaggttctctgaaggtggccctgagatatgtggggttttgcagcctcgaaagaagagctggggcccggcagggcgcgggggctcacgcccgtaatcccagcactttggggggcggagctgggtggatggcttgagcccagcgagttcgagaccagtctgggcaacatggcgaaaccccatctctataattaaaaacaagccagggctaggggagacactttttaagagagcacttgtggttctagctcagagaggaccagacacttctgcagggtcacacagcarggtcctggacaggattcccagggaaagtggggggcgggggttgtgatgcgagacccacggacaggaccgggacctgaccctccaggaccttccagctggaggggggtgtcgtccccgcccaccccctcccccgacgcccactgggcacctgggaaggtgtccttacagctgacttctgcaggggaaactgcctctgcacgctctgagggcaccggccctgccagccccaacagccacctgcccggcggcactccagggccggcagactggagggagaattcctgcttccccgctgtgagc

SEQ ID NO: 29855 - DNA, 601 bp, Human
ccccctcccccgacgcccactgggcacctgggaaggtgtccttacagctgacttctgcaggggaaactgcctctgcacgctctgagggcaccggccctgccagccccaacagccacctgcccggcggcactccagggccggcagactggagggagaattcctgcttccccgctgtgagcccctgcaagccttcagaccagctcttggccaaaaagggaggctgaggcttggggtggtcaaggcctgagccagggtccccagcccggggctcacgactcctccttcaaggggccatctgcaycctgcattcatagagccccccgtgcagtggggtgggcaccctgccgcaccctgcatacagccggctaagggcaccggtgtccacagggacccagagacgtcgttccagctgcccagggccacacagcccacaagtgacagggccaagaccggaacccagtacctgctgggcctgcggaagtgggagcgggcacaggagggtggggcggcttccggagacggggtggggtggggtgggggcaggttgatacctgccctggcgggggtgaggacagaggctggaagagccgcttagcaggct

SEQ ID NO: 29856 - DNA, 601 bp, Human
gggaccctacccaaatcattccaggcagatctagctcaggggaccctaacccaaatcatcccaggcaggtccagctcaggggaccctaacccaaatcatcccaggcaggtccagctcaggggaccctaacccaaatcatcccaggcaggtccaggtcaggggaccctacccaaatcatcccaggcaggtctagctcaggggaccctaacccaaatcatcccaggcaggtccagctcaggggaccctaacccaaatcatcccaggcaggtccagctcaggggaccctaacccaaatcatccyaggcaggtccagctcaggggaccctaacccaaatcatcccaggcaggtccagctcaggggaccctaacccaaatcatcccaggcaggtccaggtcaggggaccctaacccaaataatcccaggaagagatgaggaagcggaggctgagtggggagctgtccgcgggaacctggggagatgggtgcagagcagggagagggatttgattttttttttccttctctcttttctttctttttttttttaagacagaggctcactctgttccaggctggagtgaagtggcccgatcttggctca

SEQ ID NO: 29857 - DNA, 601 bp, Human
aagggagcatctgcgtgggtgtggtgaggggggacctccaggccgctctatctgctgttgccctggagtccccggccccaccctctgcagagcttctgtggggttcctgctgggggtgcccccagcccagctcagtctcgtgccctttgctccaccagctcctgtccaaatatgacccccagaaggaggcagagctccgcacctggatcgagggactcaccggcctctccatcggccccgacttccagaagggcctgaaggatggaactatcttatgcacgtgagtacacgcagggacacrggctgtctcacacttaacaaatcttggtttttctcactttttttcttaattaagaaatttttggggggccgggcatggcctggctcatgcctgtaatcccagcacttttggaggccgagggtggtgggggggggcggtggatctcgaggtcaggagttcgagaccagcctggccaacatggtgaaaccccgtctgtactaataatacaaaaaaattagccaggcacctgtaatcccagctactcaggaggctgaggaaggagaattgcttgaacccgggaggcggaggttgcagtgagcc

SEQ ID NO: 29858 - DNA, 601 bp, Human
atgcaaaaattagccgggtgtggtggcaggcacctgtaatcccagctactcgggaggctcagggctgaggcaggagaatcacttgaacccgggaggtggaggtggcagtgagtctagatagtgccattgcactctagtctgggtgacagagctagacgccgtctcaaaaaaaaaaaaaaaaagagtggaaactgaggcccagagagaggccgtgagtttgcccaggaaggcgtgagcttggctgagatcagcatcgggtcttcacggttcctcgctgctcacagaggtttctgtttccccygccccatgttgtgccctccagactcatgaacaagctacagccgggctccgtccccaagatcaaccgctccatgcagaactggcaccaggtgaggggctggtggagcggagcagggatggtgctgggggcccatctaacaggtggggagactgaggcccactcactgtccctctcctgcctcttcccagctagaaaacctgtccaacttcatcaaggccatggtcagctacggcatgaaccctgtggacctgttcgaggccaacgacctgtttgagagtgggaacatgacgcaggtgcagg

SEQ ID NO: 29859 - DNA, 601 bp, Human
tgccaggtacttcagattccttggtgaacaggaaggacatggtctaccccttatgcagttcagtctgatggcggaggcatgcaaaagtgaacacagcattgtattatgcattatatgtaagctctggccgggcgcagtggctcacacctgtaatcccagcactttgggaggccgaggttggagaattgcttgacaccaggagttcgagaccagcctggccaacatggtgaaaccccatctctactaagaaaacaaaaattacctgggcgtggtggtgcatgcctgtaatcccagctactcrggaggctgagcccaggagttaagaggttgcagtgagctatgaccacaccactgctctccagcctgggcaacagagcaagactctctcaaaaaataatcataacaaaagtaataaataagctctgaactgggagaaatgccttgaaggagaagaatcagacgaatgttgagtgtctagtgatcttcaaacccagaccgggagcgtgggtgggacagtggtgtagaccgggagcgtgggtgggacagtgtctggtgtagaccgggagcgtgggtgggacacggtgtctggtgtagaccggga

SEQ ID NO: 29860 - DNA, 601 bp, Human
gtgagctatgaccacaccactgctctccagcctgggcaacagagcaagactctctcaaaaaataatcataacaaaagtaataaataagctctgaactgggagaaatgccttgaaggagaagaatcagacgaatgttgagtgtctagtgatcttcaaacccagaccgggagcgtgggtgggacagtggtgtagaccgggagcgtgggtgggacagtgtctggtgtagaccgggagcgtgggtgggacacggtgtctggtgtagaccgggagcgtgggtgggacacggtgtctggtgtagacsgggagcgtgggtgggacggtgtctggtgtagaccgggagcgtgggtgggacacggtgtctggtgtagacggggagcgtgggtgggacggtgtctggtgtagaccgggagcgtgggtgggacacggtgtctggtgtagaccgggagcgtgggtgggacggtgtctggtgtagaccgggagcgtgggtgggacacggtgtctggtgtagacggggagcgtgggtgggacacggtgtctggtgtagacggggagcgtgggtgggacggtgtctggtgtagacggggagcgtgggtgggacacg

SEQ ID NO: 29861 - DNA, 601 bp, Human
acaaaagtaataaataagctctgaactgggagaaatgccttgaaggagaagaatcagacgaatgttgagtgtctagtgatcttcaaacccagaccgggagcgtgggtgggacagtggtgtagaccgggagcgtgggtgggacagtgtctggtgtagaccgggagcgtgggtgggacacggtgtctggtgtagaccgggagcgtgggtgggacacggtgtctggtgtagacggggagcgtgggtgggacggtgtctggtgtagaccgggagcgtgggtgggacacggtgtctggtgtagacsgggagcgtgggtgggacggtgtctggtgtagaccgggagcgtgggtgggacacggtgtctggtgtagaccgggagcgtgggtgggacggtgtctggtgtagaccgggagcgtgggtgggacacggtgtctggtgtagacggggagcgtgggtgggacacggtgtctggtgtagacggggagcgtgggtgggacggtgtctggtgtagacggggagcgtgggtgggacacggtgtctggtgtagaccgggagcgtgggtgggacacggtgtctggtgtagaatggaatgggagtgtgtgtt

SEQ ID NO: 29862 - DNA, 601 bp, Human
ccttgaaggagaagaatcagacgaatgttgagtgtctagtgatcttcaaacccagaccgggagcgtgggtgggacagtggtgtagaccgggagcgtgggtgggacagtgtctggtgtagaccgggagcgtgggtgggacacggtgtctggtgtagaccgggagcgtgggtgggacacggtgtctggtgtagacggggagcgtgggtgggacggtgtctggtgtagaccgggagcgtgggtgggacacggtgtctggtgtagacggggagcgtgggtgggacggtgtctggtgtagaccggsagcgtgggtgggacacggtgtctggtgtagaccgggagcgtgggtgggacggtgtctggtgtagaccgggagcgtgggtgggacacggtgtctggtgtagacggggagcgtgggtgggacacggtgtctggtgtagacggggagcgtgggtgggacggtgtctggtgtagacggggagcgtgggtgggacacggtgtctggtgtagaccgggagcgtgggtgggacacggtgtctggtgtagaatggaatgggagtgtgtgtttgtgacatggtgtctcacgtagaaggaacagcaaggt

SEQ ID NO: 29863 - DNA, 601 bp, Human
gtgggtgggacagtggtgtagaccgggagcgtgggtgggacagtgtctggtgtagaccgggagcgtgggtgggacacggtgtctggtgtagaccgggagcgtgggtgggacacggtgtctggtgtagacggggagcgtgggtgggacggtgtctggtgtagaccgggagcgtgggtgggacacggtgtctggtgtagacggggagcgtgggtgggacggtgtctggtgtagaccgggagcgtgggtgggacacggtgtctggtgtagaccgggagcgtgggtgggacggtgtctggtgtakaccgggagcgtgggtgggacacggtgtctggtgtagacggggagcgtgggtgggacacggtgtctggtgtagacggggagcgtgggtgggacggtgtctggtgtagacggggagcgtgggtgggacacggtgtctggtgtagaccgggagcgtgggtgggacacggtgtctggtgtagaatggaatgggagtgtgtgtttgtgacatggtgtctcacgtagaaggaacagcaaggtcttgacattggaattggctgggctgttagaggaagcgggagctggttttctcctggggtaactg

SEQ ID NO: 29864 - DNA, 601 bp, Human
agcgtgggtgggacggtgtctggtgtagacggggagcgtgggtgggacacggtgtctggtgtagaccgggagcgtgggtgggacacggtgtctggtgtagaatggaatgggagtgtgtgtttgtgacatggtgtctcacgtagaaggaacagcaaggtcttgacattggaattggctgggctgttagaggaagcgggagctggttttctcctggggtaactgctccaaatggtgttttcagatgccccctgtggctcccagtaacctcacgtggggaatggtggtcagggaggagccgggygcagacatcccagtgaggggcagagccaatggcctggccatggtgcccggggattgggtcagaggaggtggtggaaggtgagagagaggaagcgaaaaccacgtccccatccccagaattcttggcctgagccctggaaagctgagctgttgcctaagacaaggcacgctgggatgaagcagccccatgggctgggcgcggtggctcacgcctgtaatcccagcacttttggaggttgaggcgggtggataacttgaggccaggagttcaagaccagcctggcaacatggtgaaaccccg

SEQ ID NO: 29865 - DNA, 601 bp, Human
gacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctscccatctgggtttttgggtttttctgtgttttcatcttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcc

SEQ ID NO: 29866 - DNA, 601 bp, Human
acaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatcttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagt

SEQ ID NO: 29867 - DNA, 601 bp, Human
gtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatcttttttttttttttcttracccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttca

SEQ ID NO: 29868 - DNA, 601 bp, Human
cacatcgtctccccatctgggtttttgggtttttctgtgttttcatcttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctgsttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctg

SEQ ID NO: 29869 - DNA, 601 bp, Human
gtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaycaacagacttcagaccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgta

SEQ ID NO: 29870 - DNA, 601 bp, Human
atgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctgagttgttggggctaagcctgaccccctctccatgctccccgccccaacycactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccagg

SEQ ID NO: 29871 - DNA, 601 bp, Human
cgccccaacccactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccacsgtgcccaggccctcagtaggttttaaggagcccccagccctcctcccttctgggcccgaccagcttatactgctccatcttccccggccacatgccccgccaagtactgcacagggaccccccacccaggggacctgctccgtgagataatgtgaaatacgactgtggaccaaacgcaataaaacctctgtttgtacgaagagaaggtggccaagagagttggcgtcgatgagggcgtgctttgctttgatgcttttgtggggagagaggaggtcttgggggatggggggatcaagggga

SEQ ID NO: 29872 - DNA, 601 bp, Human
ccactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccagsccctcagtaggttttaaggagcccccagccctcctcccttctgggcccgaccagcttatactgctccatcttccccggccacatgccccgccaagtactgcacagggaccccccacccaggggacctgctccgtgagataatgtgaaatacgactgtggaccaaacgcaataaaacctctgtttgtacgaagagaaggtggccaagagagttggcgtcgatgagggcgtgctttgctttgatgcttttgtggggagagaggaggtcttgggggatggggggatcaaggggaaaatgtcca

SEQ ID NO: 29873 - DNA, 601 bp, Human
ttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagyccccagccctcctcccttctgggcccgaccagcttatactgctccatcttccccggccacatgccccgccaagtactgcacagggaccccccacccaggggacctgctccgtgagataatgtgaaatacgactgtggaccaaacgcaataaaacctctgtttgtacgaagagaaggtggccaagagagttggcgtcgatgagggcgtgctttgctttgatgcttttgtggggagagaggaggtcttgggggatggggggatcaaggggaaaatgtccacctcaccattgggaggaggagc

SEQ ID NO: 29874 - DNA, 601 bp, Human
agagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccattactctgcacatggaccagaaaaagtatatgggaccttaagctcaccttctttacttgtatcaaatgatgactggtatactggtctcccatccctttgcttgtggcrggagatggcttaaataaataacttaaacttaaaaaaataaaataaaataatgctttgtctttaactcagaagtttcgcttctacgaatttatccttagtaaatgatcatggcaaagatttagcttaaaggatgttatcacagcttcatttgatattgtgaaaaaggtaaaacaacccaattattcaacaataggaaatttgttgaatagcttatgccattctcgtactcggccaccgtctttaatggcctcttagaaaacgatcccatgccctgggaagtgatcatgatatactaattga

SEQ ID NO: 29875 - DNA, 601 bp, Human
cctgggcaacagagcgagactctggtctcaaaacaaaacaaaacagcaacaacaaaacatgggcatctggcagctactagttgcataatgaagagactgacagctttctctattccccaccaataccttttctcgactgttttatcattggttgttgatgtagatatattacaatgttgtgtcctctgttgtttgctgtatctttaacaagggcttattctgattcttcaatactggccatgcgcggtggctcacgcctgtaatcccagcactttgggaggccaaggtgggtggatcgcckgaggtcaggagttcaagaccagcctcgtcaacatggcgaaacactatctctactaaaagtacaaaaagtagccgggcgtggtggcgggcgcctgtaatcccagctactcgggaggctgcggtgggagaatctaggaggttgaacccaggaggaggaggttgcagtgagccaagatccagccattgcactgcagcctgggcaacaggagtgaaactccgtctcaaaaaaaaatagtaataatatacttgatcttagccaaaaggccgagaagtgatgaaaaaagttattattattattatt

SEQ ID NO: 29876 - DNA, 601 bp, Human
ttattgtgaggattaaatttagatgatactgtaaaaagaccaacactatacttgcatatactttggccatttttattcagaatctgattcatataatttatttcaaaataactacacacacacacagatacatatgtatttgtgtgaatacacacacatatatacacacacggcacatgtatataggtatgtgtctgtgtgtgtgtgtgtgtattcacacaaagctagttgaccattttaacaagggcaatacgagaaatatgagaaactgtatgtaccatatactgaagctatatatgtyatatactgaaaaagaggtaaagcacccctttcttttgtagtctgtgaataagcaggaataggagtatcgtggcttcttagtacatctgtctgtctattctatctatctaatttgtgtatgggtctttgatgtgtgtatatatatatctgtgtatgtttatttaaatttatttaaatgtattatctctatatatctgtgttttatgtatacttataatatgtacgcatagagctaatttaatcatttattcttcctttttcatagacttctaaaagggtattttactgctttttcaaaaag

SEQ ID NO: 29877 - DNA, 601 bp, Human
gggcagttcttttttggggtagaatactgtcccagacattgcagggcatttaaaacttgagacttgtggtgcttggcatggtggctcacatctatcatctcagaactttgggagaccaaggcaggagggtggcttgaggccagaagttcaagaccagcctctgcaacatagtgagagcctatctctacagaaaatttaaaaattagccaggtgtgatggtgtatgcctatagtcctagttattcaggagcctgaggcagaaggatcacttgagctgaggagtttaaggttgcagtgacctrtgattgtgccactgcatttctagcctgggtgacagagtaagactctgtctcaaaaaaaaaaaaaaaaaaaggccatgagatgaaaaaaaatgggtaaacatttgaaataataattttaaattatatttatttatttgctttcaaatttaaatacgtgtgtttatcatttttatctggattctgtttttcgtttagaatgaacagtcaggtgtggtggggcatgcctgtagttccagttactggagtggagtggctgagttaggaagacaggaggatagcttgattctaagaggttgagtc

SEQ ID NO: 29878 - DNA, 601 bp, Human
tgaaaatgggcattttatagacataatgacattggaaaccccaaaacacaatatccagaaaatgctggcaacacagtacgctgtacaatattggttgtttactctcatgattgtgtggctgactgagagcggcagctcactgcacctgcccagcatagagagatagtatcatacttcatattgctagtccaggaaaattcaaagtatgatttctattgaatgcatgttgtttttgcatcattatataaagttgaaatatctcaaattgaaccatcatagttgagaacttctgtgtttgtasttttattttatgtgttggtagtaaggtttgcattctgccattggtagatgtatttctagtttaggcagtcaaactcctaggaatgtttttgacaggcactgaataagaccaaacatagctagctaaaatatagggttgtattatatatgtatttttatttttctgtatattatgatgttttgacatcttaaaaaacctttctggctgggaagagattacccctccagaggttagccaattcttagaattagccaaaaactcagctgggagcatgcctatgatatgtgctctaaccaatcc

SEQ ID NO: 29879 - DNA, 601 bp, Human
agtgtttcccctgtgaccctgtgtggcatgcgatgtgacttcctgtttagaatttgttaagtatagtaacctttgttttcatgagggactttcctttgtgctctgtggccacatctgtctatcataaaagagcacagaagagaatattatgtattgtttaatgaataaccatacctgaaataagatattgtaacttttgacataattaagtatgccacaggagcttccataacatctcttatttttgttttttcttttcttattcctacatagctaataactccttattttattgtttatrtttgatagttgctttgttgaaaattctgcaggccttatatgtatcaaatgaatatgtagatttggatgggttcatcattttcatgtttattgatttttctgctgtttctaactgaagctattataaaacttacctgaaaaatgtaataactaaggaatagactgtaagacggtaacgaaaaattccaatatatagtggtttcaagcaaatggtttattttcatttcacacgacacagaccagagggagaaacccgaaggctgtcagggtacctctgcatccttaatatgtgacttccgtc

SEQ ID NO: 29880 - DNA, 601 bp, Human
tctgatttttttttctttttcaagggaaaaatttatacacaaatgaatatgtggcaattaagttggtaagttcctgtttcttaatttttcttaatgatttctttgttactttttaagtaacttatatattttaattattttttgttttcatgtcatttataatttggatgtttatttgacagttatatgcatagctaatctttgttgctaagctcctaacatcatcctgctcttaaagtatatggtaatgtgtaggacattcatgtttgtctgtgccacaaaaactcaatccctttacttyggcagcattgtagaactggatcttggccctatttttaatttagggaaggatttttaattagataaaaattaacaagattttgccttctgattcaaacattttggtaaaacaaaagtgttcttagtattcaggattatattctttgaaaacatacttccaggtagcttctgaaatttctttttaaattgttacttcatatatatggcaaagctggctattgcttgactttgagggatgcagaaatgcttgatgtggtaggtgatagataacagggaaagcaaactcccgtggaattattct

SEQ ID NO: 29881 - DNA, 601 bp, Human
cacttgaaataaagatgtggagtagggttgcagtgccatgaagagagattggttggctgacatgtggctttagactggattttacctagatgagtccgtcttggtattaagatctggtccttggcttatgaaacaaaacgtgattaggttatctcaccagttgtcagcgtttcttagaggtggattcacagtaatcagttcacactatcaagctctcagattcaggaaagagtgaatttctaactaataatgaggtattttacaggtctagaaagcccaagtttctttctatgggccgatktacatagaaagccaagttaaaatttcaaggtcccctcatgagcatgaaatcagaaagaggttggtgaatattaatcacagcggggaggcctactgtgggatccgcctgcctcggcctcccaaagtgctgggattacaggcgtgagccactgtgcccagcctggacgttgtttgaacaggcattgctgactttcatttctttgaaattcttccttttctcatgttgtaggccagtggtcctgaacctacaacaatctttgtggtgtgcaaggataaaagtgtggcagtgtttacagtctgt

SEQ ID NO: 29882 - DNA, 601 bp, Human
cttatttttcaaagttctattgattctttttgaaattttctattaccttgttatacttttctgttggttctttttaaaatttcctgttaccctgttacagttttctacttcttgtattttcatatttaatattatttctaacgtctaaaacccatgtttcctctgtacatgtttgtgtgtgtgtgtgtgtgtgtgtgtgtggtgtgtgtatatgaatctcaaaaacatttatgtcgaatgataaaagctggacacaacagaaagcatatactgtataatatcatttaggtgaaatccagcracaggcaaaactaatccaaaggtgatagaagtaaaaaaggtatgatggaaatgttctatagattggtgtggtggttatagggatatatggagttaatatgtatttaacgcttatgaactgtgtgttttattgcatataagttatactttagtgaaaaaaaattaagacattgttgctactatcaaaattttcaaattaccatctttgttcttactatcctatgacttaactttaatctagaacctttatgtaagaaatacacagttcagaggtgaatttggagaacaggagaaatagcat

SEQ ID NO: 29883 - DNA, 601 bp, Human
atgtgaagtatgatttggtttagttttcaaattaaacttaaattaagtaaggccagtaaaaccttactgacctcactagtttggggctaattttatattggggagctgtatgcatttatgaaaataattttgctttcaagtagatttatggcaactcaaattaagccaaaaaaaatttacttaagatttctacatcaattaaggaataagaataacttgttagtatattaagataatgactgtgatttatttgtgcagccacattaagtgaaaagagagctaaatttgaagataaaatackgaattcctatctcactttagtattccgtagttctcctgtataatgctggcgttattaatgtaataataatattatcaacataacaaaagtagctctttctcaagcttgtttatattattcattgacagcaaactttaattatatattttcctttcttgctataatatctagaagtagattttttaaaatgtcggttaatagtactagcagtttagtgtaggcagatagggtagttgtcattaaggaagcctatataaaggtgggaaaaatggggttgccaaatcaaattagccaggtatt

SEQ ID NO: 29884 - DNA, 601 bp, Human
tcgtttctcattatttctaagagttttcagcgtactgagactacatctgacttcatcctaatattcaataagtgattaacttaataggtttctagtaatatggaaatacataggtaaaacaaagaatagtattttcattgacttcatgtattttgtaatattaactgacacatgatatgatggactaatatgacagcctaagtaggatcatgcctgaatccttcccactccaaaataaagactgaattcatttataatttatgtcctatacactttcaaaattatttgaaaatttgtaatrtgacccttgtgtaattggactaatgaaattataaattaaaacgtaataagagcaaagaaaagtacctaaaatttgaactgatattataattgaatactatatttgattctgaatgaaggcagaaagggaaacaatatgttctattaatattattctcattgtttgataaagggaggagagaaagagaaaaaaacttttcagtaatacaaaaatatgagaagaatttgccttgggcttatttgtgcaatggtcattaaatcacctgttgaacaaactttcaagcattggctttacaggaga

SEQ ID NO: 29885 - DNA, 601 bp, Human
ataagtgattaacttaataggtttctagtaatatggaaatacataggtaaaacaaagaatagtattttcattgacttcatgtattttgtaatattaactgacacatgatatgatggactaatatgacagcctaagtaggatcatgcctgaatccttcccactccaaaataaagactgaattcatttataatttatgtcctatacactttcaaaattatttgaaaatttgtaatgtgacccttgtgtaattggactaatgaaattataaattaaaacgtaataagagcaaagaaaagtacctaaaatttgaactgatattataattgaatactatatttgattctgaatgaaggcagaaagggaaacaatatgttctattaatattattctcattgtttgataaagggaggagagaaagagaaaaaaacttttcagtaatacaaaaatatgagaagaatttgccttgggcttatttgtgcaatggtcattaaatcacctgttgaacaaactttcaagcattggctttacaggagatgcaaagactttatatggcaattaaaaaattattcttaataaacatactaagagtatgtcatcaaat

SEQ ID NO: 29886 - DNA, 601 bp, Human
tacccatacaatggactgccatttgacaatataaagaaatgaaattgaaaacattgtgctaaatgaaagaagccaaacacaaaaggccacatgttatgtgattccatttaaatgaaatgtccagaataggcaaatacatagacatcaaaagattagtgattgcccagggcagggaagaggaggatgggatttctttatggagtgatggaaatgttctaaaattagatagtggtgatagctgctcaattctgaatactaaaagacactgaattatatattttgaaaggataaagtttataaygtgaaaaatatcttaataaaatggttgttttaaaaaaagtatagcaactcataatatcagtgaagccttacttcaggtgggttaggtaggttacagaaatcctcagaactttcctacctctttgctgattaaacattctatttaaacaagattttttctttaggtttattctgacatttctacacgtttgttattgtgttcctcataccctcttaatctgtgactaagaaatttgagcatgattttttttcttttttaagagatggaatcttgctgtgttgccaaggctggccctgaact

SEQ ID NO: 29887 - DNA, 601 bp, Human
aattagcagagatccttctcaccccaccccatttactagaatgtattctataatgcacattttagcatcctcatgtttcctgagaatagtatctcattggggtaaatacttgatttccaaatgatggaaaatactctattctcccatatggaaaatgatggaaaagctgattagcttcattagtaatgaggttttgtctttcttgtttactgtagctgagaattttaagacaggtaatacaaatgatagcaccttcatcattccttccaggaacttaggaaaacaaaataatttagtttamttatttactttttaagtagtatgaaaccatcctttattctttctctttccttcttccaacatttaccgaacagattatcatgttttgtaatgtgatgattattaaggtatgtcaaagtttgcataccattaagttggttggaaagtatactaacaacttttatacaatggttctcaaccttgatttcacattatagtcacctagggagttttaaagatgtactaatacttaggctgtattttcaaggtttctgattttactagttggtctgtggtggggcctggttatcagtatttttaa

SEQ ID NO: 29888 - DNA, 601 bp, Human
gtatactaacaacttttatacaatggttctcaaccttgatttcacattatagtcacctagggagttttaaagatgtactaatacttaggctgtattttcaaggtttctgattttactagttggtctgtggtggggcctggttatcagtatttttaaaaaacttctaaggtgactctaaggagcagccagggttaaggatcattggtctaatacaaagtattacatgattagcactataggaaagggataatttttactggagttcagaaaatggagtatgtcctcctagttgggaagatcrgagaagtcctcatgggtaaggatgcatttacactagttctcaaagatgagaatgatttggcaagggaaatggatagaaggagtcagagagaagaggttgacgcaaggaaagaattgaaccagttggaggagtaactcatgcaggcagagaatatatgaacacgttaatgaaaactgagataggctaatttcccaatctcagagggccttggtagccagtaaccaaatttggacattatctttctcagcacaagaaaggaagccaagaaatgacatgtggttttaagccaagaaacaatat

SEQ ID NO: 29889 - DNA, 601 bp, Human
ctagggagttttaaagatgtactaatacttaggctgtattttcaaggtttctgattttactagttggtctgtggtggggcctggttatcagtatttttaaaaaacttctaaggtgactctaaggagcagccagggttaaggatcattggtctaatacaaagtattacatgattagcactataggaaagggataatttttactggagttcagaaaatggagtatgtcctcctagttgggaagatcggagaagtcctcatgggtaaggatgcatttacactagttctcaaagatgagaatgayttggcaagggaaatggatagaaggagtcagagagaagaggttgacgcaaggaaagaattgaaccagttggaggagtaactcatgcaggcagagaatatatgaacacgttaatgaaaactgagataggctaatttcccaatctcagagggccttggtagccagtaaccaaatttggacattatctttctcagcacaagaaaggaagccaagaaatgacatgtggttttaagccaagaaacaatatgatcaggttgatccttaggaaaattaatttggcagcagttatgaggcttatgtcac

SEQ ID NO: 29890 - DNA, 601 bp, Human
tattctttgtcaaagaattaaagattagatgccataaaatatactttctgtacactcatcaacccaggtcaggagaaactaggttctggagtcctacgtggttagttctaggaggtaccaacagtctctcaaccaaaggatgagcaatgagtcatcttagaagggataaataagaacatcatatccagatagggaaacatgcttcagtttctgggtggatttgagagaaggaagtatatacaaatatatgaagaaaaaggcaatgaacaaaggagaaatggtggtgcggtgtcaatagcamaagcctgtatgtgttttaggactttgatccattttgattgcctgtttgttgcctaattgtatttaaagaaactaaggttgtttctaaagttcatcataagtaggacttaacatatattcccaaagaattttagagtagagatgtagcttcacattttgagaggctgaggtggaaggattgcttgagctcaggagtttgagaccagcctgggcaacatagtgagatgttgtctccactaaaaataatgaaaaaaaaatttaccagctcggcgcctgtagtcccagctactcaggaggctga

SEQ ID NO: 29891 - DNA, 601 bp, Human
tcttttctaagtcttaaatttaaaggttcatttggagtaaaggattttatcttttagaaagtaattgagatttgagaaatattaggtagctgacagttaaaaataaatttgacttatttttttaaatccagatcaaatctcttacatgtgtagtcttgttgtactgtggcagctcttctctaggctcttgactgggtaatccatttcagttctttctgctagtcacctccatgagagtaaagttgataaacattcatcattacatatatttctagttgaatctttatcagctggtccacarttttaaattatttacattccacggtctagtcggtgtttactgtttggtttacttaaaaaaatgcagttgtgtaatttggtttgcagtaccctcatagtagtttcataattatggcagaaatcacaataaataatttaaaattatttttgactaaagataatgtgggtagagagattatgtaatttaactggacagtgtagatttctgtttacatttatttcacagaagtatataaaacatacctagtagttattttatattctgtaatcttttgccgggtgggacacttgaagctatttt

SEQ ID NO: 29892 - DNA, 601 bp, Human
cctttatttgaaggattgtgaggcatttaagatagatgtgtatttaatttttttcttttttttttttggtgggagcagatcagtgattttttcagttcataccagaccacagcattttcccacagcagccttgatgtgttcatctcctcttttagagacagggtcttgccctgtcacacagactggggttcagtggcacaatcatagatcaaacattcctcctgcctcagcctctcaaggagatggggtaacaggcgggtgccaccatgtccagtgcatgtgtgtgtgtgtgtgtgtgtgygtatgtatgtataatataatatatgtgtgtacatttatatatgtatgtgtgtatatatatatttagagatatttgtgtatgtgtatatgtagttagagagagagagatatttagagatggggtcttgctgtattgtccaggctggtcttgaattcttaaactcctgagctcaagcaatcctcctgcctcggcctctcaaagtgctgggattacaggcatgagccactgtgcccagccaagattttttttcacctagaaataaaagtcagtattatatttttttgcatatacagttttgac

SEQ ID NO: 29893 - DNA, 601 bp, Human
tttatttgaaggattgtgaggcatttaagatagatgtgtatttaatttttttcttttttttttttggtgggagcagatcagtgattttttcagttcataccagaccacagcattttcccacagcagccttgatgtgttcatctcctcttttagagacagggtcttgccctgtcacacagactggggttcagtggcacaatcatagatcaaacattcctcctgcctcagcctctcaaggagatggggtaacaggcgggtgccaccatgtccagtgcatgtgtgtgtgtgtgtgtgtgtgcggatgtatgtataatataatatatgtgtgtacatttatatatgtatgtgtgtatatatatatttagagatatttgtgtatgtgtatatgtagttagagagagagagatatttagagatggggtcttgctgtattgtccaggctggtcttgaattcttaaactcctgagctcaagcaatcctcctgcctcggcctctcaaagtgctgggattacaggcatgagccactgtgcccagccaagattttttttcacctagaaataaaagtcagtattatatttttttgcatatacagttttgactt

SEQ ID NO: 29894 - DNA, 601 bp, Human
atttgtgtatgtgtatatgtagttagagagagagagatatttagagatggggtcttgctgtattgtccaggctggtcttgaattcttaaactcctgagctcaagcaatcctcctgcctcggcctctcaaagtgctgggattacaggcatgagccactgtgcccagccaagattttttttcacctagaaataaaagtcagtattatatttttttgcatatacagttttgacttgtaaaatggaatcacctcaattgtgctactttaaatattaagcatagtttttaccttaactaaactttyaataagcttgaccttctttaacccttaaagaattcaaaattgccagtcttggtattctatataatgtattttctgtctttcacttttttaatatgatggaaaatgttgactagtgtatattggagtgtctttttatttttggagtctaaactgattattggtgagaataaactccccaatgttaggatcattattgccttcctaatggcttcaacagtcacatataaatatcagggagaaagggtgagaatgcatagaatgaaattcttaattactcttagtgaaaaaccttttgaattt

SEQ ID NO: 29895 - DNA, 601 bp, Human
ctgagctcaagcaatcctcctgcctcggcctctcaaagtgctgggattacaggcatgagccactgtgcccagccaagattttttttcacctagaaataaaagtcagtattatatttttttgcatatacagttttgacttgtaaaatggaatcacctcaattgtgctactttaaatattaagcatagtttttaccttaactaaactttcaataagcttgaccttctttaacccttaaagaattcaaaattgccagtcttggtattctatataatgtattttctgtctttcacttttttaatrtgatggaaaatgttgactagtgtatattggagtgtctttttatttttggagtctaaactgattattggtgagaataaactccccaatgttaggatcattattgccttcctaatggcttcaacagtcacatataaatatcagggagaaagggtgagaatgcatagaatgaaattcttaattactcttagtgaaaaaccttttgaatttaatggctcctttttatgttgcatagaatgtcttgctattcttaaaaggcatgtgaatgaaacataatagtaatagctctgccatattttcact

SEQ ID NO: 29896 - DNA, 601 bp, Human
ctcaattgtgctactttaaatattaagcatagtttttaccttaactaaactttcaataagcttgaccttctttaacccttaaagaattcaaaattgccagtcttggtattctatataatgtattttctgtctttcacttttttaatatgatggaaaatgttgactagtgtatattggagtgtctttttatttttggagtctaaactgattattggtgagaataaactccccaatgttaggatcattattgccttcctaatggcttcaacagtcacatataaatatcagggagaaagggtgmgaatgcatagaatgaaattcttaattactcttagtgaaaaaccttttgaatttaatggctcctttttatgttgcatagaatgtcttgctattcttaaaaggcatgtgaatgaaacataatagtaatagctctgccatattttcactaatacgtatgcttcattggtgtaatcactgtttatcttgcactagcctgttgctttttatgatcatttaagttaaagtgatacagtcaactttgtgatattttagtgcttttaaaataaaaagagtgtttccctcatctgcaggtgctgctgtt

SEQ ID NO: 29897 - DNA, 601 bp, Human
ctgcaggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcastgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataag

SEQ ID NO: 29898 - DNA, 601 bp, Human
gaaaggcaccagaaacccgggtcgtgggtgggctgcagaaagaaggtccaggaccctcctccgattgtacgcaaaagctgtctggtgagcaacatttcaatttctgtttagcggttctcatcagatctttaaaaagattcgtaaatccaaaggagatttaaaaacagagattatctgcttgtctctctgttctgtctaccataaaccgatttctcaacttcctaccagacccaggagcagagccgaagccgcccggggctttgttaggccggggggaaacgttttttggtctcttgcttctgatcctttcaatccggcatttcctctgaacctccgattggacgcggggcgcgggagcctggcgacaacaccaggcatcttacattctgaaccccccgccgcagcccagccctcggcccaagggcgcgtgtctcctcctcctggccctgagtttcttggggacgaaagcgacccaggaggggagaagggggcctgtgtttcctcctcacctttcttttcggctctagggtccttggctgggtcggggtcgctgtaggcacgtggatagaaggcgggggcggcgggaaaggcagacgcacac

SEQ ID NO: 29899 - DNA, 601 bp, Human
acagagaggcagagagacgcttggtaagagcggcttgacctacggagcgcggccgcacagtaatggtaagggatcctcgtggaggccactgtgtcctgcctggagcgcccagctggctgcggctcactctgccaagtgcactgggagccaccgacacgtctcactcagcatttgtagaaagtcaggctggctcaaggcgctggagaacaaaacgggaggtctctgccctcggggcagttcacaccctggtgagggagacagacggtgacttaaaatttcaggctgcaaaaaaaaaaaaaawaaataaaaaaataaaaaaataaaaataaaaccaggtgatgctctggggtgaactgaattagggctagtttggtttgagaagttaaatgaacagaggccgaggcctcactgctagggacggtcttatctcaaaattaaggaatcaagaaacagaaggccagggagtgttggtttggtgatcggaggctccagcctggccgcagcagggtttgcgcagtgtccaagaagctgcgggtgggcaggcggcctcggaacctgccttgctggcttcctcgaattggtagcgatcagttctagccgc

SEQ ID NO: 29900 - DNA, 601 bp, Human
gcaaaggcccgggcgcccggccctggctcgcggaatgggcggccagatctcaggccctgcgtgcccgagctcagtcccagttccaaccgggggtgcccatggactctcggagggcactcctggggggacagctaagacaccaggctgcaggatcactcattgcacgctgcataatcgccgccacaaactctcccgtgcgcaagaacaaacgcgcgtgggacagaaaaagttcctaggtctccgcaggagtgaatgcaaaatccaggggactcagggtcatgttgggagccccttctccccmcgagagtcagggagctgttgaggtgggatcggtcagggtcgcgccacgcgggtcccttccctaccaggctcggataccatgcagcgtggacactcccgagttgctctgcggaatcccggggctctgaaccgcattcaagtccccgacgccgaagttcacgaagttgttgttggcggcggcagtggccggctgcgctggggaaggcccggcggggtaagcggcagtgcagctgtagccagggctgcaggccgcgccgccgtaacccggataggcggggtaggcgttataaccgtagggatt

SEQ ID NO: 29901 - DNA, 601 bp, Human
agatgagatttgggtggggacacagagccaaaccatatcagcctcctttttgtctagggatttctcagtttcagctaactctgtttgctcactggatacctttagtattttgttcccatcgagtgggtttttattctttcgccatagaaaaaatatttccaaatgtggaaggatctcctaaaatcctttcacccatccttttgactgcttccagaattttttaaaacattttgggccattcgtagtttctctaactttctctctgaccaacaggaaagttccactcaacaaacatttattsaatgttcattctgtgccaggcttaagtgaggctgggattaggaacttaaccaagagccagtcctcagtgagacaggcacataaatgtgattttagtttatgtggttatttttaagtatgtttttatcagcagaattccttgttgaaagggaatcttgtatggtagcccaatgtgtaatataaacaggaacaaagttactctgaatagtgagagagagatagagagccccaggaggctactggtgcaggccccagagtctagaagcctaggaatctggtgttctgatgtccaaaggcagga

SEQ ID NO: 29902 - DNA, 601 bp, Human
gtaggaagtgttagtgataggagaggaagagtgtcttgtgggaacagatgaaaggggacacagcttagaaagttgggtggaggatgtgccaagtcagtggagccctgtcaggtgaaagggtagggcagaggaggaaagctcaggcatttcacatagaagggacagtaggccaggtgtggttgctcatggctgtcattccagcactttgggaagcagaggtgggagaatcccttgaggccaggagttcaaggcccacctgggcaacatagccagaccccacttccacaacttttttttttttaactagcctggtgtggaagcatgcacctgtagttctagccacttaagaggttgaagagggaggatcacttgggcccaggagatggaggctgcagtgagctttgataacaccactgtactccaacctaggtcactatagagacctagctgtctctataaaacagacaaacaaacaaaagagtatatgcaaaggcctggcagctagaaacagcacaagggtttctgaagttcagtgtgttactaagagtctgtgactccaaactgtgttgcaaatatttctatgcaaatttcatgtgtgtga

SEQ ID NO: 29903 - DNA, 601 bp, Human
acagtaggccaggtgtggttgctcatggctgtcattccagcactttgggaagcagaggtgggagaatcccttgaggccaggagttcaaggcccacctgggcaacatagccagaccccacttccacaacttttttttttttaactagcctggtgtggaagcatgcacctgtagttctagccacttaagaggttgaagagggaggatcacttgggcccaggagatggaggctgcagtgagctttgataacaccactgtactccaacctaggtcactatagagacctagctgtctctataaaaaagacaaacaaacaaaagagtatatgcaaaggcctggcagctagaaacagcacaagggtttctgaagttcagtgtgttactaagagtctgtgactccaaactgtgttgcaaatatttctatgcaaatttcatgtgtgtgacagctttcatgtgttacacacacaggagctgaaggatcctcactgtcgggatgagatggcagccgcccgaggggctctgaagaagaatgccacaatgctgtacacggcctctcaagcatttctccgccacccagatgtcgccgctacgagagccaaccgag

SEQ ID NO: 29904 - DNA, 601 bp, Human
ccttctccactccagcccttgtgcccctccttttccttctctatttcctcttgctgaaaaaggctactcatcatttatgagctgtttcaagttctacctttctcagaaagaataaaccataccagtctcttcagaattaccatggcagcttggccaggcatggtggctcacacctataatcccagtgctctgggaggctgaagtgggaggattgattgaggccaggggttcaaggccagcctgggcaacatagtgagactccatctctacaaaaaaataaactagctgggtgtggtgggggcattcctgtagtcccagtttactggggagtctgaggtgagaggattgctggggctcaggagttcgaggctgcagggagctgggattgtgccactatactctccactcctgttgactttgttctatttgttttgggttgtgatttaaatgttccatatctatttaccttgtctcggcagctaaatcataaacttgcacatgtggaaagcaagagttgcatttctgctgtatctgtgctaagtcatgagacttgtccagtaaatactttttgaaacccgaggcaaactattatgtcttaaaa

SEQ ID NO: 29905 - DNA, 601 bp, Human
gggttgtgatttaaatgttccatatctatttaccttgtctcggcagctaaatcataaacttgcacatgtggaaagcaagagttgcatttctgctgtatctgtgctaagtcatgagacttgtccagtaaatactttttgaaacccgaggcaaactattatgtcttaaaaagaagcaaacaaaaattaatggtagttgaaaatctcctttatcttttatgtgtttgattgtccttctgaacaccaagaacccacttatctgtagaacgtacagggtgcatggttttaacatggtctttgaccrgcttattcctcttttgaagtgtgtggtcatcatgtccctggattgtttccaacaaataggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcaggtaatcatcacaaacaggtcccttacaaggcagctggaggagggtaactgaacgagataaggaatgtctcgcaaatgtcatgga

SEQ ID NO: 29906 - DNA, 601 bp, Human
tattcctttttagtgtttggagtttataaagcaggatggcctttgatgtatctgaatcactcatgtaaaaaagggccagggaatatgggattcattaatctacacagtttatgtcttaaaaataggtgatcagttactccaatttggctatgttaagttttgttttgttttgttttttttccaacaagtgaaggtttgtgataacacaggtagagatatcagccacagaacttaccccttagcagggacttggtagctatcaaggctttgagcacttgtctatgaggttgtagaaggaagygagtgaaagaaaatagaactgctcatcacttgaaattataactttcttctttgtaaatgaagccagactggaggatgctagtagacatgaataactgcagagacagtctgacctttaacaggactcgtggagtccatttcaagatttgtctaccagccagcaaatggacatttttccaaatgcttttgacctaacttatttggcccagttcacctggaagaatctctgtgaggaggaggtcactggaaacatcagccttctttgtgaggtgttaaaagagccagctgacccttggaaatt

SEQ ID NO: 29907 - DNA, 601 bp, Human
gatcagttactccaatttggctatgttaagttttgttttgttttgttttttttccaacaagtgaaggtttgtgataacacaggtagagatatcagccacagaacttaccccttagcagggacttggtagctatcaaggctttgagcacttgtctatgaggttgtagaaggaagcgagtgaaagaaaatagaactgctcatcacttgaaattataactttcttctttgtaaatgaagccagactggaggatgctagtagacatgaataactgcagagacagtctgacctttaacaggactcrtggagtccatttcaagatttgtctaccagccagcaaatggacatttttccaaatgcttttgacctaacttatttggcccagttcacctggaagaatctctgtgaggaggaggtcactggaaacatcagccttctttgtgaggtgttaaaagagccagctgacccttggaaattcaaattggccaggtgttgattctacacaggtgtgtggaactcacacctactgactcaggcagtactagccctgatgacctgctggttcttggctgactgagggctgagggagacattgcatcactgt

SEQ ID NO: 29908 - DNA, 601 bp, Human
atcagttactccaatttggctatgttaagttttgttttgttttgttttttttccaacaagtgaaggtttgtgataacacaggtagagatatcagccacagaacttaccccttagcagggacttggtagctatcaaggctttgagcacttgtctatgaggttgtagaaggaagcgagtgaaagaaaatagaactgctcatcacttgaaattataactttcttctttgtaaatgaagccagactggaggatgctagtagacatgaataactgcagagacagtctgacctttaacaggactcgkggagtccatttcaagatttgtctaccagccagcaaatggacatttttccaaatgcttttgacctaacttatttggcccagttcacctggaagaatctctgtgaggaggaggtcactggaaacatcagccttctttgtgaggtgttaaaagagccagctgacccttggaaattcaaattggccaggtgttgattctacacaggtgtgtggaactcacacctactgactcaggcagtactagccctgatgacctgctggttcttggctgactgagggctgagggagacattgcatcactgtt

SEQ ID NO: 29909 - DNA, 601 bp, Human
tttaattctcatcaaaattctataaaataggtactactaattctaggttttgttttaagaaaactaagtcattgagagggtaggtaacttggcagagatggtattaaaatccagatcatcctcttttcagaaactctataattctcaatatgtcaagatagaaaggaaatttcctttggtgcttgctgctttcatttcagcttccctttcccacctctggcattctcattccaatctctaatccctttcagaaacctgtcttgttttttattcccaaggtctttgtttttgatgacttgtsaaagcaactattcatttaaatatcaccatatctagagcttagctgataaaagaactcaatatattgtcacttctgcttttttttttttttttgagatggagtttcactcttgttgcccaggctggagtgcaatggcgcgatcttgactcatagcaacttccgcctcccggattcaagctgttttcccgcctcagcctccagagtagctgggattacaggcgtgagccactatgcccagctaattttgtatttgtggtagtagagacggggtttctccgtgttggtcaggctggtctcaaa

SEQ ID NO: 29910 - DNA, 601 bp, Human
attgagagggtaggtaacttggcagagatggtattaaaatccagatcatcctcttttcagaaactctataattctcaatatgtcaagatagaaaggaaatttcctttggtgcttgctgctttcatttcagcttccctttcccacctctggcattctcattccaatctctaatccctttcagaaacctgtcttgttttttattcccaaggtctttgtttttgatgacttgtcaaagcaactattcatttaaatatcaccatatctagagcttagctgataaaagaactcaatatattgtcayttctgcttttttttttttttttgagatggagtttcactcttgttgcccaggctggagtgcaatggcgcgatcttgactcatagcaacttccgcctcccggattcaagctgttttcccgcctcagcctccagagtagctgggattacaggcgtgagccactatgcccagctaattttgtatttgtggtagtagagacggggtttctccgtgttggtcaggctggtctcaaactccggacctcaggtgatccgcccgccttggtctcccaaagtgctggtattacaggcgtgagccatcgcg

SEQ ID NO: 29911 - DNA, 601 bp, Human
ctaatccctttcagaaacctgtcttgttttttattcccaaggtctttgtttttgatgacttgtcaaagcaactattcatttaaatatcaccatatctagagcttagctgataaaagaactcaatatattgtcacttctgcttttttttttttttttgagatggagtttcactcttgttgcccaggctggagtgcaatggcgcgatcttgactcatagcaacttccgcctcccggattcaagctgttttcccgcctcagcctccagagtagctgggattacaggcgtgagccactatgcccrgctaattttgtatttgtggtagtagagacggggtttctccgtgttggtcaggctggtctcaaactccggacctcaggtgatccgcccgccttggtctcccaaagtgctggtattacaggcgtgagccatcgcgcccggcccatttctgcttttttatttttattttttgctttgctgatagctgagtcctaatcttgtaaaagatacctccacaaaatgaatctctcataaggtatttggaaattgcttagataggtatgttcgtaatttggttgatggggaatagaaaggtggccactg

SEQ ID NO: 29912 - DNA, 601 bp, Human
gtaggctgtggacacagcccaatagctagggaaactacttctcatcttctctctgagctacagccaaacatttacataagtaaactgcaagtttggcccaagagatattttgaagtggcattaatgatattttatgtatcagtttcttcttaggggaatatctctttggtcaggaaactctatttaaaaaacaataaaaacagatctttgtttttaaaagattgtagtttttttaatgctaccctaacttctgtatctgatattaaatttgtccatatgaaatgcaacaagtttggggagsaatgatgctagctattaacattacaggagcaaaaccaattttaagatgtggcctatgcacataaaaaagtgaaatgactgtgtgataacagtcaaactttttcccactttggaaaacctacaatttttaatagtattttaaaataagcatcttggcattaatcatgtgacagtttaattcttggatttggctcacaaagtagtaggaagctaagatctgaaaaagctattaacttgatctcataatgcccaagagttttgctttttaacttttcctatttttttttaactctacagtctt

SEQ ID NO: 29913 - DNA, 601 bp, Human
ttttaaaagattgtagtttttttaatgctaccctaacttctgtatctgatattaaatttgtccatatgaaatgcaacaagtttggggagcaatgatgctagctattaacattacaggagcaaaaccaattttaagatgtggcctatgcacataaaaaagtgaaatgactgtgtgataacagtcaaactttttcccactttggaaaacctacaatttttaatagtattttaaaataagcatcttggcattaatcatgtgacagtttaattcttggatttggctcacaaagtagtaggaagcyaagatctgaaaaagctattaacttgatctcataatgcccaagagttttgctttttaacttttcctatttttttttaactctacagtcttaagtttgttttcttttaaaaattcaccgtgaactttattgctttgaatctgtagccttatggtttacaacagtcaaatagtttggtcatcactgattttttttcataacaaaattatatcatttctaaaatagtaatgttgccaaatataaggaagtttacaataaaatatgttgcaatcaaatgtttcatgacatgtttaaataccacac

SEQ ID NO: 29914 - DNA, 601 bp, Human
attaaatttgtccatatgaaatgcaacaagtttggggagcaatgatgctagctattaacattacaggagcaaaaccaattttaagatgtggcctatgcacataaaaaagtgaaatgactgtgtgataacagtcaaactttttcccactttggaaaacctacaatttttaatagtattttaaaataagcatcttggcattaatcatgtgacagtttaattcttggatttggctcacaaagtagtaggaagctaagatctgaaaaagctattaacttgatctcataatgcccaagagttttgstttttaacttttcctatttttttttaactctacagtcttaagtttgttttcttttaaaaattcaccgtgaactttattgctttgaatctgtagccttatggtttacaacagtcaaatagtttggtcatcactgattttttttcataacaaaattatatcatttctaaaatagtaatgttgccaaatataaggaagtttacaataaaatatgttgcaatcaaatgtttcatgacatgtttaaataccacacttgatattagagtgtgccacccaaacattgcagtttttcacagcaatgga

SEQ ID NO: 29915 - DNA, 601 bp, Human
gaaatgcaacaagtttggggagcaatgatgctagctattaacattacaggagcaaaaccaattttaagatgtggcctatgcacataaaaaagtgaaatgactgtgtgataacagtcaaactttttcccactttggaaaacctacaatttttaatagtattttaaaataagcatcttggcattaatcatgtgacagtttaattcttggatttggctcacaaagtagtaggaagctaagatctgaaaaagctattaacttgatctcataatgcccaagagttttgctttttaacttttcctawttttttttaactctacagtcttaagtttgttttcttttaaaaattcaccgtgaactttattgctttgaatctgtagccttatggtttacaacagtcaaatagtttggtcatcactgattttttttcataacaaaattatatcatttctaaaatagtaatgttgccaaatataaggaagtttacaataaaatatgttgcaatcaaatgtttcatgacatgtttaaataccacacttgatattagagtgtgccacccaaacattgcagtttttcacagcaatggaataatctctaggatact

SEQ ID NO: 29916 - DNA, 601 bp, Human
ggggttcaaaaatccatatatacaccaagtatggtcttctgaccaaaaagttcatgttcatgtctatgtaaacaggtatggcttttttccaaacacaggcaaacctcgaacgtattgctggttctgttccaactactgcagtaaaatgccaattgcaataaggtgaatcatacaaatcttttttgattcccagtgcatataagttatgtttacagtgcagtgtagtccattaactgtgcagtaggattatgtttaaaaactgtacatacctttatttagaaatacttcatttctaaaaaaygctaaagatcattctgagccttcagccagccataatctctttgatggtagggggggtttccttgatgttgatcagagtggtggttcctgtgtggttcctgaaggatggcgtggctgtggcaatttcttgaagtaagataacaatgaagtttgatgcgttgattgactattcctttacaaaagattctctgtagcatgtgagatgctgtttgacagcactttatccacagtagaacttctttcaaattggagtcagtcctctcaaactctgctgctgctttatgcactacatttatataat

SEQ ID NO: 29917 - DNA, 601 bp, Human
taaaccatgctataaacagatgtgctgtcttcagtcttcgttgttccatttatagagcacaggcagagtagatttagcataactcttagggccctgggattttcaaagtggtaaatgagcatttggttcaacctaaaaatcaactgtattagccactaataagagactcagcctgtcctttgaagccagctatgaaagttgtaaatggcaccgtcttccagtagaaggctgtcttgtcaacattgaaaacttgtttgcccccttaatcaatgatcttagctagatctttaggataacttgscacaggttctatctacatcagcacttgctggtttaccttgcacttttatgttatggagatgacttctttcttaaacatcatgaaccaacctctgctagcttccagcttttcttctgcagcttccttacctctctcagccttcatagaattaaagagcattaggatcttggtcaagattgggctttggcttaaaggaatgctgtggccgatatgatcttctatttagaccactcaaactttctccatattagcaataaggctgcttcattttcttatctgggtgttcattggagtagcact

SEQ ID NO: 29918 - DNA, 601 bp, Human
ggcaccaacagacttgcttgacgcagagttgcaacaaaccttcaatttgtatttgggggggaagaaaaaaaaacccaccaatctgtgatacacaataaaacaagacatgcctgtagattgtttttaataaagtacaaatctatttgaaaacattctgaaccgtagtagcttttacatgtctaccatccatcaatataactactatcatgaagaaactgtgactcattttttcataaaaagggacctgaattggagaaggttgaaaaacactgagtaaactgtaattatatgttgcttgacracaggcatatgttctgggaaatgcatcgttgggcaatttcatcactgtgtgaacatcacatactgtatttacacacctagatggtattgcttactgcatacctacactacatggtataacctattactcttaggctacaaacttgtacagcacgttactgtactgaatactgtaagcaattggaatacaatagtaagttttgtgtatctaaacatgtataaatattttaaaagtacggtaaaaatatgacataatcttatgggactacctttaagtatgtggtctgttattgactgaaat

SEQ ID NO: 29919 - DNA, 601 bp, Human
atacacaataaaacaagacatgcctgtagattgtttttaataaagtacaaatctatttgaaaacattctgaaccgtagtagcttttacatgtctaccatccatcaatataactactatcatgaagaaactgtgactcattttttcataaaaagggacctgaattggagaaggttgaaaaacactgagtaaactgtaattatatgttgcttgacgacaggcatatgttctgggaaatgcatcgttgggcaatttcatcactgtgtgaacatcacatactgtatttacacacctagatggtaytgcttactgcatacctacactacatggtataacctattactcttaggctacaaacttgtacagcacgttactgtactgaatactgtaagcaattggaatacaatagtaagttttgtgtatctaaacatgtataaatattttaaaagtacggtaaaaatatgacataatcttatgggactacctttaagtatgtggtctgttattgactgaaatgatttatgttgcatgactatatcttaaaattttaaaaatttatttataaaaattagtcaattaggccgggcctagtgggtcatgcct

SEQ ID NO: 29920 - DNA, 601 bp, Human
atctaaacatgtataaatattttaaaagtacggtaaaaatatgacataatcttatgggactacctttaagtatgtggtctgttattgactgaaatgatttatgttgcatgactatatcttaaaattttaaaaatttatttataaaaattagtcaattaggccgggcctagtgggtcatgcctgtaatcccagcactttgggaggccaaggcaggcagatcatttgaggtcaggagttcaagagcagcttgaccaacatggtgaaaccctgtctttactaaaaagacaaaaaaaaaaaaaaatccaggtgtgatggtgcatgcctgtaatcccatctacttgggaggctgaggcaggagaatctcctgaacttggcagactgaggttgtggtgagctgggattgcgtcactgcactccagcctgggcgacagagggagactccgtctcaaaaaaaaaaaaaaataaaataaaataaaattagtcaattagtaaattataaaactaatactttgtacaacattattaacctgactatgtaacagattttgctgatgatttgagtaattaatagcaatgtttttgttatggatttctagcctgt

SEQ ID NO: 29921 - DNA, 601 bp, Human
tctcactatttttttctcaactccaaagtaccgtttctaaactctgcactgaaactttgtccattcttgtattactgttatacaaagaaaatagcagccggatgtgtgattttgacacaaatccttttctagttacttactctcaagggccaggacacattttaattgtcttaagaaattctacaggacagaaagagaagcttcttttaatcaaagttttacatttagaattctctgtcaatattcatttgagtaaacatttctctcagatgtccttttaggtatatactgtgttcacatktttaatcatgttttcattaaaatgtcatgtctcaagaaaatgtcatgatttgggaagtactactttttgtgagttttagaaatcgaaatactaaaatttaaacgtttcattatttttctattctaatttatagttgaaattaaagaaatggagaatgtagaaatcagcaatttataatggtttgagtgaagaaatcacactgtatgaggtcaaaatggatgttctttatgaaaagtcagttataacttgcaattttctatcctgtgtcctaaaaatataaattttctttctaagtgctta

SEQ ID NO: 29922 - DNA, 601 bp, Human
gtgtgttttggagaatactgtaaactgtgttgcttataatcaatagaaatttatgtctcatggttctggaggctgggaagtccaagacaaaggactctgctttctcatagtcttctcactggaaccttgataggaagaggatagaaagagggtagaaagagggagggatctctgaggtctcttttataaggacactaattccattccttaagattctgccctcataacacaatcacctcctaaagtctgcacctcttaatactacccctttgggagttagaattttaacatatgaattttwagggaataaaaacatgcagtttattagttggtgtgtgtgcatgtatgtgtgtgttcagcttatttacaaagagcactaaactttttgaacatttccttagaattctgcttctaaagaatgcacaaggaatagaattacagatctcacactggacatgaaaaatacaaaattacacacttgttaaaactgcaagggaataaataatgtgttttctctatgccattagagagtgaagcctcccctctatgcctgcttgatttctactttgggcaatcatatgaaagttatgcagatcttgac

SEQ ID NO: 29923 - DNA, 601 bp, Human
aagggaataaataatgtgttttctctatgccattagagagtgaagcctcccctctatgcctgcttgatttctactttgggcaatcatatgaaagttatgcagatcttgactataatctgagggaaccagccacaagactggattgtattttaattgtgggaaactgatcgtcttcacctaatcagttttcccattgcatataccgtgtgcatgacataattttaaaagaccaactgcgtgatatttgtttatttttcctcaaatgttttcgtaatgaaaacatgattaaagaaacatgtgyccaaagctttgactctggttttatttatggacatttatacttggtcagattgacttcatgttggctgctacaacttctaaaaggccctgtcgtgtgtaagtatcaaacttcaaaacaaaggaagggatattctttaagtcagtggtcctcagaatgttgtcttcaaaccagtggcattagcatcacctgggaacttgacagaaactcaatttcttgggctctaccccagacttactgaattggaaactctaggagtggcacctagcgatctatgtgatgctaccagccctctggctgatg

SEQ ID NO: 29924 - DNA, 601 bp, Human
gagctggaataagaggtagtgagagagaaattgcctaatcctctgctttttatttttaacccagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcagggtatgtgaggcctctgtagctcagagctggtcagatctcctagtaggaaactaaagagctaactgtcttatttattatttatttygtaattactgagtttaacttggtaagctgtttggctccttattagtcagacaaggtgagctttatacttatgaagggatgagtaatatcaacaagctcaagtgagcactgaatattctgaagggcaacaccctgcctacttgttgcatgcattacttcctcagtttcatacaacctttaggcatacccctgctattttccatttgtatctcttgctaacactcttcccatcaggatctgaagaccatgggctggaaagaaatgaagattacacagcatagtagtgtttataataacacat

SEQ ID NO: 29925 - DNA, 601 bp, Human
ggcaacaccctgcctacttgttgcatgcattacttcctcagtttcatacaacctttaggcatacccctgctattttccatttgtatctcttgctaacactcttcccatcaggatctgaagaccatgggctggaaagaaatgaagattacacagcatagtagtgtttataataacacataatagtaacagttattatcatgcaactatgaagtgatacataattacattctctttgtataaaaataattcagacattataaataaggctggatagcctaacatcaaacctcttattacccamtccactatcttcccatcttcagacttctgttgttaggtaggtgtgtcttccaaaatgttgtctaaataattaatatatatattcacaggcctagaaaatatatattgtagttgatttaaaaactcatacagcatcatttgcaactttttgttcacccacaaggcacattcacatatgtctgttaagacatctagctaacctcattttatttaactgctgtataatccattataagatgacttttttctccttatcttaccaacagtttagcatagtaatgtccaaacatatttattagcc

SEQ ID NO: 29926 - DNA, 601 bp, Human
acatatgtctgttaagacatctagctaacctcattttatttaactgctgtataatccattataagatgacttttttctccttatcttaccaacagtttagcatagtaatgtccaaacatatttattagccacataataatctttatttcttcaaatatactgcatatgcaaaagcacatttattgctattatatttgaagcagaggtggggcttctgcagttctaatcccaaaagcatgctgtccagtagaatggtatccacacttgtaacttaaaatattctagtaaacacactacaaargcaaaaagatgaaattaattataattttaaaaatttatttaaccaaatgtatccaaaatatcattttgtggcacactatggtgttttgtttggcacggagcctaaatctttctctctctttctttctgggtgtgtgtgcgtgtatgtgtgtgtaagagagggagagagatgcctagaaatatgggagggggacagagaaaagagatataagaattggaagagagggcaaggaaggatagtcagccttttaggcccataagaaattagatcatttttgtactaacttgtgaaataaagtaa

SEQ ID NO: 29927 - DNA, 601 bp, Human
ctttatttcttcaaatatactgcatatgcaaaagcacatttattgctattatatttgaagcagaggtggggcttctgcagttctaatcccaaaagcatgctgtccagtagaatggtatccacacttgtaacttaaaatattctagtaaacacactacaaaagcaaaaagatgaaattaattataattttaaaaatttatttaaccaaatgtatccaaaatatcattttgtggcacactatggtgttttgtttggcacggagcctaaatctttctctctctttctttctgggtgtgtgtgcrtgtatgtgtgtgtaagagagggagagagatgcctagaaatatgggagggggacagagaaaagagatataagaattggaagagagggcaaggaaggatagtcagccttttaggcccataagaaattagatcatttttgtactaacttgtgaaataaagtaatagaccatgagaattgtattttcaaagcatttggtactaaatcccactgtaatcctcaagatatattccctcttttgccatttttctgctttgctggccttcacatgtttgtcacaaccattcacctaggaggatgagaa

SEQ ID NO: 29928 - DNA, 601 bp, Human
aatatcattttgtggcacactatggtgttttgtttggcacggagcctaaatctttctctctctttctttctgggtgtgtgtgcgtgtatgtgtgtgtaagagagggagagagatgcctagaaatatgggagggggacagagaaaagagatataagaattggaagagagggcaaggaaggatagtcagccttttaggcccataagaaattagatcatttttgtactaacttgtgaaataaagtaatagaccatgagaattgtattttcaaagcatttggtactaaatcccactgtaatcctyaagatatattccctcttttgccatttttctgctttgctggccttcacatgtttgtcacaaccattcacctaggaggatgagaaagtttatagccatcattcacttactaattcatgagctgtaacacacacacacacatacacacacacaattttagataaaatgtcgtatctttgtcacataaagtgtcatttctctatctcgacatttcaagtagtttgattagacggatttcacaccacttaaaatttaggaggagagaaatgtacagtatgtacaaattgttatttttaaaatcct

SEQ ID NO: 29929 - DNA, 601 bp, Human
tttcccaaaaaatttgaccatacctccttccctcccaaaggctgcaaagaaagatttttcttttcccaaaaacaatacagaaaggatcctgaagggtcaaattctttatcatcttgtctcttggcagtcaatacatatttaatggtgatgttggtatccgagtgcttgaggccagctccaggcaaccctctgaagtagacaaagcttgttcttactgtattccagcctcagctgtcaggacctcccttttctgttggagcaatctacccctcttccatgaaaccattttttttttttttttgcttcttcctgaggcttgtccattgggatctgttaggcacataggaattttctgattatccccacaaagtggcttaaaaatatatatgcaaatctggcagaccaacatatagtcatttttcatttcttacagtagttagtgttctacaaattcactgtgaacacgaaatttgtgaatcttgaatcattgcttctaggagaaatacagggttaggttactgtgagcttctggccacacttttatcaactgatcaatacttaaccttgttttatgtgagtttgtgttcaaagacaccttctt

SEQ ID NO: 29930 - DNA, 601 bp, Human
ttcccaaaaaatttgaccatacctccttccctcccaaaggctgcaaagaaagatttttcttttcccaaaaacaatacagaaaggatcctgaagggtcaaattctttatcatcttgtctcttggcagtcaatacatatttaatggtgatgttggtatccgagtgcttgaggccagctccaggcaaccctctgaagtagacaaagcttgttcttactgtattccagcctcagctgtcaggacctcccttttctgttggagcaatctacccctcttccatgaaaccattttttttttttttttrcttcttcctgaggcttgtccattgggatctgttaggcacataggaattttctgattatccccacaaagtggcttaaaaatatatatgcaaatctggcagaccaacatatagtcatttttcatttcttacagtagttagtgttctacaaattcactgtgaacacgaaatttgtgaatcttgaatcattgcttctaggagaaatacagggttaggttactgtgagcttctggccacacttttatcaactgatcaatacttaaccttgttttatgtgagtttgtgttcaaagacaccttcttt

SEQ ID NO: 29931 - DNA, 601 bp, Human
ctgaggtcgggagtttaagaccagcctggccaacatggtgaaaccctgtctctactaaaaaaaaaaaaaaaaaaaaaatacaaaaatcagccaggcatgttggcgtgcatctgtaatcctagctacttgggaggctgtgggaggagaattgcttgaacctgggaggcggaggttacagtttaacttcacgtctcccaaactgtgtatcaaggtgccctggagcattgccagatattttaaaatttcaagggtagcacatagacatctcttgaattctgtatgaaatatgttaatcaacgtrgcctcttaaggtgtctagttttattaattagaaatagttcagtatgattaaaaattggtaattctgtcttggttattcatttatttgctgaaagcttattagatgtccaaacttttggagttgccctaaatacaggatgaacaaagcagacaaaagtctctaccctcacaggatttctattcctctggtaggagacagagaataaacaaggaaatataatgtcaaacattatgccacagagaaaaccaaagtatcctaaaggggatagagcttctggtgggcatggatctcatgaaagga

SEQ ID NO: 29932 - DNA, 601 bp, Human
gggaggctgtgggaggagaattgcttgaacctgggaggcggaggttacagtttaacttcacgtctcccaaactgtgtatcaaggtgccctggagcattgccagatattttaaaatttcaagggtagcacatagacatctcttgaattctgtatgaaatatgttaatcaacgtagcctcttaaggtgtctagttttattaattagaaatagttcagtatgattaaaaattggtaattctgtcttggttattcatttatttgctgaaagcttattagatgtccaaacttttggagttgccctraatacaggatgaacaaagcagacaaaagtctctaccctcacaggatttctattcctctggtaggagacagagaataaacaaggaaatataatgtcaaacattatgccacagagaaaaccaaagtatcctaaaggggatagagcttctggtgggcatggatctcatgaaaggaggtacctgggtggcatttgagaagatactgggagaaggaagaagaaataagccctaacggtactcaggtggagcatgtttccggcggaggaaatgtcaagtgcaaaggttggagccaggaacttgacc

SEQ ID NO: 29933 - DNA, 601 bp, Human
tggtgagaacagaatgtatggggcaagagcagaagcaagatcagttaggaacctccagaataatccaggccaggccagacttgctggtcgccaatcactcctgactagggagttttttcattttgttgttgttgttgttttgtttttacctttggatctctaatttgattttctagtctgcagcccattccagtggtgttgagctctgttgggaaatcctacctcatgcatctctcaagctctcctgccaacctatattctcagccttctcccagtgaaattctcatacacatttgggccstttctttcaatggttcttattacattttatgaaaaatgagaaaatactgaaggattcagagtcatttcaccgggactcatttgtaaaatttactcaacaactcacatgtccaggtgaaatgactgaatccttcaatactttctcactttgtttctctatagaggctgttgcagaggaatagagcaccagcagcaggtgaacgggtcctgttttgcaactgacatgtggtatgaccctggtcaagccacatgatctccctgggcccctgtaatgggcacaagttaatctcatagactttta

SEQ ID NO: 29934 - DNA, 601 bp, Human
caatggttcttattacattttatgaaaaatgagaaaatactgaaggattcagagtcatttcaccgggactcatttgtaaaatttactcaacaactcacatgtccaggtgaaatgactgaatccttcaatactttctcactttgtttctctatagaggctgttgcagaggaatagagcaccagcagcaggtgaacgggtcctgttttgcaactgacatgtggtatgaccctggtcaagccacatgatctccctgggcccctgtaatgggcacaagttaatctcatagacttttaggagagamtctggagtctgaatacttggtgccattttacagatatgacccacttccataacaaaacataaaatagtggaaccacgaaactaggagtagactttaaatagtttctgtttattgaaaaaagccttcccaaagagcacatagaactttcaccctcagtctctatcctccagtacagcgaactgtttattttatttattcctttaccctgtaacactatctaatgatagaagcgtaatcttcctgggcccatttgcagaccctctgtaattttccatgtttcctttaattcatggaggtctt

SEQ ID NO: 29935 - DNA, 601 bp, Human
atggttcttattacattttatgaaaaatgagaaaatactgaaggattcagagtcatttcaccgggactcatttgtaaaatttactcaacaactcacatgtccaggtgaaatgactgaatccttcaatactttctcactttgtttctctatagaggctgttgcagaggaatagagcaccagcagcaggtgaacgggtcctgttttgcaactgacatgtggtatgaccctggtcaagccacatgatctccctgggcccctgtaatgggcacaagttaatctcatagacttttaggagagaatytggagtctgaatacttggtgccattttacagatatgacccacttccataacaaaacataaaatagtggaaccacgaaactaggagtagactttaaatagtttctgtttattgaaaaaagccttcccaaagagcacatagaactttcaccctcagtctctatcctccagtacagcgaactgtttattttatttattcctttaccctgtaacactatctaatgatagaagcgtaatcttcctgggcccatttgcagaccctctgtaattttccatgtttcctttaattcatggaggtctttg

SEQ ID NO: 29936 - DNA, 601 bp, Human
gaatagagcaccagcagcaggtgaacgggtcctgttttgcaactgacatgtggtatgaccctggtcaagccacatgatctccctgggcccctgtaatgggcacaagttaatctcatagacttttaggagagaatctggagtctgaatacttggtgccattttacagatatgacccacttccataacaaaacataaaatagtggaaccacgaaactaggagtagactttaaatagtttctgtttattgaaaaaagccttcccaaagagcacatagaactttcaccctcagtctctatcctccagtacagcgaactgtttattttatttattcctttaccctgtaacactatctaatgatagaagcgtaatcttcctgggcccatttgcagaccctctgtaattttccatgtttcctttaattcatggaggtctttgaccaactaaaaaatagcactcatagttttaaaaatgtgtaattcaaaaaagaatgccacgagtaggagacacactcacatgcaattagcaaactgcacatgcacagaactttttatatggatgggctggatgggtttgttgcgtgtttaaggtacatgtaaatagc

SEQ ID NO: 29937 - DNA, 601 bp, Human
ggtaagcacttaatgcacagttatctattattattgccattgaagatggaaaggtgttttgttcctgggcttatggattctttcttatcttttccttatcactgactttatagattggaaaggatcttgatctaactctactctttttaagcaattttataacttcagttcttgctaaatttgtaacgtgaataaactacaacaaaaactaataatgagaagtatgtttggagtcagacacacctgggtgtttagatctaacttctggttctttattaactaatttagggatatggggcamatggcttaacttctttgcaccttgtattacttacctctaaatagagaatgatccctaatgtcactgctcatctgagctaaattgataatacatatgtaaaagttatttaatcctttatgggtatgtggtaatcagtagcttcatttcataaactttgttgaatgaattgatttaaaaatcctaataataatgatgggccaggcacagtgactcatgcttgtaatcctagcaatttgggaggccaatgcgggcagatcacttcaggccaggagttccagaccagcctggccaacgtggtga

SEQ ID NO: 29938 - DNA, 601 bp, Human
gatgtgcgtagcaggacaagtgttcagactgaggatgaccagctcattgcagggcagagcgcacgggtgagtggacacctaagactttggcttggcacacagggaccgtgtttactaaaatggtttgagggtatttctaaactccagacacgtggtaccccagagattcatgggtcagaaatctgtgctctcatctgaggttgtttatagcaaatcacattttacacagtgaaaataaccaccactgctcctgattcctctaactcctctcttttgctatcactggaaacatagcaaccayatcacagcaagcttttatgtgtataattgattttgttgggtttgggtactagaattagatgatagactgataggggacactggaatactcaaattttgcattggcacagtcaccattgttcttcctgaagtctccaagcttgtcaacacaagaggcaatgacaaatgaggaatcagggcactactttgtttatagctgggctgttgctccatacaatggcctatgttctatgatatctaagaccgtatcttttgaaattggttcaaggccattagatagagaactttttctttcctcatg

SEQ ID NO: 29939 - DNA, 601 bp, Human
ctttttctttcctcatgatgcctgtctactcccatggtggtattcctagatctgtctgccatatgatagaaaaatagagacaaattagaaatattcaagtttaaggcaaggatcaggaagcaacagagagagtaccagctctgcctgacatttgagtactccatgatactgttcaccaatgcatttggtctaaagagcatcctaaatttggatcaatctgatttgctgtatcacccagagagtaggtgtacgtaatcaaggccggtggtaagagatgaaatctttagagactgcataggaygatgaaattttcctccccttaagggctcagtttccaaagagtaaaaacaatcagattatagtataactgagaattagatattctaattttctttgttaagttttatttaaataaaagataatgaatagaaagcaagaggttgagaaagagaaggtaatttaaaatagaaattgggaaacgccagaaagcccacactgccttaagaattatgaaagaaaaataatcagaggttaaaataaagaggacttgagggagatgtttagtcaagaaagactttgtgtctaaaacccagtttctctt

SEQ ID NO: 29940 - DNA, 601 bp, Human
ttaaataaaagataatgaatagaaagcaagaggttgagaaagagaaggtaatttaaaatagaaattgggaaacgccagaaagcccacactgccttaagaattatgaaagaaaaataatcagaggttaaaataaagaggacttgagggagatgtttagtcaagaaagactttgtgtctaaaacccagtttctcttatgtgctttatgccctgatattctcactcaacaatcaagtgacccaaaagatataaacaaacattaataggagggatgtgaaggttaaagaatattaaagacaaagsctttgatttcagacagatttggttttgaattataaagggcagcattagaaccatgctcaaagctacatgttgcttgatttttcagtttcagacctctctctaaaatgcgaataacagggttacctgataggattcttatgaagatttaattacttaatatttgtaaaataataggcacaatattagacattcagtaagtgctcgataaagatgaccgtgataattatcatcctttctaagagaaatcctttccgatcacatgatggtgggacaacagaaaagttggcatagagcccccta

SEQ ID NO: 29941 - DNA, 601 bp, Human
aacattaataggagggatgtgaaggttaaagaatattaaagacaaagcctttgatttcagacagatttggttttgaattataaagggcagcattagaaccatgctcaaagctacatgttgcttgatttttcagtttcagacctctctctaaaatgcgaataacagggttacctgataggattcttatgaagatttaattacttaatatttgtaaaataataggcacaatattagacattcagtaagtgctcgataaagatgaccgtgataattatcatcctttctaagagaaatcctttcygatcacatgatggtgggacaacagaaaagttggcatagagccccctatttcaaaaattccttgcagactctatttaatcccccctaaaatgttgaaaattggaaaggtcagtaacttgaaaatcttttgactctgtgttggcaaaacgtcagatgaattaaacagtcaattcatcttcagaattaagtaaaaccagcattgttatgtcactgacaaagggcaattttgagtaattcatccaaacatgaagcaattcaaagtcaatttaattgactaactgcaactcagtatacatacagc

SEQ ID NO: 29942 - DNA, 601 bp, Human
tgttggcaaaacgtcagatgaattaaacagtcaattcatcttcagaattaagtaaaaccagcattgttatgtcactgacaaagggcaattttgagtaattcatccaaacatgaagcaattcaaagtcaatttaattgactaactgcaactcagtatacatacagcctagtatccactgactagttttcttaaagacaaagacaggttgtacaactcatcttgctttataagcaccatcttgtcaaaatggcatgaacagtcccacttttacaaggaagaatagagtcgcaatatacttctrtttcattgggaacctaattctagtctcatttacattagacttcaagtcaatgatgatgggtggaaatacaatttggagactcctgtctttatcatctattatttcttcacactagtgtcttttctgagagtttttttcagcatgaattataaacagggtccaagatagtaagaacagagcactcctacaaattcagcacttgctcatttgactttgaggtctatcatgtggtctgtacgattaagttgcagcagacagcattacttactgagtcagcctattttagcctgtaattatatg

SEQ ID NO: 29943 - DNA, 601 bp, Human
tgatcttaccctttgatcctagacatgacataatataaactgtttctccacagtctggcatagttaaaataggttagtgacaattgctaggcacttaaccttggtgatacaatatattatttggagtcacacagacctgattttaaatatggacttagtgaagctgtgtgactttggggcaactttcttaacctctccacacttcatctcctcgtatgctaccacataaggtcgtagggagaattccatgataaaatgtatcacaggatttatcatataaatatgtaataattaagttggyggtaatggtgatgatgcttgtggcttgagctaatcattcattagaaggctgactaaataatttcacctaaaagagttggatcattcaggcaatcatgagagtttttacttgagttaatgggacaactacctcaattttccaattcacttcacagctagagactggtaagaatcaaaggacccactccttaactacttattatactgctttaaagtcaagtaagtagaaacaggcacattgagttttagtccctttaattgttatttataaacattcttgtacttgaaacttaatgttagc

SEQ ID NO: 29944 - DNA, 601 bp, Human
taggttagtgacaattgctaggcacttaaccttggtgatacaatatattatttggagtcacacagacctgattttaaatatggacttagtgaagctgtgtgactttggggcaactttcttaacctctccacacttcatctcctcgtatgctaccacataaggtcgtagggagaattccatgataaaatgtatcacaggatttatcatataaatatgtaataattaagttggtggtaatggtgatgatgcttgtggcttgagctaatcattcattagaaggctgactaaataatttcacctraaagagttggatcattcaggcaatcatgagagtttttacttgagttaatgggacaactacctcaattttccaattcacttcacagctagagactggtaagaatcaaaggacccactccttaactacttattatactgctttaaagtcaagtaagtagaaacaggcacattgagttttagtccctttaattgttatttataaacattcttgtacttgaaacttaatgttagcctcttgctctaggctaagaaatgaacacttgtcagtttggggacccatagacgttaaaaatcatttttt

SEQ ID NO: 29945 - DNA, 601 bp, Human
tcacacagacctgattttaaatatggacttagtgaagctgtgtgactttggggcaactttcttaacctctccacacttcatctcctcgtatgctaccacataaggtcgtagggagaattccatgataaaatgtatcacaggatttatcatataaatatgtaataattaagttggtggtaatggtgatgatgcttgtggcttgagctaatcattcattagaaggctgactaaataatttcacctaaaagagttggatcattcaggcaatcatgagagtttttacttgagttaatgggacaaytacctcaattttccaattcacttcacagctagagactggtaagaatcaaaggacccactccttaactacttattatactgctttaaagtcaagtaagtagaaacaggcacattgagttttagtccctttaattgttatttataaacattcttgtacttgaaacttaatgttagcctcttgctctaggctaagaaatgaacacttgtcagtttggggacccatagacgttaaaaatcatttttttctctggaaattggaagataattatatcaaaatctccttgagatttaaattgaagaa

SEQ ID NO: 29946 - DNA, 601 bp, Human
atatggacttagtgaagctgtgtgactttggggcaactttcttaacctctccacacttcatctcctcgtatgctaccacataaggtcgtagggagaattccatgataaaatgtatcacaggatttatcatataaatatgtaataattaagttggtggtaatggtgatgatgcttgtggcttgagctaatcattcattagaaggctgactaaataatttcacctaaaagagttggatcattcaggcaatcatgagagtttttacttgagttaatgggacaactacctcaattttccaattcrcttcacagctagagactggtaagaatcaaaggacccactccttaactacttattatactgctttaaagtcaagtaagtagaaacaggcacattgagttttagtccctttaattgttatttataaacattcttgtacttgaaacttaatgttagcctcttgctctaggctaagaaatgaacacttgtcagtttggggacccatagacgttaaaaatcatttttttctctggaaattggaagataattatatcaaaatctccttgagatttaaattgaagaatggattcagtgctatctgaa

SEQ ID NO: 29947 - DNA, 601 bp, Human
acacttcatctcctcgtatgctaccacataaggtcgtagggagaattccatgataaaatgtatcacaggatttatcatataaatatgtaataattaagttggtggtaatggtgatgatgcttgtggcttgagctaatcattcattagaaggctgactaaataatttcacctaaaagagttggatcattcaggcaatcatgagagtttttacttgagttaatgggacaactacctcaattttccaattcacttcacagctagagactggtaagaatcaaaggacccactccttaactactttttatactgctttaaagtcaagtaagtagaaacaggcacattgagttttagtccctttaattgttatttataaacattcttgtacttgaaacttaatgttagcctcttgctctaggctaagaaatgaacacttgtcagtttggggacccatagacgttaaaaatcatttttttctctggaaattggaagataattatatcaaaatctccttgagatttaaattgaagaatggattcagtgctatctgaatggttgtttccttttatcagtgattttcacttttagtgtaataggtatagtt

SEQ ID NO: 29948 - DNA, 601 bp, Human
ttcatctcctcgtatgctaccacataaggtcgtagggagaattccatgataaaatgtatcacaggatttatcatataaatatgtaataattaagttggtggtaatggtgatgatgcttgtggcttgagctaatcattcattagaaggctgactaaataatttcacctaaaagagttggatcattcaggcaatcatgagagtttttacttgagttaatgggacaactacctcaattttccaattcacttcacagctagagactggtaagaatcaaaggacccactccttaactacttattatactgctttaaagtcaagtaagtagaaacaggcacattgagttttagtccctttaattgttatttataaacattcttgtacttgaaacttaatgttagcctcttgctctaggctaagaaatgaacacttgtcagtttggggacccatagacgttaaaaatcatttttttctctggaaattggaagataattatatcaaaatctccttgagatttaaattgaagaatggattcagtgctatctgaatggttgtttccttttatcagtgattttcacttttagtgtaataggtatagtttata

SEQ ID NO: 29949 - DNA, 601 bp, Human
tcatctcctcgtatgctaccacataaggtcgtagggagaattccatgataaaatgtatcacaggatttatcatataaatatgtaataattaagttggtggtaatggtgatgatgcttgtggcttgagctaatcattcattagaaggctgactaaataatttcacctaaaagagttggatcattcaggcaatcatgagagtttttacttgagttaatgggacaactacctcaattttccaattcacttcacagctagagactggtaagaatcaaaggacccactccttaactacttattattctgctttaaagtcaagtaagtagaaacaggcacattgagttttagtccctttaattgttatttataaacattcttgtacttgaaacttaatgttagcctcttgctctaggctaagaaatgaacacttgtcagtttggggacccatagacgttaaaaatcatttttttctctggaaattggaagataattatatcaaaatctccttgagatttaaattgaagaatggattcagtgctatctgaatggttgtttccttttatcagtgattttcacttttagtgtaataggtatagtttataa

SEQ ID NO: 29950 - DNA, 601 bp, Human
atataaatatgtaataattaagttggtggtaatggtgatgatgcttgtggcttgagctaatcattcattagaaggctgactaaataatttcacctaaaagagttggatcattcaggcaatcatgagagtttttacttgagttaatgggacaactacctcaattttccaattcacttcacagctagagactggtaagaatcaaaggacccactccttaactacttattatactgctttaaagtcaagtaagtagaaacaggcacattgagttttagtccctttaattgttatttataaacaytcttgtacttgaaacttaatgttagcctcttgctctaggctaagaaatgaacacttgtcagtttggggacccatagacgttaaaaatcatttttttctctggaaattggaagataattatatcaaaatctccttgagatttaaattgaagaatggattcagtgctatctgaatggttgtttccttttatcagtgattttcacttttagtgtaataggtatagtttataacaatcaccgaaaaatggttggtggttcagaggaaaggctgggagggactctggggtagggggaaggaatcc

SEQ ID NO: 29951 - DNA, 601 bp, Human
tgcttgtggcttgagctaatcattcattagaaggctgactaaataatttcacctaaaagagttggatcattcaggcaatcatgagagtttttacttgagttaatgggacaactacctcaattttccaattcacttcacagctagagactggtaagaatcaaaggacccactccttaactacttattatactgctttaaagtcaagtaagtagaaacaggcacattgagttttagtccctttaattgttatttataaacattcttgtacttgaaacttaatgttagcctcttgctctaggctaagaaatgaacacttgtcagtttggggacccatagacgttaaaaatcatttttttctctggaaattggaagataattatatcaaaatctccttgagatttaaattgaagaatggattcagtgctatctgaatggttgtttccttttatcagtgattttcacttttagtgtaataggtatagtttataacaatcaccgaaaaatggttggtggttcagaggaaaggctgggagggactctggggtagggggaaggaatccttttggattaatatctctgataccactaatttggaacccca

SEQ ID NO: 29952 - DNA, 601 bp, Human
ctgtttatagataacctttttttaaattccagtttcagaaaaggtcaattatgaatttttaaaagcaagagcattttaagaatatttaggaagagacttcagctcattgatagctacataagcagaagcaaatggaaagatgctttcacccaagtcacacaccattaagtgtattatgcaggtcgagcacccctagagtcaaaataatatcttcctttgcaaacttgcattggaggggatagtttttcttcagaattgtgtccttagaatgtgtgtgtccgttctggcaacttctcttgarttatgttaatgcagtgagtggaaaaatgtttaagcagtcaaaagatgtttattaagcttctactctgggcaggatatggcagcctaaaccctagggaagcatataaagaagttagcagtagggcattaataggaattaattagagagcaaagcaaagcagttaatattcaagtgctaaattgtattatggagatgcaagtgctatagttgacagagaagtatacacttttcagtgcacaaattaaccttgtgttgggacaatgaaatgtgcattgcttttcatctggggattgaacattg

SEQ ID NO: 29953 - DNA, 601 bp, Human
tggagatgcaagtgctatagttgacagagaagtatacacttttcagtgcacaaattaaccttgtgttgggacaatgaaatgtgcattgcttttcatctggggattgaacattgagtctgggagtctgctggtagttttacggattctttttcagagaagcacctagcgaatgttttaaatgatgctggtttaggacctgtgaggtctaagtaaagcatgattcgctcttctgtatgaggaggacaataaaccaaaaacagcaataggtcatcagaaaggaatagttaaggaaaaaagtgcrtatataatttctgtaaatcaaacatatctcaaatatagtggaatagctgtcttgctatgaacacaacattgcaaatgtgagcttacaataaactcttgtatatcaagcaccttttcaaatacagtttttaaagctactttatctttcaagatatagtattttagatatcttaatagtattcatacaagtctggatttttaaatatggattaaaatttacacgtacacacgcatatccaaacatacatacacatgctatttaaagccacatacatgtatccatggaagtcagtagatgtgg

SEQ ID NO: 29954 - DNA, 601 bp, Human
accttttcaaatacagtttttaaagctactttatctttcaagatatagtattttagatatcttaatagtattcatacaagtctggatttttaaatatggattaaaatttacacgtacacacgcatatccaaacatacatacacatgctatttaaagccacatacatgtatccatggaagtcagtagatgtggctactagtaagaagcatctgggcagccacgggttcaaggatacctttagtcaaatcagacaccataggcaactcatgtctatggcatccaccaggatgcacagtgtggygagcagtgctagtgatatcagtgacccttgccccacttggttgaggaccccaggacagtgggtaagttgcatggccaggcacaactgatgatccagttgtgtagagtggttaagaatgatcttagttcaggtgggtttgaatcctattcctagagcctattgtgtgatattaggaattctatgaatttctctaggcctagatattattattaaaatggggatagtaatagtatcagaatgattaagtagattgttatttgacatacataagcctcagcacagtacccagtacttgtggat

SEQ ID NO: 29955 - DNA, 601 bp, Human
tactagtaagaagcatctgggcagccacgggttcaaggatacctttagtcaaatcagacaccataggcaactcatgtctatggcatccaccaggatgcacagtgtggcgagcagtgctagtgatatcagtgacccttgccccacttggttgaggaccccaggacagtgggtaagttgcatggccaggcacaactgatgatccagttgtgtagagtggttaagaatgatcttagttcaggtgggtttgaatcctattcctagagcctattgtgtgatattaggaattctatgaatttctctrggcctagatattattattaaaatggggatagtaatagtatcagaatgattaagtagattgttatttgacatacataagcctcagcacagtacccagtacttgtggatatacataaggaatcataacaatcttctatttgtagatagttgcatagaccccgagcccatccctttccctatagcaactaagaaatgagccagaggggtagttggaaaggcaaattaatggcagcagttataatataatgttaatgataattctatacatgcttactttcattttatttgaaaaaacacatat

SEQ ID NO: 29956 - DNA, 601 bp, Human
cagtgtggcgagcagtgctagtgatatcagtgacccttgccccacttggttgaggaccccaggacagtgggtaagttgcatggccaggcacaactgatgatccagttgtgtagagtggttaagaatgatcttagttcaggtgggtttgaatcctattcctagagcctattgtgtgatattaggaattctatgaatttctctaggcctagatattattattaaaatggggatagtaatagtatcagaatgattaagtagattgttatttgacatacataagcctcagcacagtacccagtayttgtggatatacataaggaatcataacaatcttctatttgtagatagttgcatagaccccgagcccatccctttccctatagcaactaagaaatgagccagaggggtagttggaaaggcaaattaatggcagcagttataatataatgttaatgataattctatacatgcttactttcattttatttgaaaaaacacatattatttaatttgctgcccaccatcaccttttgaggtaattatttactatgcccatattctatctgaagagatcaacgatagatccatgtaacagtgaagt

SEQ ID NO: 29957 - DNA, 601 bp, Human
ggccaggcacaactgatgatccagttgtgtagagtggttaagaatgatcttagttcaggtgggtttgaatcctattcctagagcctattgtgtgatattaggaattctatgaatttctctaggcctagatattattattaaaatggggatagtaatagtatcagaatgattaagtagattgttatttgacatacataagcctcagcacagtacccagtacttgtggatatacataaggaatcataacaatcttctatttgtagatagttgcatagaccccgagcccatccctttccctatrgcaactaagaaatgagccagaggggtagttggaaaggcaaattaatggcagcagttataatataatgttaatgataattctatacatgcttactttcattttatttgaaaaaacacatattatttaatttgctgcccaccatcaccttttgaggtaattatttactatgcccatattctatctgaagagatcaacgatagatccatgtaacagtgaagtcttaacccatgtcagctacagagcccctgttgaacccagttcttctgagctcacattgcctgatacctctattagacctta

SEQ ID NO: 29958 - DNA, 601 bp, Human
tcaggtgggtttgaatcctattcctagagcctattgtgtgatattaggaattctatgaatttctctaggcctagatattattattaaaatggggatagtaatagtatcagaatgattaagtagattgttatttgacatacataagcctcagcacagtacccagtacttgtggatatacataaggaatcataacaatcttctatttgtagatagttgcatagaccccgagcccatccctttccctatagcaactaagaaatgagccagaggggtagttggaaaggcaaattaatggcagcarttataatataatgttaatgataattctatacatgcttactttcattttatttgaaaaaacacatattatttaatttgctgcccaccatcaccttttgaggtaattatttactatgcccatattctatctgaagagatcaacgatagatccatgtaacagtgaagtcttaacccatgtcagctacagagcccctgttgaacccagttcttctgagctcacattgcctgatacctctattagaccttagttatagtccttccaaatttattcgctcacacagggagaagatttataatttag

SEQ ID NO: 29959 - DNA, 601 bp, Human
gtagttggaaaggcaaattaatggcagcagttataatataatgttaatgataattctatacatgcttactttcattttatttgaaaaaacacatattatttaatttgctgcccaccatcaccttttgaggtaattatttactatgcccatattctatctgaagagatcaacgatagatccatgtaacagtgaagtcttaacccatgtcagctacagagcccctgttgaacccagttcttctgagctcacattgcctgatacctctattagaccttagttatagtccttccaaatttattcrctcacacagggagaagatttataatttaggaagcatttttcttgtgttattttacttgttcattgcagaaactgcagtcccccaaactgtaccctcttggtctgtcttatggaaaatatgtgcatcctagaagcaggggaattggaagtacctattcacattcccctgtctgtgaagcaggttgcatacagttttgggaggatgtgatacggtgatgacagacatttcattcggggcttgctacctaaatggtgtttaacaaatatagttgattctcattactcctgatagttatgttct

SEQ ID NO: 29960 - DNA, 601 bp, Human
cactttatatttttgattcattaacattgaactcacagccaataactctgtaactcatgcctgattgaagcttaactaacacatgtgttttctccataaggcacatgcccgccttctcgtgctcggggacactagacgcacttcagcaccatgcttggagccattttaaacagcaaagttactaacaaaaagcacaaagatatgaaaaatgtagcattaaatagactgcaaaaagtacacttgtttacagtacgagagctgaaaaaggaaggcagagcattgccttgttcaacctcatctrggaatgtgcatgtcacgcaactcaatttttttgctgctctgcccacatttgcaaatgaccacgaaaatgctacaagccttgattttggggttacaagtatattttagagagtaggcaaattggcaaatgaagaatccatgaataagaagactgcagttctcctttttctacattttcttacctagcagttattgaaaatgaacccatgcttcctaattttatcctttatcccattataacttttctgcctacgtactcaaaggctttaacaaggagccgcaggcatgccaccaccctaaa

SEQ ID NO: 29961 - DNA, 601 bp, Human
ttgtatatgttgtttcagaggcaaaggcccattgaaaaatacatctgatgtcattaatgctgccaagaaaattgccgaagcaggttctcgaatggacaaattagctcgtgctgtggctgatcaggtaatagaagagggaagggtgggcacatgctgagtggagtcactaattagcacttgggttttgtaactagttttatgcaccctataaaatgcctctgaagaatgaatcagaggggagaatcactgatattttacacactggtatctgcctctcctgacactgtgctagtggcaaacrtagatttagctcaggagagaatgctaaggcttctgaccaaaattccttgagaaagaagaacatactacttaggagacatcagcccctgaagagtcacggattgtcccagccttccccattcagaaaggcaactatactgcataatgaaggggggaaaagcaggtttttaaattttcattgttaggctcttggtttaaatatattttcagagattcctacctaatgccctcttttgtttacttcatggtgcttatcacatttaaaaaatatatatttattattgctttacttttattttct

SEQ ID NO: 29962 - DNA, 601 bp, Human
ctgtggctgatcaggtaatagaagagggaagggtgggcacatgctgagtggagtcactaattagcacttgggttttgtaactagttttatgcaccctataaaatgcctctgaagaatgaatcagaggggagaatcactgatattttacacactggtatctgcctctcctgacactgtgctagtggcaaacgtagatttagctcaggagagaatgctaaggcttctgaccaaaattccttgagaaagaagaacatactacttaggagacatcagcccctgaagagtcacggattgtcccagscttccccattcagaaaggcaactatactgcataatgaaggggggaaaagcaggtttttaaattttcattgttaggctcttggtttaaatatattttcagagattcctacctaatgccctcttttgtttacttcatggtgcttatcacatttaaaaaatatatatttattattgctttacttttattttctgttgcccccaggaaatttaggttgcacattttaactgcctgacagaatgaataaaggagagaaaagagcaacctgccttgtggtcagggaactgaattagcagagcttta

SEQ ID NO: 29963 - DNA, 601 bp, Human
tacttcatggtgcttatcacatttaaaaaatatatatttattattgctttacttttattttctgttgcccccaggaaatttaggttgcacattttaactgcctgacagaatgaataaaggagagaaaagagcaacctgccttgtggtcagggaactgaattagcagagctttagggatgtgatgggtcatgatttgatggtttctttaaaaagttgtcgcggactctaccaggagtagaatggaaactgggggtaggacagtcaggggcatttggagatcaaagggcagaaacaggttgcrgaatctgggagaacatcatgtttttaaatgtagaaataagaaactagaacttcaccttttcttatttaatatggctctcactctaatgatattcttcataataacttatgctccaccataaacgggattattccacatgatcaagaaccttcagatttcagctttattctaacccagactcagaagcatcagagataaatgaaattctcagagtatctcttaatgctttcaaaccaaactaggatatacattaaaagagttctcaccttgaatgtttatttccatacttttcgttttatt

SEQ ID NO: 29964 - DNA, 601 bp, Human
ctctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatmatgtttttttcccccctttaatgaaaacaataaacatctatttgagacaattaaaatccttctgggggcactggaagcacaatacggtgaccaatcttgctttcatttttttttcttttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttgacatct

SEQ ID NO: 29965 - DNA, 601 bp, Human
aaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttcttttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttgacatctcaagtatgttttcttttttaattttttaagtatgtacttaataaagattagagcatcatcttcctgaaaattcattaaaaaaatgcattatgttttggtttttagagattagtaataaaat

SEQ ID NO: 29966 - DNA, 601 bp, Human
tggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccrtgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggc

SEQ ID NO: 29967 - DNA, 601 bp, Human
cccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaaytcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatgggga

SEQ ID NO: 29968 - DNA, 601 bp, Human
gggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcayacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgccc

SEQ ID NO: 29969 - DNA, 601 bp, Human
gggcaatcaaaaccagggaatggcaggtggcactgaggcccacacactggcaggacagcaagaatgctcactggctctgccccatgccgtgagacacaggaacatgcgactcccacagaactgacttggatgctgcggggtttcttctgctacatctgtatttgtgactatttaaattgggggcaggacagaaccaaatccaggatcttaagttcagatgtgccaccacagctgtgagccaggcctgggacgctggctgggaaggaaatgcacagggcgcctacgagacagagccaggttyggcctgtccagtctcaggagggactccctattttccagagggatcaatgggcttctgtgccaactgtgggtgtggccagggtggggtccacatgggcaggctggagccacacttctctggctggcaggttggctggctgcggtcacagctccaccaacagtgggctgtccccaacactggcactttcttcaggcatcctctgataagaaagtgaatgttctgagaacagcagccctatggacggcaatactgtggggttcactgcgggggtttgctgatgggagttcactggtgggaggt

SEQ ID NO: 29970 - DNA, 601 bp, Human
ggtccctgtaggaagcatggcggttgtatatgaggaagctccaggccagcgcccaccagtgtcgctggaggaagcatggggtttgtgggtgaggaagccccataccagcgtccctgcaggaagcatggcagttgtatgtgaggaagccccaggccagcacccaccagcttccctgcaggaagcatggggtttgtgggtgaggaagctccaggccagcgcccaccagcgtccctgcaggaagcatggcagttgtatgtgaggaagcccaggccagcacccaccagcgtccctgcagggcagrcgtggactgtgaatggataaaggaaggtggaagtctgtcccttgtgggtgttagggggcctgggcaatcaaaaccagggaatggcaggtggcactgaggcccacacactggcaggacagcaagaatgctcactggctctgccccatgccgtgagacacaggaacatgcgactcccacagaactgacttggatgctgcggggtttcttctgctacatctgtatttgtgactatttaaattgggggcaggacagaaccaaatccaggatcttaagttcagatgtgccaccacagctgtgagc

SEQ ID NO: 29971 - DNA, 601 bp, Human
ccaccagcgttcctacaggaagcatggtgtttgtgggtgaggaagccccagaccagcgcccaccagcatccctgcaggaagcatggcggttgtatatgaggaagctccaggccagagcccaccagcgtcgctgtaggaagcatggggtttgtatgtgtggaaactacaggccagcagccaccagcatccctgtaggaagcatggtgtttgtgggtgaggaagccccaggccaacgcccaccagcgtccctgcaagaagcgtggggtttgtatgtgaggaagccccaggccagcacccatcrgcgtccctgcaggaagcatggtgtttgtgggtgaggaagccccagaccagtgcccaccagcgtccctgcaggaagcatggggtttgtatgtgagtaagccgaaggccagcagcaaccagcctccctgcaggaagcatggggtttgtatgtgaggaagccccaggccagcgtccaccagggtccctgtaggaagcatggcggttgtatatgaggaagctccaggccagcgcccaccagtgtcgctggaggaagcatggggtttgtgggtgaggaagccccataccagcgtccctgcaggaa

SEQ ID NO: 29972 - DNA, 601 bp, Human
gaaggatggcggttgtataagaggaagctccaggccagcacccaccagcgttcctacaggaagcatggtgtttgtgggtgaggaagccccagaccagcgcccaccagcatccctgcaggaagcatggcggttgtatatgaggaagctccaggccagagcccaccagcgtcgctgtaggaagcatggggtttgtatgtgtggaaactacaggccagcagccaccagcatccctgtaggaagcatggtgtttgtgggtgaggaagccccaggccaacgcccaccagcgtccctgcaagaagcrtggggtttgtatgtgaggaagccccaggccagcacccatcagcgtccctgcaggaagcatggtgtttgtgggtgaggaagccccagaccagtgcccaccagcgtccctgcaggaagcatggggtttgtatgtgagtaagccgaaggccagcagcaaccagcctccctgcaggaagcatggggtttgtatgtgaggaagccccaggccagcgtccaccagggtccctgtaggaagcatggcggttgtatatgaggaagctccaggccagcgcccaccagtgtcgctggaggaagcatgggg

SEQ ID NO: 29973 - DNA, 601 bp, Human
tggatgtgctgggttcttggggaaggatgcttgtccatggaggcatgcggcttctggtgagccacctgcgcagccgccggggggaaatctttgtcaccctgtcaggaaacacggaaagctcaggttaatcaataggaagcatggggtttgtgggtgaggaagccccaggccagtgcccaccagcgtccctgcggaaggatagcaattgtgtgtgaggaagcctcaggccagcatccaccagcgtccctgtaggaagcatggggtttgtatgtgaggaagccccaggccagggcccaccagcgcccctgcaggaagcatggggtttgtatgtgaggaagccccaggccagcgcccaccagcgtccctgcaggaagcatggcggttgtatgtgaggaacgtccaggccagcgcccatcaacgtccctgcaggaagcatggtgtttgtgggtgaggaacccccaggccagcacccaccagtgtccctgcaggaagcatggtgtttgtgggtgaggaacccccaggccagcacccaccagtgtccctgcaggaagcatggtgtttgtgggtgaggaagccccaggccagcgcccaccagcgtccc

SEQ ID NO: 29974 - DNA, 601 bp, Human
cgtggctgctggatgtgctgggttcttggggaaggatgcttgtccatggaggcatgcggcttctggtgagccacctgcgcagccgccggggggaaatctttgtcaccctgtcaggaaacacggaaagctcaggttaatcaataggaagcatggggtttgtgggtgaggaagccccaggccagtgcccaccagcgtccctgcggaaggatagcaattgtgtgtgaggaagcctcaggccagcatccaccagcgtccctgtaggaagcatggggtttgtatgtgaggaagccccaggccagggcccaccagcgcccctgcaggaagcatggggtttgtatgtgaggaagccccaggccagcgcccaccagcgtccctgcaggaagcatggcggttgtatgtgaggaacgtccaggccagcgcccatcaacgtccctgcaggaagcatggtgtttgtgggtgaggaacccccaggccagcacccaccagtgtccctgcaggaagcatggtgtttgtgggtgaggaacccccaggccagcacccaccagtgtccctgcaggaagcatggtgtttgtgggtgaggaagccccaggccagcgcccac

SEQ ID NO: 29975 - DNA, 601 bp, Human
agtggataggtttttctagcacaaatggaatgtggtgtctcatgtccctagggagacaaagggcaggtttcttatctggtctttccaagctttcaactctctggctcaagtgtcccagaatgaactagaagtctattcctccaccctggtccgtggtcacttccagaactctgaagtggctcaggaggtgactcctgaaaggcagcccttgcttgatctcctggtggagcctgtctgggctgaggcgatgctgggcttgccgtgccgagatctcatgccagaagtcctccctcggagctayctgtctccagcctcattctttggcatgttgactcctggaattgaggggctatttctaagatgcatgctttttcggcttttctcatgggtgcctcatcagcctgcacaggatcccccatctcacgagagagggaaatttggcattgctgttccctgcctctaaggtcctttatgaggggccgcccaaactcattcccttagttcttactctcccacaggtgttgagattttattggcccatactaaaaagcatgcaatgactgaggttttctcctaaccttaatctcatcttctcaaatgt

SEQ ID NO: 29976 - DNA, 601 bp, Human
tttatttactgtatttagtgcacttcttcatctgtgtgacgtttagaagagtccatgtgttttagcaacttgtcttccttaagagcagtaacttgtggttaaccatactttctgtttaactgaggcttgactatcttattttaactttgttgtttaaaaatgcgaacaaactattttctaaagggtattagtccacttacctacctgaaaatggtgatgtaaaacaatgtgcctcagatgcttagaggccttccaaatctatatttaattttgggggcacctcagaggtatattcctgtgrttaaaagcatataatattggattcatcgtaattgacctgaagacacatacaataggaagaattggatttttttttggtttgtttgtttctctggattcctggtagagttcatatcctggccaagtttgattctattttcaaagagtaataagaaaacaaattctagcaggttctagttagttggattctggttaattttattattataaaaccaacttattttattattattgtttattattattaaagtttcctgctaatgtacatttacaggttgtacatggagaaagctaccaaaat

SEQ ID NO: 29977 - DNA, 601 bp, Human
gtgatgtaaaacaatgtgcctcagatgcttagaggccttccaaatctatatttaattttgggggcacctcagaggtatattcctgtgattaaaagcatataatattggattcatcgtaattgacctgaagacacatacaataggaagaattggatttttttttggtttgtttgtttctctggattcctggtagagttcatatcctggccaagtttgattctattttcaaagagtaataagaaaacaaattctagcaggttctagttagttggattctggttaattttattattataaaacmaacttattttattattattgtttattattattaaagtttcctgctaatgtacatttacaggttgtacatggagaaagctaccaaaatattagagtttcttaaattgttggttttgagaatatgggctagaaaagtgcctaacacattgcatgttcataaatatttactgactgctaatgaatgaatgtattgttcagttgtgttcttgaagataacaatactaagacaaataaagcaaattaatatgatgaattgttttccaaaagaaaaaagagtctatgacttttcaaacctttattt

SEQ ID NO: 29978 - DNA, 601 bp, Human
agggaaaacttccccctcaccctctgaaggtttgctgaaaatcaactgacaaaatatagattaataggagaaaaggaatacaaaattatttttatgtgacacaggagccttcagaacgaagacctaaagatacaggagaaactgtccatctttatgcttatgtccaacaaaacatgggcagccatgtagaaatatgattggacaaaaaggttttgaccttatactagtagaccaagtggggtggcccagcaaagcctgtccagattcttcttggcctctccgtgcagcatttcttccttcytgatatgggacaggaccttctctgcaatgcgggtcttatgacatacaattaaactaggggggtcagagaatttctttaaggccagttgttacacagaaagacagggggacttagggtaatattttcaggttttattgctggctttggggaaaagaggttctggtttctataacctgcctttgggaaagagggattctagtttctatggttagtctcaggggagaatgaggggccagagataggagggcaggggaaggtcagagagaagcttttgcttctgaggctgcttctgaggccttc

SEQ ID NO: 29979 - DNA, 601 bp, Human
ggaagttcatcagacaagtatgctagggcagctaccagggcttactagtgcagggtaaattgcgttccttaaaccatttcaataaatttttactttagcatctagtacttctatttttaaatacaaaacaaagtgttttccaaagcaacagctcttgaagtgtgaaatgaagttaccctccagaaaaatagtttgatttggcgtgtttctctcagcatgatttacaagtgtatcccaaacctgtaatcttccccaaatccttcagtactgtgaatgacagcaaaaataatttagcataatyatgtataatgtatgactaaacgtgtcacagtagatattaagagctttctgaagttgtaatatgaagcctactctagcgcatctcttgcagatcacaaaaaaagcaaaaaaaaatctattttgtgtagacattattatgcagtcataaatgtgacttagaagccattgtgtgtgtgtgtgtgtatgtgtatgtgtgtgtttgtgtgtgtgtgaaaacaaatgcccaccacctatcactggtgtcaataagtgtagttttttagggagaatacatttgctagggtgctctgccataccaagc

SEQ ID NO: 29980 - DNA, 601 bp, Human
taaaccatttcaataaatttttactttagcatctagtacttctatttttaaatacaaaacaaagtgttttccaaagcaacagctcttgaagtgtgaaatgaagttaccctccagaaaaatagtttgatttggcgtgtttctctcagcatgatttacaagtgtatcccaaacctgtaatcttccccaaatccttcagtactgtgaatgacagcaaaaataatttagcataattatgtataatgtatgactaaacgtgtcacagtagatattaagagctttctgaagttgtaatatgaagccyactctagcgcatctcttgcagatcacaaaaaaagcaaaaaaaaatctattttgtgtagacattattatgcagtcataaatgtgacttagaagccattgtgtgtgtgtgtgtgtatgtgtatgtgtgtgtttgtgtgtgtgtgaaaacaaatgcccaccacctatcactggtgtcaataagtgtagttttttagggagaatacatttgctagggtgctctgccataccaagctgcataattattgtaaaagggaatggatagaaatttctatattcctctttctttactttttcgtcaatt

SEQ ID NO: 29981 - DNA, 601 bp, Human
agttataatctatacaccacatacttcactaatttgaagtgtatagctcagtggttttcagtatgttcacagagttgtgcaaccttcactacaatacatggaacagtttcatcacctccaaaagaaatcctgtacccattagctgtcacccctcaacctcccatctgcacaagctctgggcaaccactagtctactttttgtctctgtagatttgcctattgtggacatttcatgtaaatagaatcattccaatgtggcctttttatctggcttctttcacttagcatagtgttctcaagyttcctctactctgcagcacatgtcagtacttcattcctctttatggttgaataatattctgttttatagatacagtaaattttatttatccattcatcagttcatggacatttggatgaatttttagtaggaagaaactgttaaaaagttgaagctactttattcctttaacatggagagaaacatctatgtccttcattccaggtagaggtatcacacccaactatgaagatcagcatcctgctcatgttcctttggggattatcctgtgctctcccagtaagtattagggtagggata

SEQ ID NO: 29982 - DNA, 601 bp, Human
aacctcccatctgcacaagctctgggcaaccactagtctactttttgtctctgtagatttgcctattgtggacatttcatgtaaatagaatcattccaatgtggcctttttatctggcttctttcacttagcatagtgttctcaagtttcctctactctgcagcacatgtcagtacttcattcctctttatggttgaataatattctgttttatagatacagtaaattttatttatccattcatcagttcatggacatttggatgaatttttagtaggaagaaactgttaaaaagttgaarctactttattcctttaacatggagagaaacatctatgtccttcattccaggtagaggtatcacacccaactatgaagatcagcatcctgctcatgttcctttggggattatcctgtgctctcccagtaagtattagggtagggatatatgaaaaaaccctttcatacttaaaactccacaattttgattggctatgaaccaagatggctgtgtatgttccagtccagtaaaaatagtagtttcttagcatgctgttttcttaagaaatatcattcaaggtgttttttattctgttcagtt

SEQ ID NO: 29983 - DNA, 601 bp, Human
gctaagccagactctttagggataggaaacagaaatcagtgttttaacaaggcctcccagtgattctgatgcagcctaaaatttgactatccctactcctatgtatgaaatgtgttaataactattgctttagaaatttctctttggatttaccatgtgtactaaattttctaggtaaccaggtatcaaaataatgaatctgaggattctgaagaatggaaggtgagtagaaatatgactttttgaaatattttaattttaatttattatgagtataaccaaattgatttcattgcaaatrttgaaactgctaatgacttcatcagcatattaataagctaagctatagagttcatagaagaaaatactgctgtgattccaacttagtagtatactctggcaaggaagcatattttctgttagctttcttcttataatggatgtgtataatagtaccaggggatgcatgacaatgaatcaagagtcttcaggagagattatgacttgaaatctgttttaacaagagttatctggtgggcaagaggtcaagtcctggaaggtgaaaaaagaaagaagaatgagaggacactagagtctctgg

SEQ ID NO: 29984 - DNA, 601 bp, Human
aaatttctctttggatttaccatgtgtactaaattttctaggtaaccaggtatcaaaataatgaatctgaggattctgaagaatggaaggtgagtagaaatatgactttttgaaatattttaattttaatttattatgagtataaccaaattgatttcattgcaaatgttgaaactgctaatgacttcatcagcatattaataagctaagctatagagttcatagaagaaaatactgctgtgattccaacttagtagtatactctggcaaggaagcatattttctgttagctttcttcttrtaatggatgtgtataatagtaccaggggatgcatgacaatgaatcaagagtcttcaggagagattatgacttgaaatctgttttaacaagagttatctggtgggcaagaggtcaagtcctggaaggtgaaaaaagaaagaagaatgagaggacactagagtctctggaatgagagctaatgttgctagcatgttattatattgagagttactaactctcaataactcaagaatcattgccaggcacagttctgagtgttttacatatattaactttcttaattttcacacctctgtgaat

SEQ ID NO: 29985 - DNA, 601 bp, Human
accaggtatcaaaataatgaatctgaggattctgaagaatggaaggtgagtagaaatatgactttttgaaatattttaattttaatttattatgagtataaccaaattgatttcattgcaaatgttgaaactgctaatgacttcatcagcatattaataagctaagctatagagttcatagaagaaaatactgctgtgattccaacttagtagtatactctggcaaggaagcatattttctgttagctttcttcttataatggatgtgtataatagtaccaggggatgcatgacaatgaaycaagagtcttcaggagagattatgacttgaaatctgttttaacaagagttatctggtgggcaagaggtcaagtcctggaaggtgaaaaaagaaagaagaatgagaggacactagagtctctggaatgagagctaatgttgctagcatgttattatattgagagttactaactctcaataactcaagaatcattgccaggcacagttctgagtgttttacatatattaactttcttaattttcacacctctgtgaattaggtattatgttttattctcactttacagatgagaaaactgat

SEQ ID NO: 29986 - DNA, 601 bp, Human
agatgagaaaactgatcacagagagtaattcaatcgtctaggttacatggtcaattagtgttagagccagactttgatattacgtcactctagctccagaatccacattcttaaccagtgtgtcatatccctctcaggaaggagccaggtctaagaggtcagaaaattctcaagattggcactaagggttaaaatcttatgcgaaatcagagcattttgttcactactgtgtttcctactggcttttacatatgataaagcttggccccaatgcttttggtggtggccagataatgtcagygacctgaggtggggtcctgtccatgcctgagtctggaatagactttgcagtatttattatgaactttcttcagagaaatccataggctggttaatttaaaagcagacactctagatcctctctctcatttaaccagagacgcacaaacatgccctgttctcaagtctagccttggcatgagaaaaataacaatgtcttgctcccttccacccattaattccaaatgataattgactggagcacagcctgccattgtgcctgcctgcagtgttgcaggccaaagacagcgtgattatagct

SEQ ID NO: 29987 - DNA, 601 bp, Human
aaggggaagaagtgatggggaggggtaccagaagttgctaaggcattcttatagtgcttatgagactaaagatagtgaaataaattagaggtatgactagttaaatttctgatttagcatttgtttttaataccagggcttttacatgactcgagaagggtttcatggctttctcaattcagttttgtttactattaaattttataaggtggatgttatcaaatggattttttctttagtttatatcatgttgaataaatagttttcgagatacttccataggcattagctggtttcatcytcataactaccttgtggggtaagcacagtgggtgttaatttccttaatttatgaataagaaactggtggtcagacacgtgaagtgaattgcccaccttcacctagagtaaccaaccatctcggtttacctggaacttaggggtttcctggaacacatgactttcagtgctaacaccaagatgattggttttcagggctaaaaccaaaaccagtgagttaattgagacttaaatctggattctgagtttcaatgctgcttttcctgtgttacgtttcctctaggttgtatgaacggccagg

SEQ ID NO: 29988 - DNA, 601 bp, Human
gggtaccagaagttgctaaggcattcttatagtgcttatgagactaaagatagtgaaataaattagaggtatgactagttaaatttctgatttagcatttgtttttaataccagggcttttacatgactcgagaagggtttcatggctttctcaattcagttttgtttactattaaattttataaggtggatgttatcaaatggattttttctttagtttatatcatgttgaataaatagttttcgagatacttccataggcattagctggtttcatcttcataactaccttgtggggtargcacagtgggtgttaatttccttaatttatgaataagaaactggtggtcagacacgtgaagtgaattgcccaccttcacctagagtaaccaaccatctcggtttacctggaacttaggggtttcctggaacacatgactttcagtgctaacaccaagatgattggttttcagggctaaaaccaaaaccagtgagttaattgagacttaaatctggattctgagtttcaatgctgcttttcctgtgttacgtttcctctaggttgtatgaacggccaggttcaaaaaagcatatttatttc

SEQ ID NO: 29989 - DNA, 601 bp, Human
aagttgctaaggcattcttatagtgcttatgagactaaagatagtgaaataaattagaggtatgactagttaaatttctgatttagcatttgtttttaataccagggcttttacatgactcgagaagggtttcatggctttctcaattcagttttgtttactattaaattttataaggtggatgttatcaaatggattttttctttagtttatatcatgttgaataaatagttttcgagatacttccataggcattagctggtttcatcttcataactaccttgtggggtaagcacagtgrgtgttaatttccttaatttatgaataagaaactggtggtcagacacgtgaagtgaattgcccaccttcacctagagtaaccaaccatctcggtttacctggaacttaggggtttcctggaacacatgactttcagtgctaacaccaagatgattggttttcagggctaaaaccaaaaccagtgagttaattgagacttaaatctggattctgagtttcaatgctgcttttcctgtgttacgtttcctctaggttgtatgaacggccaggttcaaaaaagcatatttatttctgtaaatga

SEQ ID NO: 29990 - DNA, 601 bp, Human
tttaagatcactcaatatttttaaaaactctgtttcacaccaaacactttaatgcatgagcattataaaccaactctaattcacaaacaattacctaagaggtttttttgtgtgtgtgtttgtttgtttgagacggagtctcgctctgtcgccaggctggagtgcagtggctcgatctcggctcactgcaacctctgccccccaggttcaagtgattctcctgcctcagcctcccaagtaactgggactacaggtttgtggcaccacagccagctaatttttttttttttttttttttttwtttttttttttgagacggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtattttttagtaaagacggggtttcaccgtgttagccaggatggtctcgatctcctgacctcgtgatccgcccgcctcggcctcccaaagtgctgggattacaggcgtgagccaccgcgcccggcctgctaatt

SEQ ID NO: 29991 - DNA, 601 bp, Human
ggtgtcatcatttcacagaggtttaaatactgtggagtgacaccagaacacagccaaagaggctagaagcaagaaaggatctgcatgataactttgcagctgagatagttcctaattcatcaacgtaacaaacaaagctattgggtgtccatgatataccaggcactatgctaggtgttgagaatgtaaagcaggttaagacttgtttcttgctcctgaggagcgtatagaaggacccacaaagctacagagttaaagagggatatgtataagagaaacaagaattgttacaacccagtayggtgagtgccaagacagagagctatgaacacgatatctatctgggaacactgagaagggtgaccaatgcgttggagaacgagggagggcttcatagcagaagacattggagttggaaggttgcatagggtttcctcattggagaccggggaattctattcttgggataaataatagtaaattctataggattcaatacttagtttgcaaaagcactttgaaattatggcacagtgagttgttttggataagaaaatctttttctcccaattaatttaccaattcatcatttttttttttt

SEQ ID NO: 29992 - DNA, 601 bp, Human
atgatataccaggcactatgctaggtgttgagaatgtaaagcaggttaagacttgtttcttgctcctgaggagcgtatagaaggacccacaaagctacagagttaaagagggatatgtataagagaaacaagaattgttacaacccagtatggtgagtgccaagacagagagctatgaacacgatatctatctgggaacactgagaagggtgaccaatgcgttggagaacgagggagggcttcatagcagaagacattggagttggaaggttgcatagggtttcctcattggagaccgggraattctattcttgggataaataatagtaaattctataggattcaatacttagtttgcaaaagcactttgaaattatggcacagtgagttgttttggataagaaaatctttttctcccaattaatttaccaattcatcattttttttttttgtagaactcccataaacatcaccttactaatcactggtgatgataagaaggattgggtcaggaagagtgggagaaagaaattcctctttacgtagatactttttagctttattttttctaaaatcagtttgcgtgcaatgctagaaaaaa

SEQ ID NO: 29993 - DNA, 601 bp, Human
tatcccctattttcctttcaagccagacctggcagtcctgggctgatttgcaggcatcttctgcagactcctgtttctctgctgagtacccccagcaccacatgagcagggaaccactctggtctgctcagtctagagtgggtcatgagctccaacccttgagcaaattcatggaaacctgctgcgcaaaccttagggtgtttgcatagccacgcctaccccgctgcaccctgcaagctccccagtgaacagggaaggctttctttcccccatcattatcaacccaggaaggtcaggggcratgtctgaggttgctttcaaatgcaccttgatatcttcttaaaacaagtgagacgctgaacattcagagtaggaattttgtctttctcaaggtgaagtctcagagtttccggtcagcatataacataagcaacgtataagctgctttacaaaagggagggagggaggagggagaagcatgcatagcaatgaacccaactcacctgagcaaaatataacttcatttcctttcccagaaactcagtcttatgcagctggagcctggcatctgctgcggagaaggggttgctgaagtttattc

SEQ ID NO: 29994 - DNA, 601 bp, Human
agaaatgctgaccagtgatgagagggctgtccatagagctcttacatctcaagctgcgcggtgtaggttttctctgcacttccagattgccctccccaagttttcacaatgaatatgcattgttttacaaacagaaaaggtcagaggagtactaagtaattatttgcataaaatcttatcccgtgcagaaaggagtgtactcacacaggaaggcctaggcacccaaggtcaaagctcagcctgtgcctcccagggcaaaaaggtcaggggtggggcggggatcccaaatgctttatttatwcttgaagggcccagcaagttcgctgtcctcactttgaggaagaaaagacactttggctctctggcgtggtgtcagatgagcttcctcccactgggggaggcctttggacagggtcctctcccatcccagcaaggtatgtgtgtatgtgtgtgtgtggtgggggcgggttgggggggtgctcagagcctgagggggacttgctttactgaggagctggctgcattctagaagctcctctcttcttccctgacaatctgtcagcccctaaggacatcaaatggaactctgggagctgccttg

SEQ ID NO: 29995 - DNA, 601 bp, Human
atcatagtttatgactggggtcgcatcttccacttgtttccatcccactggcggagaggcgggaggggagatcagaaactgcttgtctggatttggcggagccaggtgtgagcttcctatgtgtaaggtctgaggagagaaaataagcacaggtcagttgttgccagggaagaactgcagtgaggcaacagcacctaacgccagttccgggagatgggcaggtcaatgtccaggcgtcaggacaggtgtgattccaggaccaattgtaagatggtctgtaatggggagggcaaaaggacayatgaactctggttgtggcacagataggatgacagccccctcccagggctatgggagtcacaggcacagggactgcaaataattacgcttgacctagatggacagaaaatcagcagaggtgactttagtatatatggaaatttaagtcactgtcattgaggtcaggagggctcttggaatcagtctctccccgctcctcataccacagaggcaagctctgaaagtccaaagcctaggccacagttctgagaggacacagcttctcagggacagggagccagggctccacctgcccctaggg

SEQ ID NO: 29996 - DNA, 601 bp, Human
tccaaagtccaatcactcatccctatccggagcgacagaacctggggccggggctcaggcctcccacgcaggctgtgctcagtggacacaggaatggattcctgggacactgcggggggtggaggggcgtgatgcagggtccccacgatcagccgcagtctctctaacactgcaggtggtgccaagaggcaggcatgctcccagcacaagggacggtggcgcagaagaatacagagaagctcacaaaacatgccggcatgggctcaggagagctacgggggtagtggtggtactgctcccyggtgcagggcagcagctgtgtctccccctgcctccctcccacccgagggccctgctcacctggccccagcttggagatggcatataagagatcatagtttatgactggggtcgcatcttccacttgtttccatcccactggcggagaggcgggaggggagatcagaaactgcttgtctggatttggcggagccaggtgtgagcttcctatgtgtaaggtctgaggagagaaaataagcacaggtcagttgttgccagggaagaactgcagtgaggcaacagcacctaacgccagttccgg

SEQ ID NO: 29997 - DNA, 601 bp, Human
ttttcctttaagaaggccaggtgagaatcacaggaaagggagaatttattttgattaaaaataacatttcttaaagggggcatcgattttccctttccaaagtccaatcactcatccctatccggagcgacagaacctggggccggggctcaggcctcccacgcaggctgtgctcagtggacacaggaatggattcctgggacactgcggggggtggaggggcgtgatgcagggtccccacgatcagccgcagtctctctaacactgcaggtggtgccaagaggcaggcatgctcccagcrcaagggacggtggcgcagaagaatacagagaagctcacaaaacatgccggcatgggctcaggagagctacgggggtagtggtggtactgctccctggtgcagggcagcagctgtgtctccccctgcctccctcccacccgagggccctgctcacctggccccagcttggagatggcatataagagatcatagtttatgactggggtcgcatcttccacttgtttccatcccactggcggagaggcgggaggggagatcagaaactgcttgtctggatttggcggagccaggtgtgagctt

SEQ ID NO: 29998 - DNA, 601 bp, Human
catgctcatgcccccgggccaggagctgctgtggggggagcacacgcttcctcaaaatggccatttctgatcttgaccttcacgccacaattagcagtaagtaatgtgagtcttgctttatcccacagagggaatttccgtttggacaatgttttcagaaatgtaatcttttcaatatgaaactgctgatggaccaagaaaacaaaaccctcaacccaagggaacatcagattgctggtcaaggagaaatgaggagctgacggtctcagcatttatttgacttgctccacggacagagcargagaaggctcaaacctcttcaccccaagactctccctcacacctgcctcctcacccaaaccctagaggacaggacaggaaccaccaacattttatggttttcaaaaatcctgcattgaacactgactgtgagccaggtgctgatggaagtgcctttcactcgatgatctcatctactgctcacaattccaccagttaaggcccacattttggacaaagagcctgaggaacctaccccctccccgcagtgctcacacttttgtccctccagaggacgggaacttcctctttctttagcaag

SEQ ID NO: 29999 - DNA, 601 bp, Human
aaactgattttattacgtctatttcctaaaaagccttctccaataagccctcggtgaaggaagtggtatattctggagtatgcagaatttttattaacagcatttgcctctggaactgtggacacctctttgcaagtggagaccctgttttctcccattcctaacctaggggaagactccacaccctcagccatgctcatgcccccgggccaggagctgctgtggggggagcacacgcttcctcaaaatggccatttctgatcttgaccttcacgccacaattagcagtaagtaatgtgastcttgctttatcccacagagggaatttccgtttggacaatgttttcagaaatgtaatcttttcaatatgaaactgctgatggaccaagaaaacaaaaccctcaacccaagggaacatcagattgctggtcaaggagaaatgaggagctgacggtctcagcatttatttgacttgctccacggacagagcaggagaaggctcaaacctcttcaccccaagactctccctcacacctgcctcctcacccaaaccctagaggacaggacaggaaccaccaacattttatggttttcaaaaatc

SEQ ID NO: 30000 - DNA, 601 bp, Human
ttgcctgttgcccaggctggaatgcagtgacaagatctcggctcagtgcaacctccgcctcccaggttcaagtgattctcctgcctcagcctcccaagtagctgggactacaggcgcatgccatcatactcagctaatttttgtatttttagtagagacgaggtttcaccatgttggccaggatggtcttgatctcctgacctcgtgatccgcctgcctcagccttccaaagtgctgggattacaggcatgagccaccgcgcccggcctgtgcttgggatttctttgcagttcgggtaagygaggaggcaccgcaccaaccactgtgtgatttccgcccgacaagagcggcccaggagagcttcctacctccagccacactggttactcctctaaacctggaaggtacttttactgataaggaaggtggtgatcttttctctatcacatgtgggactggaatgttattataactgcactgaaaaaggcaaaggagctcagctctctgagagagagaattcaggcatgggaggtcagatggattgctgaaaatgctggttaagagcctcttacaaatctacctctttgcaagtctcttatct

SEQ ID NO: 30001 - DNA, 601 bp, Human
ttttctttctttctttcttttttttttttttttttttgagacagagtcttgcctgttgcccaggctggaatgcagtgacaagatctcggctcagtgcaacctccgcctcccaggttcaagtgattctcctgcctcagcctcccaagtagctgggactacaggcgcatgccatcatactcagctaatttttgtatttttagtagagacgaggtttcaccatgttggccaggatggtcttgatctcctgacctcgtgatccgcctgcctcagccttccaaagtgctgggattacaggcatgarccaccgcgcccggcctgtgcttgggatttctttgcagttcgggtaagcgaggaggcaccgcaccaaccactgtgtgatttccgcccgacaagagcggcccaggagagcttcctacctccagccacactggttactcctctaaacctggaaggtacttttactgataaggaaggtggtgatcttttctctatcacatgtgggactggaatgttattataactgcactgaaaaaggcaaaggagctcagctctctgagagagagaattcaggcatgggaggtcagatggattgctgaaaatg

SEQ ID NO: 30002 - DNA, 601 bp, Human
acggagccaggtgctctggaaacgtttttgacctgggcatcttttccttagaacaacttctaatccccgggaccaggagtgtcctgctgttctatgtcagcctgagttctaccaggttggccaagttcaggccactctggtccagcaagggtggggagagctttctgcaactgaaaaacccggcaatgtagaatgaagggactggggcctcccgctggggtgccgctctggccacgggaagagtgtgcatctctggtgctcatgaaggcagctctgagcctggctccttagtacccagggmtcatgggcactttattctgcttccctgtgcacctcagttccctcctcagtaaaggagacggtaaaggtattgacttcatggagctaacagcatgagtgagtgcccgaggcaatgagaacccggctcaccacatgcttgtccagcccatgtcacctagaaagatgtttaagaatggagactgcatcgttattggtgccctgctgggcagggatctgaaataggggcaggaggtttgcttcaacctgctccacccacagggtgtggcctcatggtcagttttcttccagggctttgtgcttg

SEQ ID NO: 30003 - DNA, 601 bp, Human
ctcaaccaacagtttccaaaaaagtttttggctatgattcatgtatagaaaccaccacataaaagaaacaacagaaactgaggtccgatcccaaacacctaaactaaaatttctcacccactaaaagttggcagtgaaactgctattctctgaattgtataagctaaattctacagaggaatttcagatcaacttcttttgcaaaagcacaagttacacgttgcacggttggggatgctgagtgaatgcattccaggaagagttccgcaagcaagtgctgttgcaaagagtcgagaatccragaatctgggaaaggtgatacgttttccaaacgctttcctggcttcccaaaagatgtaaaacaacaacggtgtaactttatatacgaacaaaggttagtcttgtaaatcagtaatatacatgcacaaacatgagaacatgagggaagaaaggaaacgctacaatttccacattgcattgctgctgttttcacaacctctctgcactaggcggcttcctgtggtacctcttcctaccagtagagagtggcccctgcaggccacttagaaacaggaagctctctcctgagctcactgatcaa

SEQ ID NO: 30004 - DNA, 601 bp, Human
gatctactatccacttgacatgctttgaattcaagtcctgttagacatgggaacagcttttcctacaacatatgattcacaggtaggttaatacatcttagtctcccactgccatacttttcacccaagtgtacaacaggtatgaatatatgctatcagctttatttacaagtgtatcttgatgtcttcgtggggtaaaagaaccaactatctcaaccaacagtttccaaaaaagtttttggctatgattcatgtatagaaaccaccacataaaagaaacaacagaaactgaggtccgatcccaaacacctaaactaaaatttctcacccactaaaagttggcagtgaaactgctattctctgaattgtataagctaaattctacagaggaatttcagatcaacttcttttgcaaaagcacaagttacacgttgcacggttggggatgctgagtgaatgcattccaggaagagttccgcaagcaagtgctgttgcaaagagtcgagaatccgagaatctgggaaaggtgatacgttttccaaacgctttcctggcttcccaaaagatgtaaaacaacaacggtgtaactttatatacgaac

SEQ ID NO: 30005 - DNA, 601 bp, Human
tgaaagagttctttttagaggtttgtatgtgtgtacagcccctttctattctaaatctgtttgctggttttgctcaatttttaatgaccagaatctgtactggcttattttttttcttaactgtgtaacactcagagtattgattaactatgggtatttttgacagcgtgagaaattgatgcttaccatctgtctcacctttttgtttgtttttgtagggggatatgagactttctactcggaatatcctgagtgttgcgtggatgtaaaacccatttcacaagagaagattgagagtgasagagccctcatcagccagtgtggaaaaccagtggtaaatgtcagctacaggccagcttatgaccaggtacgtgatgtgatggggaagaggtatcctgagtggtattctgggctcctgtctcccttccttcctcagcacctgactgttctctccccactcagcaatgatggttagttcttttgtggatcagggtgttggcaaaatcccctggctttagggagcttctgttgcttgccagcttgagcttccatccaagagtaaatgggcttccttccagcaaacgagctgacaagagcaaac

SEQ ID NO: 30006 - DNA, 601 bp, Human
agagaagattgagagtgagagagccctcatcagccagtgtggaaaaccagtggtaaatgtcagctacaggccagcttatgaccaggtacgtgatgtgatggggaagaggtatcctgagtggtattctgggctcctgtctcccttccttcctcagcacctgactgttctctccccactcagcaatgatggttagttcttttgtggatcagggtgttggcaaaatcccctggctttagggagcttctgttgcttgccagcttgagcttccatccaagagtaaatgggcttccttccagcaaaygagctgacaagagcaaaccagccacaggatgcttggcagcttctggggaaaaggggaagtgaaagatacattattgtcatctggcttcggaggttcagagaagctttgaaatactggtctaggtttccctgaagacatttcagagttgactttcaggcttcctgtgttgcttttctttgtaattgtccatgctctgcagtttctgcaaaccatcccggtacctgtcaaggtgtgtcttattggtatgtttaactgaaactggtgttggtgggggtgctacagagaaagtcctgtttgggt

SEQ ID NO: 30007 - DNA, 601 bp, Human
ggttagttcttttgtggatcagggtgttggcaaaatcccctggctttagggagcttctgttgcttgccagcttgagcttccatccaagagtaaatgggcttccttccagcaaacgagctgacaagagcaaaccagccacaggatgcttggcagcttctggggaaaaggggaagtgaaagatacattattgtcatctggcttcggaggttcagagaagctttgaaatactggtctaggtttccctgaagacatttcagagttgactttcaggcttcctgtgttgcttttctttgtaattgtycatgctctgcagtttctgcaaaccatcccggtacctgtcaaggtgtgtcttattggtatgtttaactgaaactggtgttggtgggggtgctacagagaaagtcctgtttgggtggctaagtaggctcctctaaggggttcttatgcttacaattccacagataactgaaaccagaggaaatcaaaagatactagagggcttcatgtttctgtaaactagtgagtttttgtttttcttctaaaaatgagtgctttgtgataactcattaaagggaaaaataaagtggaagggggttacgta

SEQ ID NO: 30008 - DNA, 601 bp, Human
aggaaggctgctctgtacgcatggaagtttgggaggtttcgaggaggtgatgcagatggacattttatctctagaggaagagaggaaagagggaattttttccttcctgtctttacctgaaatacttactttctcatattgatcactattgaaatggagtcagacaaggccttgcatctcatgctacgcaatcagttttgggtttcagcccagctctaccactgactagctctgacttggacaagttattaaatgcatctgagcctcaagttgcccatccgtaaaatgggaataatgttayctacctcacagattttgtgaaattggtatgatgtaggcacatctaaatggttaagcccccagaggccagccatagtagatgctgataaaaataccagttgttattaccgtatgtaaaatcttgtgtaattttctttcaagtgactgaactggcctttgcttaaacacttgacttctcaggaaacaaaaagctaactccgggtgtggggtaaattgagaattgcctgtggctggcccctgtcccacgcacccttccctgttagggatctggctgagagtttccattccgttcttattccag

SEQ ID NO: 30009 - DNA, 601 bp, Human
ttgaaatggagtcagacaaggccttgcatctcatgctacgcaatcagttttgggtttcagcccagctctaccactgactagctctgacttggacaagttattaaatgcatctgagcctcaagttgcccatccgtaaaatgggaataatgttacctacctcacagattttgtgaaattggtatgatgtaggcacatctaaatggttaagcccccagaggccagccatagtagatgctgataaaaataccagttgttattaccgtatgtaaaatcttgtgtaattttctttcaagtgactgamctggcctttgcttaaacacttgacttctcaggaaacaaaaagctaactccgggtgtggggtaaattgagaattgcctgtggctggcccctgtcccacgcacccttccctgttagggatctggctgagagtttccattccgttcttattccagggcaggaaatggaaacacaggaagcagatggttggcatgggaaaggctcccaaagacacagccactgtcacccagccccttgtttccctctcagtctctaagggctcccatttttccaaccatcactagcttttctgccaccttcaga

SEQ ID NO: 30010 - DNA, 601 bp, Human
tgacaacattttttatctaaagattctgagtaggtagtggttattttcatttctaaaaagcatacttttttgtggaggtggaggtgcattttaacatctctaaaacctgggtgcatcttaggatcaacagtgtcttaggtttgatgaaatacaccatataggctaggcttggtagctcatgcctataatcccagcacttcaggaggctgaggtaggaagatcgcttgaggccaggagttgaagaccattctgggcaacatagcaagaactcatctctaccaaaaaaattataaaattagcyaggcatggtggtacatgcctgtaggcccagctactcgggagactgagacggtaggatctcttcagcgtaggaattcaagattacagtgagctatgattgtgccgctgcactgcagcctgggtgacggagcaagactctgtctttccaaaaaggaaaaaaaaaatacactatgtaaaatgtcaaggctgtaaaggaggacacacaccatgttgagtcctggtccattttatctgtaaagaaagcaagactgtcccaaggcataggagattgccctggtactctcagggcagctgtaacttc

SEQ ID NO: 30011 - DNA, 601 bp, Human
ttttgctgtcattgagtcacaaggcagtcacataaggtagagagttggccaggatggagatacaaccacacttggttgaactgccctggctctgaactccacttggaaaccagaaagggaaccacccatcttaagaaacaaataggtcggagttgttttttcctctctcaaatgaacaagctaatccaatatttcctgattgtcctttgtccctgcatccagggtggcccagttgaaatccttcccttcctctaccttggaagtgcctaccatgcatccaagtgcgagttcctcgccaacytgcacatcacagccctgctgaatgtctcccgacggacctccgaggcctgcatgacccacctacactacaaatggatccctgtggaagacagccacacggctgacattagctcccactttcaagaagcaatagacttcattggtaggtttagccattccccttcagttattttgggagcccctttggggcatgtgttcttgacttttgatgccctgatggaagctaccttcactgaaagaaaagtgtcttgtatatgccgctgctgagagttggagccaacatgggatgcagctaccaaaa

SEQ ID NO: 30012 - DNA, 601 bp, Human
atcctccgtctagtaggcgtcacttagccagggctataattagtggccatgcgctatttattgtgtgtttggtggtgagaaccctgggagctgagccaagcatcctgccctggcacagccagacagggtgcccggagagaccggaaggcctctaccaggatcggggttaggttgttacccttagaatcagacctggagagacaagagttgcttctccaagtcagtctttgagcctgggatgctctccttagaaaaatgtatgtgcccaataaaaatgtgcacaatttcaaggattttccartgccctcttggaaccatcagtggaacctaggttaagatggcatccccaggaagggactgctccaggtccatcgcctccagaggcacaatctgcaagtatcttgggaactgtaaagcttctgtgtgcttatgtctcttgtgacaatagctgctgtaaactgtaaaggtcctacttggggatagtctttgctgggaccccaaaagctctatcctcaccagtggggattaaagactggcagaagtgtagtgtagggccgtggctcttaggcaggcacaacagtttcatatctaggttactcca

SEQ ID NO: 30013 - DNA, 601 bp, Human
ggagctgagccaagcatcctgccctggcacagccagacagggtgcccggagagaccggaaggcctctaccaggatcggggttaggttgttacccttagaatcagacctggagagacaagagttgcttctccaagtcagtctttgagcctgggatgctctccttagaaaaatgtatgtgcccaataaaaatgtgcacaatttcaaggattttccagtgccctcttggaaccatcagtggaacctaggttaagatggcatccccaggaagggactgctccaggtccatcgcctccagaggcasaatctgcaagtatcttgggaactgtaaagcttctgtgtgcttatgtctcttgtgacaatagctgctgtaaactgtaaaggtcctacttggggatagtctttgctgggaccccaaaagctctatcctcaccagtggggattaaagactggcagaagtgtagtgtagggccgtggctcttaggcaggcacaacagtttcatatctaggttactccagtgtttgattcttgtgttttgccattgcccttagattctaatcccaactcactcccaccatcttttcttccttccagactgtgtca

SEQ ID NO: 30014 - DNA, 601 bp, Human
gaaggccaagccattacgggagcacagcatgtgctgactactgtacttccagacccctgccctcttgggactgcccagtccttgcacctcagagttcgccttttcatttcaagcataaggcaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtmaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggaga

SEQ ID NO: 30015 - DNA, 601 bp, Human
tgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctccyctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattattattttatcattattattatttactctaaattggtag

SEQ ID NO: 30016 - DNA, 601 bp, Human
gagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacrtagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggat

SEQ ID NO: 30017 - DNA, 601 bp, Human
ttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaatttwccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctc

SEQ ID NO: 30018 - DNA, 601 bp, Human
tttagttctaggtgaaggggtgggtaacactttacctaaatttcccaaactgctccttgtcctaattaatgacctcatctgagaaggtaaggagaaagtaagctactcttcgcgtctgttctgattagtttaggctgagctgaaggtagtgttcgctattgtgcctcatgaacttcaggtgcgacatacctggtggctgtctagtatttcagccttccaaattctccagtcttgcaccagctgagtgaacggaagagaaaatggccacataagagttttgcaggccgggcgcagtggctcrcgcctgtaatcccagccttttgggaggctgaggcgggcagaccacctgaggttaggagttggagaccagcctggctaacgtggcaaaaccctgtatctactaaacatacaaaaaaaaaaattagccaggtgtggtggtgcaaccctgtcaggaggctgaggcaggagaatcgcttaaaccagggaggaagaggttgcagggagctgaaactgtaccactgcactccagccttggccacagagcaagactccgtctcaaagagttttgccgcttctagcccactgaggccagcagagaaag

SEQ ID NO: 30019 - DNA, 601 bp, Human
ctcctcatcctccctgcaggcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgtgagtgtcccaccctgtctcctgggcccagcagacagggccaggtggggggactgatgagggtccatgtggagactcttgcttgagcatcagagagggctggagatggggctcggctcattccagcaaccycacactgcaactcccccacagcgggcactccaaccctcactaaacagtgtttgcttctgaacttgtatgagcacccagggcgcctcagtttcctcttacaaaatgggactcacgatataaactttaccaggttcctgtgggtttaatgagaggatataagtgaagcaccattgcgatgtgtggtgtaaagtaagcattcagtaaacggcagccatttcgattatcatcacatgcacatcgtacactggccaagcacctgcatttacattatttaatcctttattcaaatagccttgtaaa

SEQ ID NO: 30020 - DNA, 601 bp, Human
tgccaagctaccatgcttcaatggccgggtggtgtcctgggtaaggagccctcagccttccatccacctgcatccctgtgctgggctggacgagggaaaggcatcactgagattgtagctggtggttttaagcttcagtatctgaatctttctttagttttgcaaatgaactgcttctcaccccagattctgtaacctttgatgaaaagtgagaaattagtgggaagggggaagagggagagacggaaacacacagtggagacagtaacgtttcctatgccgttcagacacttgcctcagrtttccttctgccatctgctcatctctgccttagacctctgagccttgttctttgtccccattccacttcaccaccccatgccttccaacaaccccgtcaatagcaggaagtggcagaggggccactgttcatctcagccaccctcgcacagccctgtcttttctccctcgatatttcctgcttccttcctcttaggccttcatgccttgctggaagtgaactatccccttctccttgatgctcctgtaacatactactcactcagtttctccctttcagctggtgtcagctgagggctca

SEQ ID NO: 30021 - DNA, 601 bp, Human
aaagacttgagtgaaagcttttttttgagacagaatctcgctatgtcacccaggctggagtgcagtggcacaataatggctcactgcagcctctgcctcccaggttccagcgattctcctgcctcagcctcccaggtagctgggattacaggcatgcaccactatacctggctaatttttgtatttttagtagagacggggtttcaccatgttggccaggctggtctggaactcctgacctcaggtgatccacccgcctcggcctcccaaagtgctaggattacaggcgtgaaccaccgcrcccggccaaaagccatttttttaaaccatggtaaccctgatgttttgagagaagctgggacctacttcccatactttacttaacctggaagtgatgttctgtgttcacaggtagcctatagattaaattgagatattatgctagaaaatactggcttaacatttgactaaattagtgttagatatagtcgacctttaaacctgtggctcaagtatacaaattctgtgttatcgctcagcctacctactttctatatataagtacttgttctaaaatcctaattttctctatttctttgac

SEQ ID NO: 30022 - DNA, 601 bp, Human
tgaggataacttagaagaatcattgaagagggtgaactaatttagtagatgggggaattaaaggagatgccagataggaaatctgtggggtggctggtggtgctgtttatgagacgaagaatgtaggagtgtatttagagtgacgttcagttttggacatgcagacctaattagaagtgtttgtgagccatccatgaggagatactgagactgcagttttattatgtggttcttgagctcagaggagaggtctgggttggagataaacatttgagagtagtaggcatatagatgataattgaagtcccccatctactaaattagtttactctcctcagtctttaaaattgcctggggaggccgggcacagtggctcatgcctataatcccagcactttgggaggccgaggcgggcggatcacctgagatcaggagtttgagaccaacctgggcagcgtagtcaaactctgtctctactaaacatagaaaaaaaattagccgggtgtggtggtgcatgcccatagccccagttaacttgggaggctgaggaaggagaatcacttgaacctgggaggtggaggttgcagtgagccaagatcgt

SEQ ID NO: 30023 - DNA, 601 bp, Human
agccatccatgaggagatactgagactgcagttttattatgtggttcttgagctcagaggagaggtctgggttggagataaacatttgagagtagtaggcatatagatgataattgaagtcccccatctactaaattagtttactctcctcagtctttaaaattgcctggggaggccgggcacagtggctcatgcctataatcccagcactttgggaggccgaggcgggcggatcacctgagatcaggagtttgagaccaacctgggcagcgtagtcaaactctgtctctactaaacatasaaaaaaaattagccgggtgtggtggtgcatgcccatagccccagttaacttgggaggctgaggaaggagaatcacttgaacctgggaggtggaggttgcagtgagccaagatcgtgccactgcactccagcctggtcaacagaggagactccatcttaaaaaaaaaggccagcgctgtggctcatgcctgtaatcccagcactttgggaggctgaggcgggtggatcacccgaggtcaggagttcgagaccatccagcctgatcaacatggtgaaaccccgtctctactaaaaataacaa

SEQ ID NO: 30024 - DNA, 601 bp, Human
aggtgaagagtaggaggagaaagagaaggtagtctgaggtatagggagagagtgggaaagtttgaaatagccattatggaaatgaagctgattggaaaaactgtatattaataattgccagataatattatgtgctctagcacccaatcctgatgattcttgtcaatatctctcaaaagccatcaactctttactgctcctgcctgaattcaggtttttattattttaacctgtactgtactagttttctttctttctttctttctttctttctttctttctttctttctttctttctttctttctttttttttttttttgagacagagtctctgttgctcaggctggagtgctgtggtgtgatctcggctcactgcaacttctgccttctgggttcaagcgattcttgtacctcagcctcctgagtagcttgattacaggcgcgtgccactatgcccagctaatgttttgtatttttagtagaagacggggtttctccatgttgctcctgctggtctggaactcctgagctcaggcagtctgcccaccttggtctcccaaagtgctaggattataggcgtgagccactgcaccggcctat

SEQ ID NO: 30025 - DNA, 601 bp, Human
gaagagtaggaggagaaagagaaggtagtctgaggtatagggagagagtgggaaagtttgaaatagccattatggaaatgaagctgattggaaaaactgtatattaataattgccagataatattatgtgctctagcacccaatcctgatgattcttgtcaatatctctcaaaagccatcaactctttactgctcctgcctgaattcaggtttttattattttaacctgtactgtactagttttctttctttctttctttctttctttctttctttctttctttctttctttctttctttctttttttttttttttgagacagagtctctgttgctcaggctggagtgctgtggtgtgatctcggctcactgcaacttctgccttctgggttcaagcgattcttgtacctcagcctcctgagtagcttgattacaggcgcgtgccactatgcccagctaatgttttgtatttttagtagaagacggggtttctccatgttgctcctgctggtctggaactcctgagctcaggcagtctgcccaccttggtctcccaaagtgctaggattataggcgtgagccactgcaccggcctattgta

SEQ ID NO: 30026 - DNA, 601 bp, Human
gagtaggaggagaaagagaaggtagtctgaggtatagggagagagtgggaaagtttgaaatagccattatggaaatgaagctgattggaaaaactgtatattaataattgccagataatattatgtgctctagcacccaatcctgatgattcttgtcaatatctctcaaaagccatcaactctttactgctcctgcctgaattcaggtttttattattttaacctgtactgtactagttttctttctttctttctttctttctttctttctttctttctttctttctttctttctttcttcttttttttttttgagacagagtctctgttgctcaggctggagtgctgtggtgtgatctcggctcactgcaacttctgccttctgggttcaagcgattcttgtacctcagcctcctgagtagcttgattacaggcgcgtgccactatgcccagctaatgttttgtatttttagtagaagacggggtttctccatgttgctcctgctggtctggaactcctgagctcaggcagtctgcccaccttggtctcccaaagtgctaggattataggcgtgagccactgcaccggcctattgtacta

SEQ ID NO: 30027 - DNA, 601 bp, Human
ctttttttgtttctagtaccttagttgttgatgtatttagataatttactcacaaaaaaattaagagttagttattactatacttggtatttatatactctagcagttctatttctaaattgctttatcatcacatgctttgatctctggacaatctggtacaatatggagaagtagagtttgtcactcccagtttacagtggaggaaactgagttaggtcagagctgacaggtgctgactctcaagactcagatggtggtctaagctgatgatttgtaaaatccaagtcatttgtgggawgacgttggcatctttaactctgtgggtatctcttctttcagtgaatattaagtgcttctgcagtgtcaggccctgggctgtgttttagggatgtgaaaatgaataaaacatggattcagcctttgagaaactccaagtctaatggaggaggggctaaccattcttctttgctgagtacagagtaaaagaatacaatatttaagtatggcaaagataagagacacaagaaattactcaggatctgaaatgactgagcaaggaagttctttctctgagatctttaagactagtagtagttgg

SEQ ID NO: 30028 - DNA, 601 bp, Human
ctaagctgatgatttgtaaaatccaagtcatttgtgggatgacgttggcatctttaactctgtgggtatctcttctttcagtgaatattaagtgcttctgcagtgtcaggccctgggctgtgttttagggatgtgaaaatgaataaaacatggattcagcctttgagaaactccaagtctaatggaggaggggctaaccattcttctttgctgagtacagagtaaaagaatacaatatttaagtatggcaaagataagagacacaagaaattactcaggatctgaaatgactgagcaaggragttctttctctgagatctttaagactagtagtagttggtaatgtctgattgagtgggaagagtatggacgaagtgatgtccaagtttcatactgactagatttcttttcaccgcataattccaaaactaggttataccttggaaaaatgaatttacttttaatttagaatgattattattctctgctcttttttctctctgttgtattctgggattgttcctatagccacctacacacagatccagccccattcactgattcagcaacagcaacagatccacctccagcagaaacaggt

SEQ ID NO: 30029 - DNA, 601 bp, Human
cctatagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagmaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcagg

SEQ ID NO: 30030 - DNA, 601 bp, Human
taattccagtactttgggaggccaaggccggtggatttcttgagctcaggagtttgagaccagcctgagcaacatagtgaaaccttgtctctacaaaaaaatataaaaattaactgggcattgtggcacatgcctgtagtcccagctacttgggaggccaaagtgggaggatcgcttgagcccgggaggtggaggttgcagcgatccaagatagcaccacggcactccagcccgggtgacagagtgagactgtctcaaaaaaatttttttttccaaaagatgatctaaaataggacatttrtatctttaatttccagttctccttattctagattttataatctatcttaaggactcttactgattttcccactgcttttggaaatctttgtggtagaaggatcttatatctttctaggcattagtagttcctctctcctcagaaattgaatcatatctgaaatctaagagtatgaattaggataaaattagtaagacatctaaaatggagagagttcggcttaaggttaggaagacgtcataaagttctcaagggacaagtcttcgtgattttaggttttgaactttgcgttttagggat

SEQ ID NO: 30031 - DNA, 601 bp, Human
tctcaaaaaaatttttttttccaaaagatgatctaaaataggacatttatatctttaatttccagttctccttattctagattttataatctatcttaaggactcttactgattttcccactgcttttggaaatctttgtggtagaaggatcttatatctttctaggcattagtagttcctctctcctcagaaattgaatcatatctgaaatctaagagtatgaattaggataaaattagtaagacatctaaaatggagagagttcggcttaaggttaggaagacgtcataaagttctcamgggacaagtcttcgtgattttaggttttgaactttgcgttttagggattctcaactaggttgtgtaggtttttgggggtgaaccctgagaataattttagaatccagctctgagcctaatgattgcctgaggggcagcagaaacccatggtgactgtccagcaataccttgttttttagagttagataagaaggcgaatctcctgaagtgcgagtactgtgggaagtacgcccccgcagagcagtttcgtggctctaagaggttctgctccatgacttgcgctaagaggtactctgggca

SEQ ID NO: 30032 - DNA, 601 bp, Human
agattttataatctatcttaaggactcttactgattttcccactgcttttggaaatctttgtggtagaaggatcttatatctttctaggcattagtagttcctctctcctcagaaattgaatcatatctgaaatctaagagtatgaattaggataaaattagtaagacatctaaaatggagagagttcggcttaaggttaggaagacgtcataaagttctcaagggacaagtcttcgtgattttaggttttgaactttgcgttttagggattctcaactaggttgtgtaggtttttgggggtgaaccctgagaataattttagaatccagctctgagcctaatgattgcctgaggggcagcagaaacccatggtgactgtccagcaataccttgttttttagagttagataagaaggcgaatctcctgaagtgcgagtactgtgggaagtacgcccccgcagagcagtttcgtggctctaagaggttctgctccatgacttgcgctaagaggtactctgggcaccctcctccttgccctcagcactggtatctccatctaatgttacaccccttccccaggatcgtctcatagctgatatt

SEQ ID NO: 30033 - DNA, 601 bp, Human
gtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccgggtgagctgcttgttgtagagccagatgcctttaaactgggtctttttttctttccctgcagggcaattcatttgcccaggtaagagggtgtgagatgagaactctggtttcacattgattgcattactacaaattccaagagatcctgaccccctttgtctccrgacctcttacccaactactggttcatgtttccattaatccttacactgtacttgagtacaattgttaattgtactcaattgtactcaatttctctcaattgtacttgagagaaaatctagatcaattgttaggtcatggggagaatcaaggaagtgatacagtttctatttgaaagactttgagagtagattttgggaatttgcaaataaagtgctgcttatttcacatatgataagatgagtttttcttctacgcccaacccagggtggtttgggaagaaagagagaggaataaacctt

SEQ ID NO: 30034 - DNA, 601 bp, Human
actaaatttttggataaaatgtttttgtgtaattaactatgatacctcccatggggaaaaaattttttttttcagtggagcagggtattagaaactaagtggccattgttgccccactcttcaaagagggcttgtttgctagtcttcttttttttttttttttaaacagagacagggattccctatgttgcccaggctggtcttggagtcctgggctcaagatatccttctgccttggcttcccaaagtgctgggattataggtgtgagccactgcactcagcctatatgcaattttgacagagtttttttcggaaatgaaaatcaccctacccttcttgctatttgtctgaattctgggcccttaaacaaaaatatcacaaagaatctttttgccagtataaaagaaaacatgcttttatttctgttctctccctttcccctgtctctaagctatttgaatgaagttatttctgtggttgaacaatttagttgcttttcctttcttggtcttggactttggttttgttgttgttgttgttttgagacagagtcttactctgttgcccaggctggagtgctgtggcatgaattttggcaca

SEQ ID NO: 30035 - DNA, 601 bp, Human
cccttcttgctatttgtctgaattctgggcccttaaacaaaaatatcacaaagaatctttttgccagtataaaagaaaacatgcttttatttctgttctctccctttcccctgtctctaagctatttgaatgaagttatttctgtggttgaacaatttagttgcttttcctttcttggtcttggactttggttttgttgttgttgttgttttgagacagagtcttactctgttgcccaggctggagtgctgtggcatgaattttggcacactgcaacctccgcatcctgggctcaaatgagcctcctgcctcagcttcccgagtagctgggactataggcatgcatcaccatgcccagctgatttttgtatgttttgtagagtcaaggttttgccatgttgcccaggatggtcttgaactcctgagctcaagtgatctgcctgccctggtctcctaaaatgctgggattataggcgtgagcctctgcacctggccattttttaaataccagttgctttctaatttcattttgcttttaaagcttgccatctgacttcatattactgaatttaggacaggtactttggaattaatcattgct

SEQ ID NO: 30036 - DNA, 601 bp, Human
cctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatccyggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaa

SEQ ID NO: 30037 - DNA, 601 bp, Human
ctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctyccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagt

SEQ ID NO: 30038 - DNA, 601 bp, Human
tctgatacacgtatcttgagaattctgttctgtgcaattccttttgttcctaactggccgaagttttgccattcagaggttttggcattcaaaactcaatgaaatctaatttcccaaaacccatcatctctcaccaaatatcccacagtgaactcccttttaaccaagggttcacacatcaacaggcagggacacacctgagtttgtgtgggaaacttctaaccaagggtcttgtcaattattcctgatcactgacccccctcttctggaccttggaaagataatcctagaaagaaatggytctatattctttgggggaggaagttagcaaggaaagagcaaattgttcacattttcagaaattttacatggaaatgtaaaaatattctaagacacatccaaaatatacttaaaaaaaaaaggggaaaagaagtagtccgtaccgggaaaggctccgccccctcctggatcacaaacccttcgataacatgcgtcaggatttggggtttcacaatggcctgtggtggtttattctcaccattctggggggcagtgccggcgatgctggaggcagagtttccgttccctgaggtcatgccgg

SEQ ID NO: 30039 - DNA, 601 bp, Human
ccaacagccagatacttttcatcagaacagaggctggtgtgccgctggctctgggctcctccacacccacagggcagcaccactgtctccagtgcacactgcacagaagcagctctgggtgctttggtcaataacccatcttcgtggctcgtggatatttcttgttagtcttaggcttccatcgtgacctttctgagtgcccctcaatctcattaactcccctttcaaggctctgtccccagaaaacaagcttcaggttgtgaccctgtttcctcacattcatttctgatacacgtatctkgagaattctgttctgtgcaattccttttgttcctaactggccgaagttttgccattcagaggttttggcattcaaaactcaatgaaatctaatttcccaaaacccatcatctctcaccaaatatcccacagtgaactcccttttaaccaagggttcacacatcaacaggcagggacacacctgagtttgtgtgggaaacttctaaccaagggtcttgtcaattattcctgatcactgacccccctcttctggaccttggaaagataatcctagaaagaaatggttctatattctttgggg

SEQ ID NO: 30040 - DNA, 601 bp, Human
tctagggcaatgctgggggtgctatgcaatctgcctccaccccatgagatcaggtggtttctagtgttactctaggaggcccagtctaacagggaagggatgtaacagagcgagagccacttctagctaaggtgttccaggcagatttctttgccactggccttggacaacctccagtgggaaagaagacaagaagctatgtgtcttttggcattttacaggagcagttcacccatctcagttaatcaagctccgcgtcttctgcagactaatcaaaccactcatggaaccaaagaatgargaaaaggcagatggtatcccagaaaggtgtcttctccaacagccagatacttttcatcagaacagaggctggtgtgccgctggctctgggctcctccacacccacagggcagcaccactgtctccagtgcacactgcacagaagcagctctgggtgctttggtcaataacccatcttcgtggctcgtggatatttcttgttagtcttaggcttccatcgtgacctttctgagtgcccctcaatctcattaactcccctttcaaggctctgtccccagaaaacaagcttcaggttgtgacc

SEQ ID NO: 30041 - DNA, 601 bp, Human
agcaggttctcaggaaatggcagtggtttttatgatgaccattagtgatctatgctgggcgagagctcaccaagggaacactatagctgtggttctgggtaaggcttaccctaacaaggcaggggctgtcaatgctaggaaaggcgaatgggtgccagtggagcccaggagggccagccgagccaaagcactgcggcttttccttggactcccgctgctctctcccacctgctcttaggggttctggcttctcgtgcttgttgaattagggatgccatcctgcttccaggtgggtcgaggaactaggaaactggagaagccacccctatggacctcctggggtagactattaatggcaggaggtgggacataaagtgcagtcctggggaaatggagggggctggggccactcacctctttgcacaagccatggaacagaagcgcttggaacgcttgaacttataggcaaagtccacccggccacagagctcacacttgagtttgaggggagcaccctcctctttggattctgaaaagtatagaaatgggtagggtggagaatgagaaattcctgcaggactgtggccagccccaccacggg

SEQ ID NO: 30042 - DNA, 601 bp, Human
ttgccatgaatacctgacctggtcggtgtatgagtgagactggcagaaaaacagtaatgcatccaggccccactgaaggcatctgtgaatgatgtaaggcttgcctcttacagctggctcctagatcccgggcctcaccaccacttgtgctccaccacgcagggctctgtgccatgtctggccataccacagacttccctatcttcatgcctctgcatgtgcgccctcttgcagtctctccatccagcaaaggcatacttgtctgtctactgtcatttagtttacattttcttaattaaattttttttttttttttttttggtagagacaggtctcaccatgttgcccaggctgttctcaaactcctgacctcacgcaatccttccacctcagcctcccaaagtgctgggactataggtgtgagccaccacacctggctattttcttaattttgatgttcctgacacatatcctacactctacctgactcccctcctaatctctcccaggagagagagacagttaattacattatcatctctgtatttcacacagatcacttcccatgccagaaaatatacagaattacagctatggaata

SEQ ID NO: 30043 - DNA, 601 bp, Human
caaaaattagctgtgtgtggtggcgaatgtctgtaatcccagctactcaagaggctgaggcagaattgcttgaacccaggaggcggaggttgcagtgagccgagatcacgccattgcacaatagcctgggtgatggagcaagcctctatctcaaaaacaaaaaacaaaaaagtcaaaggtaatataaaataaaaaggaggaagcaggctgagaaaacgactacactgaaaatacaggctacttttcacagaaaaggaaggagaactcagagggcagaaccaagacagaaatcactcccagsctttgagtcccaattgaggaaatgccaccataaaccctagcggatttcggaactggaatggatcagcgactcttgtacgctccctgtttctccctttttggatgggcatgtctgtaatggttatcctatggctgtcccactgtgcattgggtttgtggaagggagcagatagcctctctctctagttctcagatcttcagactgagaggacctatacttgaagaactggaccccaggagcctcatctcacctcaatgatgagagcctggacttcaaactgatgctgtcatgggaccaaac

SEQ ID NO: 30044 - DNA, 601 bp, Human
agatcctcttttcaacagcagggtttctaagaatgtgaagggcactgtccatgctgcccctcagcttcagaagaataccaatgcagacaacagcttacccttgaagataattctgggtgtggtttttgtctaatggaatggaccccaacaagattcccagaaaacccacaattattttaagaaatactgaattactgattttaagagtcaaaggtaggccgggcgcagtggctcacgcctataatcccagcactttaggaggctgaggtgggtggatcgcctgaggtaaggagtttgagascagcctgccaacatggtgaaaccccatctctactaaaatacaaaaattagctgtgtgtggtggcgaatgtctgtaatcccagctactcaagaggctgaggcagaattgcttgaacccaggaggcggaggttgcagtgagccgagatcacgccattgcacaatagcctgggtgatggagcaagcctctatctcaaaaacaaaaaacaaaaaagtcaaaggtaatataaaataaaaaggaggaagcaggctgagaaaacgactacactgaaaatacaggctacttttcacagaaaaggaagg

SEQ ID NO: 30045 - DNA, 601 bp, Human
gcagggaggggtgtctggaaaggaaactctgaagcgccgtctctttctgaccttgcctctgcgctgaggctgccattcttggctattccccatcctgaggctgagtggagtccaggacaaagcactaagtggctgtttgctacaaaacacctggagatgccagagagtagcccttggcctatctgtcagtccaggctcccacacagtcacacagtcatacacacagcgttaaggcgtctgtgccagcaggcacggcccggctgggcccagcttctctctctccacctgcagagggtgtagkggggagaaccctggctgctgcagaaacaggctgaagggggagaagctgacaacggaagagttaaccaggcctggagaaagaagtgggaggaaggaaggcaagggctttctaggcctccatccaggcctgctggctgcccttgaagtaacccaactcaggttggggagccctgaccatataccccctggaaaatgggggacagaaagaggggaagagagcggggctagagtattgggactttggaggaagccagtgctatcaatatttacaagcataaagccccatcttctgtgccaccta

SEQ ID NO: 30046 - DNA, 601 bp, Human
gaggcaggccctcgccctttctgccctgcctcctcctcaggtagctcaaattgctgctaggaagatttataggcaaagaagtgtgggagtgggaggccaagagctgccttcttcacatcaacagaaactccagctgttctttccccttagaagttctctgagcctcaccactgggactcccagggtgggcgggcaggcaggccaggaggctcagccctctgggctatgttgctcagaccaccgcagctttcttaatgctctttgtgaaccaggagggcggtcaggggaacttcacagtgcrgggaggggtgtctggaaaggaaactctgaagcgccgtctctttctgaccttgcctctgcgctgaggctgccattcttggctattccccatcctgaggctgagtggagtccaggacaaagcactaagtggctgtttgctacaaaacacctggagatgccagagagtagcccttggcctatctgtcagtccaggctcccacacagtcacacagtcatacacacagcgttaaggcgtctgtgccagcaggcacggcccggctgggcccagcttctctctctccacctgcagagggtgtagtgg

SEQ ID NO: 30047 - DNA, 601 bp, Human
accctgcctgggggtgtgggtggggaatagaataagctcagaaaggtgcctacctccttcctgcaaaggacacggcaggtcagaggcaggccctcgccctttctgccctgcctcctcctcaggtagctcaaattgctgctaggaagatttataggcaaagaagtgtgggagtgggaggccaagagctgccttcttcacatcaacagaaactccagctgttctttccccttagaagttctctgagcctcaccactgggactcccagggtgggcgggcaggcaggccaggaggctcagccctytgggctatgttgctcagaccaccgcagctttcttaatgctctttgtgaaccaggagggcggtcaggggaacttcacagtgcagggaggggtgtctggaaaggaaactctgaagcgccgtctctttctgaccttgcctctgcgctgaggctgccattcttggctattccccatcctgaggctgagtggagtccaggacaaagcactaagtggctgtttgctacaaaacacctggagatgccagagagtagcccttggcctatctgtcagtccaggctcccacacagtcacacagtcataca

SEQ ID NO: 30048 - DNA, 601 bp, Human
aaagagacagattttacagatttatttttaaaaaacaaaacaaaggttaaaaaagtccttcatttccaaccctgcctgggggtgtgggtggggaatagaataagctcagaaaggtgcctacctccttcctgcaaaggacacggcaggtcagaggcaggccctcgccctttctgccctgcctcctcctcaggtagctcaaattgctgctaggaagatttataggcaaagaagtgtgggagtgggaggccaagagctgccttcttcacatcaacagaaactccagctgttctttccccttagmagttctctgagcctcaccactgggactcccagggtgggcgggcaggcaggccaggaggctcagccctctgggctatgttgctcagaccaccgcagctttcttaatgctctttgtgaaccaggagggcggtcaggggaacttcacagtgcagggaggggtgtctggaaaggaaactctgaagcgccgtctctttctgaccttgcctctgcgctgaggctgccattcttggctattccccatcctgaggctgagtggagtccaggacaaagcactaagtggctgtttgctacaaaacacctg

SEQ ID NO: 30049 - DNA, 601 bp, Human
caaagagacagattttacagatttatttttaaaaaacaaaacaaaggttaaaaaagtccttcatttccaaccctgcctgggggtgtgggtggggaatagaataagctcagaaaggtgcctacctccttcctgcaaaggacacggcaggtcagaggcaggccctcgccctttctgccctgcctcctcctcaggtagctcaaattgctgctaggaagatttataggcaaagaagtgtgggagtgggaggccaagagctgccttcttcacatcaacagaaactccagctgttctttccccttaraagttctctgagcctcaccactgggactcccagggtgggcgggcaggcaggccaggaggctcagccctctgggctatgttgctcagaccaccgcagctttcttaatgctctttgtgaaccaggagggcggtcaggggaacttcacagtgcagggaggggtgtctggaaaggaaactctgaagcgccgtctctttctgaccttgcctctgcgctgaggctgccattcttggctattccccatcctgaggctgagtggagtccaggacaaagcactaagtggctgtttgctacaaaacacct

SEQ ID NO: 30050 - DNA, 601 bp, Human
tgacccagctccagaaaagtgtggaggatatgccatccacttaaggtcccttccccagcccagggacccacctgtctgtatgggtgaaaagtagccatttgggcccagagacaggcattcctaggggagaaaggcaccaaagagacagattttacagatttatttttaaaaaacaaaacaaaggttaaaaaagtccttcatttccaaccctgcctgggggtgtgggtggggaatagaataagctcagaaaggtgcctacctccttcctgcaaaggacacggcaggtcagaggcaggccctygccctttctgccctgcctcctcctcaggtagctcaaattgctgctaggaagatttataggcaaagaagtgtgggagtgggaggccaagagctgccttcttcacatcaacagaaactccagctgttctttccccttagaagttctctgagcctcaccactgggactcccagggtgggcgggcaggcaggccaggaggctcagccctctgggctatgttgctcagaccaccgcagctttcttaatgctctttgtgaaccaggagggcggtcaggggaacttcacagtgcagggaggggtgtc

SEQ ID NO: 30051 - DNA, 601 bp, Human
attgtgtgtatgttatgtatatgtacgcatgtgcatctttatacacatgcatgcatatacatacacatacatacacacgcacaccatatacttatatttaaattctatctgttgtgttggtgatgacaaagggcaaaagcagagccagcttccccatgatggtgggaaggagaaattgctatgtaattgagagaagacacaaagctggagtggctggttgaagcctgcctttctgggaaaagattttgaaagagatgggagaaggtttagaggggagaaggggaaggagtgggagggcagrgggcaaactcaggaacatagatttcttagagtggggctaaggaaatacacatatattttaaaaggcaggctcagcgatggctgctctttctccccacagatcaaactgccctgaggcctaagagggaagcgctcagaaaaggaggggttctgaggggccaaacccgaagcggcggcagcagcaccgcgtcggcggcatccgaggcatttctctaagaaacatgatttcagagcggatggaagaccacctcctccagccacgtgcggacccccagcatgggacatctcccagcggcttggg

SEQ ID NO: 30052 - DNA, 601 bp, Human
ggctaatgatgttgtcctggcaccagttggaaggggagtcgaaggcgaactttcccaagtaggtcacggtcttgttgccgggggctggctggaaggagccggagtaagagagttccgggttgggcttctcgttggtcagaccgatgtccattacattctctgcggagagcgggggagagaggggaggggtgagtgaagccgatccggctccgggccgcggcgcccaggtccttgcccaggtgcggagggtgcggccgggtggagtgcgtagcgcatggggtaagaggaacgctgagccccrcgcaaagcgggcggtgccgcgctcccgggcgcaacctggatatagcaaaatactacggatcggggtgtggagtggctgctgcacacacagcgcacaagccgcgcacacactcacgtaccacacacacacgcgcgcgcgcgcgagaagcattgttgttcttcccgaggtggggcgggcaggtagctgcagctacaggtagtttcagacccggagcgcgctgggctctcgctctccaccgcacacaactcggcctcttcccttggccctgtccgctccaggacgccgcgcctttccctcccc

SEQ ID NO: 30053 - DNA, 601 bp, Human
ttggccctgtccgctccaggacgccgcgcctttccctccccggcgatgccccccacgcgcgctgctcccgggtcgccgacccagagcgctccgacgctttgtcctcggagcgtagaagggtgtcgccctcaaagggagctctcccttcacctaccccggccccagcctcctcgggcatgaaggagctttaggctcttgctggaggggaaaatcctagccccagctagggagggtggagagcggcggaaaaccggccggtgtctccatggcgggagaggccgcccttccccagctccccggycccgggatcgttccccgtggcaggccctcgccccgcgggtgaaccccctccttctccccgccgtccccacacccccacggctttgctgaacgccccggaaaggcagcgtcgcagtacctctcccaccgcggggactccacgccgcacatggctccatcccgggtgggaggctgagggagtaaggggggagagcgcgggtgaaaaagacgccgggctcctcccgggaagagggcgacagcaccacgccttgcgcgtagcccggcgatcgggccccctgcgtggtgagggagaaccccagag

SEQ ID NO: 30054 - DNA, 601 bp, Human
cttgatcaggttttcctgttccctgtctcttcttcacccctcacctcctgggctgagacctcaagacagggggcatctttaaccccttccctcccaagaggtggatgggtggtgccagagatccctctgactgtcagcccttctggaacatggaaggcccagctccgctagggccttctctgtctccccagttccccccacctctcaggcttacacccacaccctcgtaccttcccacgcccatccagccctggcctgggccggctgactctgagcctggtgtgagaagctggaccctgarcctgagacctggctgagctgctgaattgaagccaggccccacgctccctgggcctcagtttctccatctctacaggggaccagcagccccattctcacacctctccccaccccgaaggcttacatacccctttgccatacgggtgtgtgagccagccgagctcccctccagctgcagcaaagtccagcagtaccactgaaagggagaagggagagggggtgagcctgggggtgtcttcaggagtcagaccatggcaggaaaggtgaggatccctccaggaaccccaactctcagacagag

SEQ ID NO: 30055 - DNA, 601 bp, Human
taacaggcatacgggcagccagtatgattattgttactcttggtattattcaccatgcacccatgtgtgttggcaaacgcaggagtggcattaagtcaaaaacaacggatgatgctctccgtcatttagaatttggctttgcagcagatgaacatgttcctccctccctggatcataactcagccttctccagaaagaattcccaggttaggctacagttgggccaggtgccccccgccacccaactcccaaagttgccatgttccctttaccctgtaccccttgccatttaccaaagtgyacttggcacggcacatggggacacccacatctgggctcccacatgagattctgagctcctcagccagagtctgcatctaattcacctgtgtcctgtgtcccgagagccggcctgagacagagtaggtgctcagggaagcgtttgttgaatgaataaacaaaagaatgaatgaaagcacaggggaggaggacagaggcccgggctatactgtgtggcgttggccaaggccctacatgcccttgggcctcagtttcccactctgtataaagactgggttgtattaggtgacccgtgttccct

SEQ ID NO: 30056 - DNA, 601 bp, Human
cctgggaatgcagaaccccttccctgcaacccagaaccgtcactcaccctggcaggcatcctccaccttctcgtagcctgcctggcacaggcactgcccaatgggcaccagccactcgccatccactgcacagtgcatacggggctcttcaccccccggtggcaccacggcatggtccacacaggtgccggccacagtggccagggaaggtgcatcagagccggcgatggtctcagggaagtgggccaggccctgcagcagctcggggcacttcttgtagtagacacggacggagagcagygccacacaggcaccgatatcctggaaggccaggtagaagcctttgcgggtgagcggccccacggagcgctcctccacgttcagcttcacgtggcgtgcctcgaagtcgctgctgacggtgatctcatcgggcgcaatggtgtcaatcttggtgaacaggcgcttctggaagttggtgccgtagtccaggtccgactcggcatagtagaggttgaaagtctccttgcaggagctggcgccaccagggaagctgttgcagtcacgtacagtaaacttgagctcaatgaagatacgctcagcc

SEQ ID NO: 30057 - DNA, 601 bp, Human
gaacctgggaatgcagaaccccttccctgcaacccagaaccgtcactcaccctggcaggcatcctccaccttctcgtagcctgcctggcacaggcactgcccaatgggcaccagccactcgccatccactgcacagtgcatacggggctcttcaccccccggtggcaccacggcatggtccacacaggtgccggccacagtggccagggaaggtgcatcagagccggcgatggtctcagggaagtgggccaggccctgcagcagctcggggcacttcttgtagtagacacggacggagagyagcgccacacaggcaccgatatcctggaaggccaggtagaagcctttgcgggtgagcggccccacggagcgctcctccacgttcagcttcacgtggcgtgcctcgaagtcgctgctgacggtgatctcatcgggcgcaatggtgtcaatcttggtgaacaggcgcttctggaagttggtgccgtagtccaggtccgactcggcatagtagaggttgaaagtctccttgcaggagctggcgccaccagggaagctgttgcagtcacgtacagtaaacttgagctcaatgaagatacgctca

SEQ ID NO: 30058 - DNA, 601 bp, Human
cattcttaatgaatgagttaatccagccttaataaggaaactgatgtctgggaaggatctataatttccactaacagaactaatgtgtgtcaaagcagggatgagcttaccaagattccatgattccaaagctaaagaccagaacctgggaatgcagaaccccttccctgcaacccagaaccgtcactcaccctggcaggcatcctccaccttctcgtagcctgcctggcacaggcactgcccaatgggcaccagccactcgccatccactgcacagtgcatacggggctcttcacccccsggtggcaccacggcatggtccacacaggtgccggccacagtggccagggaaggtgcatcagagccggcgatggtctcagggaagtgggccaggccctgcagcagctcggggcacttcttgtagtagacacggacggagagcagcgccacacaggcaccgatatcctggaaggccaggtagaagcctttgcgggtgagcggccccacggagcgctcctccacgttcagcttcacgtggcgtgcctcgaagtcgctgctgacggtgatctcatcgggcgcaatggtgtcaatcttggtgaac

SEQ ID NO: 30059 - DNA, 601 bp, Human
tttgtgtttttggtagagacggcgtttcattatgttgcccaggctggtctcaaactcctgggctcaagtgatccacccacctcagcctcccaaagtgctgggattacaggcatgagccaccgtgcccagccacaattcattcattcttaatgaatgagttaatccagccttaataaggaaactgatgtctgggaaggatctataatttccactaacagaactaatgtgtgtcaaagcagggatgagcttaccaagattccatgattccaaagctaaagaccagaacctgggaatgcagaaccccttccctgcaacccagaaccgtcactcaccctggcaggcatcctccaccttctcgtagcctgcctggcacaggcactgcccaatgggcaccagccactcgccatccactgcacagtgcatacggggctcttcaccccccggtggcaccacggcatggtccacacaggtgccggccacagtggccagggaaggtgcatcagagccggcgatggtctcagggaagtgggccaggccctgcagcagctcggggcacttcttgtagtagacacggacggagagcagcgccacacaggcaccg

SEQ ID NO: 30060 - DNA, 601 bp, Human
tgtcaccccaggctggagtacagtggtgcgatctcagcttactgcatcctccacctcccgggttcaagcaattgattctcgtgcttcagcctcccaagtagctgggattacaggtgcatgccaccacacccagctaatttttgtgtttttggtagagacggcgtttcattatgttgcccaggctggtctcaaactcctgggctcaagtgatccacccacctcagcctcccaaagtgctgggattacaggcatgagccaccgtgcccagccacaattcattcattcttaatgaatgagttartccagccttaataaggaaactgatgtctgggaaggatctataatttccactaacagaactaatgtgtgtcaaagcagggatgagcttaccaagattccatgattccaaagctaaagaccagaacctgggaatgcagaaccccttccctgcaacccagaaccgtcactcaccctggcaggcatcctccaccttctcgtagcctgcctggcacaggcactgcccaatgggcaccagccactcgccatccactgcacagtgcatacggggctcttcaccccccggtggcaccacggcatggtc

SEQ ID NO: 30061 - DNA, 601 bp, Human
gtgactagcgattgacagggttccacgaactaagtcggaaatttcgctcttggaaacttgtcctcctgctgggctgatcttcccaacagggggctgctcggctctctgcaaacaaaatctgccagaaccctgaccccccacctctagaggagggaaggctgccccgcttcctggagagacacccccaccccaaccgtccacttatctctgcggggcctgcctcaccagcctgtggaaagttttcagctgcccctcacccccacccccgcattcttgtgcgaggatgtcatgtgggaggagyctgctcgccccactgggctgcctcgtcccggccccctcaaccgcactcattgtctgaaactgagagtatgcattcgaggtcacctaaagcaggggccgcctggggaaggggggctcgctcagcagaggggagctgggaagacaagggggcgatggcatgggccggagcagagcctacaccacaggcttatggccagaaagctcgtagggaacttctcatcggggggtttacagaccgtgttaagtaaggttctgaggacttgctttaggaggcaagtagggcccatcacaaagggcttca

SEQ ID NO: 30062 - DNA, 601 bp, Human
ttgacagcgtccttcagggccacaggtccagcccactcattttacagatgggggtgggaccccaaggggacctgctaaggtcatacagcctgtgggtggaaggacacacaccaggggcaactgccttcctgtgccaggcccccgttcttttggtcactgttcactgcttcctctccggacctcagtttcctcatctgtaaaatggggatcaagtcctcatcctctctgggttgtgtgtgaagatggaagaaagccctgcttatgagatgtccagcatggtgcctggaatgcggtgtccctrtgaactaggggatcatgaaactacagtagggaggggacctccccaaggggctgggccccttgagggagcaggagcctctcaggagggaatctccaactccccacaaccccagctctggcctcccagctgttcagctgagccactggccaaggctgctggccacctgctcacctgaccagcggtccccagggctgaggcgccagcaggggccccgccagctgctgaggccagcacaggaagcggagacatggagacaaagcagcccccgggggacagcggtcagcccgagcgactccactg

SEQ ID NO: 30063 - DNA, 601 bp, Human
aaacacacccacatacaccagatacctactgttccttagccaaccagcaaactcctatgcatcctttaatacccagcttaagctcctctacacagccctcccagactgcccaattcctggccccccggcccccattagggcatctattaatcttatgtttaccaaatagaaatgggcacttcatacgtgtctggcacaatgctgggtgctaggatgcgatggtgagacagataaacactgtttcagctccaggggaattcaaaacttggcttttatgctccatttgaaattattcctgcawgtatcaggagcttccgtgagaccagcagctcctgaggagcaggaatggagaccaatttatctgtgtcccatggcccagcggtgctcagttaatgtttgctgaatggatggacagacagatggatggatggatagatgggtgagttggtgggtggatgggtagatgagtgtgtggatggatgggtgggtggatgaatggatggatgggtggaggggggtatgagtgggtggatgaatggacagatgaatggacaaatggatgggtgggttggtgggtggacaggtggatgagtggatggat

SEQ ID NO: 30064 - DNA, 601 bp, Human
cccacttcaaaagccagaaactcctgacgaatttcagagcagctgtgggtctatgtgttgtggaggaggggagggtattccccaccacagatcttctcaaactgggcacttttgtgtctgtgagcagaaaagtgtagactccagcccaggggggttggttggggtggctgaagtggtctccttcaagccccgaatgtcttcaagtctcctattgtatttggaaacccatgagtatattgcatccctccccataacatatctgcatgatacaaaaatagctctctcctccaccagatctgtkagtaaaactgagactccagaaagctgggccatgtttatcctggggtcagttcccccaaatgccctgacttgtctgtggaggagacttcacctggctcagtgctggttcaggtggtccagggccagctgacttgggaagctcgggggcgttcccagcccaggctctcaggccaggcaggggccataaacccccacagcccaggctcggacccactggaggctttagccacctgcaaaccctcacaatgccccgactccccaccgtgtggctgcttctatgccaagaggaggaagtggggga

SEQ ID NO: 30065 - DNA, 601 bp, Human
ctcggcctcccaaagtgctgggattacaggcgtgagccaccgcgtccggcctattttattttttagagacggggtgtgtctttgttgcccaggctggtctcttgacctcctggcctcaagtgatcctcccacctcgacttcccacaatgctgggattacaggcgtgagccacctcaccgggcctcctttcccacttctgttcttaggaacacttcaatttggagcaaagataaatcaacattctgaaacaagcctgaagagagaggagataaggcctgacccacttcaaaagccagaaackcctgacgaatttcagagcagctgtgggtctatgtgttgtggaggaggggagggtattccccaccacagatcttctcaaactgggcacttttgtgtctgtgagcagaaaagtgtagactccagcccaggggggttggttggggtggctgaagtggtctccttcaagccccgaatgtcttcaagtctcctattgtatttggaaacccatgagtatattgcatccctccccataacatatctgcatgatacaaaaatagctctctcctccaccagatctgtgagtaaaactgagactccagaa

SEQ ID NO: 30066 - DNA, 601 bp, Human
tgacccaagcaaacctgctaactctcagggacagaatctggagcgaagactctcgtcatccagtcccctgtgtgagcagaggtgcagagggggaccaggagtcaggggaacaggactcaaaggacacccagctctgtaaggtgccagatagtgacctcctgctgatgactctgctctcagagccaggctgcatccctgtcccctcccaaccctggcccagggaccacacaaacagccgctctcacccccttggtccatcctgcttctgcagaccctcagcattggccctgcaagagctcargcacatagggcagggaagggggcttgtcccaggtcatgcagcaggacagaggaggcccgggacccgactcctgctctgcacagagcctggagtcccaatgacagtacctactatgcgcagggctcgggctaagcactgtaccctcatttagtcctcgcaatagacctgctatatacaggcactattagcgctggttccactttggaggtgaggagagacaaaaaagcttgtccaaggtcaccaagctcccaagaaggaaaccagaactcaaacttaggatgcctgattttcagcctctct

SEQ ID NO: 30067 - DNA, 601 bp, Human
gtgtagttcatgtggggctccaggtcgctcactgtcacactggtgcgggtcagtccgtgaggaggctccgagtagcgcacactggcctcacacggcccgcattccccagactcgggccagcactgttcgcaggtgacgctgtagacaatgtcctcgcggcccccgctgtcctgagggggcgtccagcgcagctccaccttggcacccatgcccacggctgtgaggtagtgtggggcggaagggggtcctgcacagacaggaggagtcagtgctgtgctggacccaggcggacacgtcaccytcagtcacgccaccctgacccactgcaagactcacgtgtgcaaggcatcgacgctgggtcctgaggtgcccggaagaagccttcctcacactcgcaggaggtggcaccctcaggggatggcagcgtgtgctcagggcactccaagcaggggctctcagatgcctcaaacttaaaaaatccaggcgagcaggctggtggacacaggacagacagagcacaaggacatcagttcaatctgcttccaccccacgtgactgtctcattccctcaccagggacccctgccctgcaagcaggtcag

SEQ ID NO: 30068 - DNA, 601 bp, Human
gaagcctgtggccccaccccagtgccctgggaacaccctggctgcccccacctcccccacagagctggggacggtgcgggcagggctgggcctggagcgggggctgcgtctcacctgacttggagaagtaaacgtcctccggggactggcgggcacgctggttcttcctcctgaaagagccccacggggaaccaaatgcagggaggtcagtgaggtctgctccggccagggaagcctcctggccctactttggtcctaggaggacctggggtgctcagaatgcggcccagtccccgctttygctgcccaagctccactctcagggccgagggtgcggagaaggcgggtggaggaacagggaggaagtgagcgagccaggactccctctccaggatctaggccccagaatggccccttaagcagtcgtgacgaaggcattcccattagagctactcggggattcctgcctgcgtgtccagaggaagtgtggacacatcattaataacaagagcagaggtaatgacccccgtgtcccggccccgccgcgtgccaggcacttcgctacacactctaactcgtatatcctcgcaccatccggagg

SEQ ID NO: 30069 - DNA, 601 bp, Human
gagaggtgggcacgggtgtaaggaggtgggtgcaggtatggggggaaggtgggcacaggtgttaggaggtgggtacaggtattggggagaagtgggcacagttgtagaggaggtgggtgcaggtgtggggggaaggtgggcacaggtataggggaggtgggcacagtcacagacagagcccctgctaagtggcccctctccacccagtgtgggcaggccccaagcctcacatttggagatgacgccctctaggcggatgatgttgtggtggctgaactggcccatgatgccggcctcgccraggaagtccactcgctgcttctctgtgtagccggctttcagcgtcttgatggccaccggcacctccttcttccccgaggatgtcttcagcatgcccttgtacacctccccaaactctcctgtgggcagacagggtcaggggagtgccctggtcagccccggcatgagggctcccacactgtgtcaccaccgctgcctcctcagggccccttggcagggggccaacctcacctgctccgatcaccttctgccgagtgacacaggatggatggatctcggtagtgaacttcaacacagcctg

SEQ ID NO: 30070 - DNA, 601 bp, Human
gaggaggtgggtacaagtatggggagaggtgggcacgggtgtaaggaggtgggtacaggtatcggggagaggtgggcacaggtgtagaggaggtgggtacaagtatggggagaggtgggcacgggtgtaaggaggtgggtgcaggtatggggggaaggtgggcacaggtgtaaggaggtgggtacaggtatcggggagaggtgggcacaggtgtaaaggaggtgggtacaagtatggggagaggtgggcacgggtgtaaggaggtgggtgcaggtatggggggaaggtgggcacaggtgtwaggaggtgggtacaggtattggggagaagtgggcacagttgtagaggaggtgggtgcaggtgtggggggaaggtgggcacaggtataggggaggtgggcacagtcacagacagagcccctgctaagtggcccctctccacccagtgtgggcaggccccaagcctcacatttggagatgacgccctctaggcggatgatgttgtggtggctgaactggcccatgatgccggcctcgccgaggaagtccactcgctgcttctctgtgtagccggctttcagcgtcttgatggccaccggcac

SEQ ID NO: 30071 - DNA, 601 bp, Human
ccccaacttacactggtggtgtaggtggcctcggggtcgtcctccagcacgcgggacaggccaaagtcagacaccttgcagaccaggttgctgttgacgaggatgttgcgggcagccaggtcacggtgcacatagttcatgttggccaggtacttcatgccagctgcgatgccccgcagcatgcccaccagctgcagcacgctgaactcgccatccttctcctgccggagcacaggcgctcagctgcaggccagccctgaacccgccaggccagccccgggctcaatggccaggcatcccygccccctacaacccacatccttacccgaaggaacttgtccagggccccattctccatgtactcagtgatgatcatcatgggcttgtctgtaggggggtgggcacaggtgagaggtaagtgggcccaggcatgtgggagaggtgggcacagatatgggggaaggtgggcacaggtgtaggagaggtgggcacaggtgtggggagaggtggaacaggtgtggggagggtgggtacaggtatggggagaggtgtggggaaagctgggcacaggcggaggagtgggcagaggtatggggagagg

SEQ ID NO: 30072 - DNA, 601 bp, Human
cctgcctgcttcccatcaccgactgtcccctgagggaggctatggccttggccagcaggttgggagcccagctgagcaatttccaaaggccctagagaatgttcatgaacaggctcaaatcccagaacttctgtgacctagaaccatgggaggcccaggtcatcccctccatacggttcccaaaacctcccagcctcccggtctgttcccgccatgatctttgaccatgcacaagctgggttgttgaaactggccactatttttagaggcacaaaaggctaagaggatagggtctcccccytcctgggacaggaggaggtgtctgtgccaaggccatgccgggaaaagtctcaatgctggagttgggaaggggagaagagctgccaaggggcagcttgacaaaggggcaaacccagggccagcagagagtaagtggcacttctcaccaggtgggactgcaggctgagagccaaccaagtggagagaggtgcccggggtaggccaggggttctctctcctgggcagcagtcagggcatcttggagaagactgccccaaactggctgtgtgacctcaggcaagccggtaacatctcagcctgt

SEQ ID NO: 30073 - DNA, 601 bp, Human
tggccctgctgggctggcgggcagcaaaagacatcctgtgatccatctcccctccctacgtgtccccgcctcccctctggtcggctctgttcctgcctgcttcccatcaccgactgtcccctgagggaggctatggccttggccagcaggttgggagcccagctgagcaatttccaaaggccctagagaatgttcatgaacaggctcaaatcccagaacttctgtgacctagaaccatgggaggcccaggtcatcccctccatacggttcccaaaacctcccagcctcccggtctgttccygccatgatctttgaccatgcacaagctgggttgttgaaactggccactatttttagaggcacaaaaggctaagaggatagggtctcccccttcctgggacaggaggaggtgtctgtgccaaggccatgccgggaaaagtctcaatgctggagttgggaaggggagaagagctgccaaggggcagcttgacaaaggggcaaacccagggccagcagagagtaagtggcacttctcaccaggtgggactgcaggctgagagccaaccaagtggagagaggtgcccggggtaggccaggggtt

SEQ ID NO: 30074 - DNA, 601 bp, Human
tcccacaggctccgggagccccggcacaggcgcagagcagggaagggcagacccaggtgagttggggggactccaggacctcccgcagaggctggtgctcccacagcagcaggaaggccgagacatttgggacatttgggagaacttcctacgctacctgcacaggacgtttctaacctatacagttggaggtgctgaaaaagcagcagtttcccacacacttgaaggtctcaaattgtggtccctggaaaagcgctcagaccacggtgaaggagacaggacccccggcctgaccccagawtcactcgatttgcagttccgcaggtggggcaaggagtctgcatttggttgaatcccagaagaaacctgacatccggtttaaaaaccagtgggttgtaagctccaggaggacaagtgctgagaccttgtcatctgggcccatcacccccacagcacctgctcccgcccccacccctgcccagggtccaggataggcctggcacatagtaggtccctaggaagtgtctgctgcatgaatgcatgagcgaatgaatgctttagcggaggttgggccgttgctgggccacctctggtccctctt

SEQ ID NO: 30075 - DNA, 601 bp, Human
attatatgatgcaagatcctagttgcagttctgcagacatgactttcccacaggctccgggagccccggcacaggcgcagagcagggaagggcagacccaggtgagttggggggactccaggacctcccgcagaggctggtgctcccacagcagcaggaaggccgagacatttgggacatttgggagaacttcctacgctacctgcacaggacgtttctaacctatacagttggaggtgctgaaaaagcagcagtttcccacacacttgaaggtctcaaattgtggtccctggaaaagcgytcagaccacggtgaaggagacaggacccccggcctgaccccagattcactcgatttgcagttccgcaggtggggcaaggagtctgcatttggttgaatcccagaagaaacctgacatccggtttaaaaaccagtgggttgtaagctccaggaggacaagtgctgagaccttgtcatctgggcccatcacccccacagcacctgctcccgcccccacccctgcccagggtccaggataggcctggcacatagtaggtccctaggaagtgtctgctgcatgaatgcatgagcgaatgaatgc

SEQ ID NO: 30076 - DNA, 601 bp, Human
gctggggaggggagtggagggaggcagaggaggagggtggagagggtgccttggggacctgtagggcaagagagctctggttaggtaggcctgggagaaggagccacagcctagaagcttgccaaggtggcccaccatcaacaaagttaggaaaacgacagaagcctcaactctgtacgatgctttaaaaaaataaaaataaatcaaatcttctgaattatctgtgaggcaggtgctctttttcatccccattttgcagattagagaactgaggtcagagaggtaaagtgacttgcctgargtcacacagctaggaggtggaagagctgggaatcaaaccagctatgaacaaatgccttccctcccctcacccctagtctgttcccagtgcccccagctcaggcctccttcccaggaactctctagggatgtcgctcaaagcctctctgcccaaggtctcttcccacctgctgcctcatttctccctcactccttccaagttcccactgctgatcatgaaggaaggacttgggaaatacttgaagggttaaactttgcgagtcttcatgggtgaggcttgcgggtcaccagatccagtgac

SEQ ID NO: 30077 - DNA, 601 bp, Human
tggcggtgcctgctaagtgctcagctgtgtgcgtctcgcagggaaagagggcccagcccagcatccctggtcatctcctcagttcaggccagggtgtcatccgagacccctcagcggaagttgcagggggaggaaagaactagaaataaataaagtccccagtggcccagcatggcacagcagggaggccactctgtttcttcaagtattcttggccgatggggctccaggccctgtcgaggctcagatggggatccccacagtgttcacctggtccttgagtcccagcaggctgtaggcratgcgcttctggtggccgggcagccgcaccccaatcctcttgatgtcgctgtgggccgggagggagagagggagagttaggggctggagcaggggagggggccgggctgggtggggacaggactcggtgggcggctggggaggggagtggagggaggcagaggaggagggtggagagggtgccttggggacctgtagggcaagagagctctggttaggtaggcctgggagaaggagccacagcctagaagcttgccaaggtggcccaccatcaacaaagttaggaaaacgacagaagcct

SEQ ID NO: 30078 - DNA, 601 bp, Human
tctccacaaagtacaaaatatatatttaaaaacctcaacacaaccaagcatcttgcaaaggcccaggaaagcaagggtttggccagtcagggatgaggatggggcccgagggtctaaagaaggcactagagggacagggaccgctttgggtctcacccagtcaagttcacagtctgccctcttagtgtgaggaaatggggcttgaggtaccctgtttacttggcgctgggccaagccctccatctcctgagatggcctcatgtgggagaaggcggagggaaggtcggcttgggaatatccyatatgtctgtccgaaggctgtggcggggctcctgctccagggatgctgggacgtggcggtgcctgctaagtgctcagctgtgtgcgtctcgcagggaaagagggcccagcccagcatccctggtcatctcctcagttcaggccagggtgtcatccgagacccctcagcggaagttgcagggggaggaaagaactagaaataaataaagtccccagtggcccagcatggcacagcagggaggccactctgtttcttcaagtattcttggccgatggggctccaggccctgtcgaggctcag

SEQ ID NO: 30079 - DNA, 601 bp, Human
ctatgagattgtttatgattgtttatgtgtgttcctttttgcagtgaaattggtggtgtttttcttattaacgtgtataacttatgcagcatttgtgtggcagactactgcagccgtggctttggggtctgaagtgaatgagatgaaacacccacagcaccctttaaaaactgtttttcgtttattttcacagcaaacccaaggagcctgtattcagtgcaggtaagtctgatttaatttatgtatgggaacccctcactcactctctcagaactcaagggacagaaaagaagtagccagyttcaggggccagccttggacacacaggagctttggtttgtgcaggcccagatggagctttgtacctggaggttgaatggctcagatagtgacagcgagactgcctttaaacagtcataaagagcaaacccttcacctaccctctccaaaaccaacgtaagacatgccagtaaggaggagagtggaatgccaccacctatgccatgatggaatttctagattaaaaggtgtctgttgccttggttattccttccttactaactggattctgttatcaacatttgcatttctcttaggggaa

SEQ ID NO: 30080 - DNA, 601 bp, Human
gacttataaaactaacttgtactataattatttcctaactgttcctcgccaatttcctccctgcggatgctttttctgttgagttgtgtacaggtatccctggttccaactgcccagtttaaataccattaaaaccaggtcctttgatctgcagtgaaatttcagaattcagcgagttctgaatctgaacagaattcaccaggagcggagctcacaagacattttctttgcccttatcatatcctgagaactccagtcagaacaccccaagatgttctttttgaggtctaggagttacccygtgttgatacgttgttgatatttacttttgtccctatgatttattgaaatattaaaagttattttattatagaaatgttcgttctgaagagttttgcatcctgatttctctctctaatgggtcttttgttcttttgttttccatttctagattttctttgagcattttcctttctgcattgcatcctagcatgcacttctgctgattttgtgttctttacacttgaaagaattgttcaattaaaagatacataaagatatatttttacattgcaatataacaaatccatttaaatattga

SEQ ID NO: 30081 - DNA, 601 bp, Human
acttgtactataattatttcctaactgttcctcgccaatttcctccctgcggatgctttttctgttgagttgtgtacaggtatccctggttccaactgcccagtttaaataccattaaaaccaggtcctttgatctgcagtgaaatttcagaattcagcgagttctgaatctgaacagaattcaccaggagcggagctcacaagacattttctttgcccttatcatatcctgagaactccagtcagaacaccccaagatgttctttttgaggtctaggagttaccccgtgttgatacgttrttgatatttacttttgtccctatgatttattgaaatattaaaagttattttattatagaaatgttcgttctgaagagttttgcatcctgatttctctctctaatgggtcttttgttcttttgttttccatttctagattttctttgagcattttcctttctgcattgcatcctagcatgcacttctgctgattttgtgttctttacacttgaaagaattgttcaattaaaagatacataaagatatatttttacattgcaatataacaaatccatttaaatattgaaaaatatttgtgaa

SEQ ID NO: 30082 - DNA, 601 bp, Human
ttaccatgtacatgcccaaagatcaagtggattcttacagcttggaagcaaaagtagaacttccaaccaagagactcaagctggaatgggtgtatcctttattcattgattaggtctcacatgaagttatcagtcaatcaatgcttgatgttaactgtagaaattcataaaacttaagtcctcttaagcttttaaaaaacaaaatgttttactgttacttttgaaaacttaatgtaacaaaattgactatatgttagagacctacagagttctaacaaagtaggagcttcataagagcggyttattatcaggagaaccaacttatcattcctgaacgaaatagctgtggttctggctcaaatacatgttcattattttgctgaaaagaaaatatgaagatgttatatgattgtatgagtgatttttttctttgtcaggagaaaatgaatcactagtttctggtccgaattttattctttccaaaagaatgacaatagtagttagaaatatataaagaagtgaacagtgaaaataatcaagaatgggtagaattttagattctaatgagaactgatttttttttaagagatagtctctccct

SEQ ID NO: 30083 - DNA, 601 bp, Human
gaacgaaatagctgtggttctggctcaaatacatgttcattattttgctgaaaagaaaatatgaagatgttatatgattgtatgagtgatttttttctttgtcaggagaaaatgaatcactagtttctggtccgaattttattctttccaaaagaatgacaatagtagttagaaatatataaagaagtgaacagtgaaaataatcaagaatgggtagaattttagattctaatgagaactgatttttttttaagagatagtctctccctatgttgccccagctgttcttgagctcctggaytcaagcaatctgctcgtctcagcttcccaaagtgctgggattataggcatgagccaccatgcccagccaaaagccaattatttttaacaggagctatcatatacttagtcaactcttcagggacagatggaaaactaggcactctctatatttataaggaaacaacagtgacaatgcaagaaaatattgtccttatgattgaggaaatgggagtatccaaaattgaaactaaaccacattggcaaaaaagtttttaaacccaaagaaagaggggtactctgaaaggaggactagcattct

SEQ ID NO: 30084 - DNA, 601 bp, Human
ggttctggctcaaatacatgttcattattttgctgaaaagaaaatatgaagatgttatatgattgtatgagtgatttttttctttgtcaggagaaaatgaatcactagtttctggtccgaattttattctttccaaaagaatgacaatagtagttagaaatatataaagaagtgaacagtgaaaataatcaagaatgggtagaattttagattctaatgagaactgatttttttttaagagatagtctctccctatgttgccccagctgttcttgagctcctggactcaagcaatctgctygtctcagcttcccaaagtgctgggattataggcatgagccaccatgcccagccaaaagccaattatttttaacaggagctatcatatacttagtcaactcttcagggacagatggaaaactaggcactctctatatttataaggaaacaacagtgacaatgcaagaaaatattgtccttatgattgaggaaatgggagtatccaaaattgaaactaaaccacattggcaaaaaagtttttaaacccaaagaaagaggggtactctgaaaggaggactagcattctccccttaaaccaagt

SEQ ID NO: 30085 - DNA, 601 bp, Human
ggagaaaatgaatcactagtttctggtccgaattttattctttccaaaagaatgacaatagtagttagaaatatataaagaagtgaacagtgaaaataatcaagaatgggtagaattttagattctaatgagaactgatttttttttaagagatagtctctccctatgttgccccagctgttcttgagctcctggactcaagcaatctgctcgtctcagcttcccaaagtgctgggattataggcatgagccaccatgcccagccaaaagccaattatttttaacaggagctatcatatayttagtcaactcttcagggacagatggaaaactaggcactctctatatttataaggaaacaacagtgacaatgcaagaaaatattgtccttatgattgaggaaatgggagtatccaaaattgaaactaaaccacattggcaaaaaagtttttaaacccaaagaaagaggggtactctgaaaggaggactagcattctccccttaaaccaagtatggacttggccagccttaggagccaaacttcaagtgtgaccttgactgaagggatgatagaaaaatatgaataccaaagtactgaatg

SEQ ID NO: 30086 - DNA, 601 bp, Human
agggatgatagaaaaatatgaataccaaagtactgaatgaagggagtcaagtgaatgacgtaaatgaaattgacatatcacgtagatatcatcctactttaaaaaaaaaaaaaaactagctacagggatgcatccctgtagtcccagctgttcaagaggcttagatggaaggatccaggagttcaagtccagcctgggtaacttggcaagtccctgtctcaaaaatacatatattcatatcaatcaaaaaggctccccaaaaatctaggccacaaaaatctgaatcaaccatataactaaygttcttgaaacagaggtgctggtagcttcatggcatgaggtttggaaaagtgagtttccaggggaaaaaacaactgaaagataagaaaatagaaactgtgaaaaaggtgaattaaatgttgattatttttccattttcttattactttagaggaatcctgcagagaccacctttcagtctatgcagattttaagggaaaaaaaaaattttttttcaccttcaaatatttgagtacctgtttaataccaagcctggaacacaaattataagatgttggtttaaatttaagctattgtgact

SEQ ID NO: 30087 - DNA, 601 bp, Human
tgacgtaaatgaaattgacatatcacgtagatatcatcctactttaaaaaaaaaaaaaaactagctacagggatgcatccctgtagtcccagctgttcaagaggcttagatggaaggatccaggagttcaagtccagcctgggtaacttggcaagtccctgtctcaaaaatacatatattcatatcaatcaaaaaggctccccaaaaatctaggccacaaaaatctgaatcaaccatataactaatgttcttgaaacagaggtgctggtagcttcatggcatgaggtttggaaaagtgagyttccaggggaaaaaacaactgaaagataagaaaatagaaactgtgaaaaaggtgaattaaatgttgattatttttccattttcttattactttagaggaatcctgcagagaccacctttcagtctatgcagattttaagggaaaaaaaaaattttttttcaccttcaaatatttgagtacctgtttaataccaagcctggaacacaaattataagatgttggtttaaatttaagctattgtgacttcatttagaataattactatttgagattatggaatcatattccttagaaattttt

SEQ ID NO: 30088 - DNA, 601 bp, Human
tagctacagggatgcatccctgtagtcccagctgttcaagaggcttagatggaaggatccaggagttcaagtccagcctgggtaacttggcaagtccctgtctcaaaaatacatatattcatatcaatcaaaaaggctccccaaaaatctaggccacaaaaatctgaatcaaccatataactaatgttcttgaaacagaggtgctggtagcttcatggcatgaggtttggaaaagtgagtttccaggggaaaaaacaactgaaagataagaaaatagaaactgtgaaaaaggtgaattaawtgttgattatttttccattttcttattactttagaggaatcctgcagagaccacctttcagtctatgcagattttaagggaaaaaaaaaattttttttcaccttcaaatatttgagtacctgtttaataccaagcctggaacacaaattataagatgttggtttaaatttaagctattgtgacttcatttagaataattactatttgagattatggaatcatattccttagaaattttttaaaattaccacctgtacctaaatttctcccccaaaatacttttttttttccagattcaaa

SEQ ID NO: 30089 - DNA, 601 bp, Human
aaaaaggctccccaaaaatctaggccacaaaaatctgaatcaaccatataactaatgttcttgaaacagaggtgctggtagcttcatggcatgaggtttggaaaagtgagtttccaggggaaaaaacaactgaaagataagaaaatagaaactgtgaaaaaggtgaattaaatgttgattatttttccattttcttattactttagaggaatcctgcagagaccacctttcagtctatgcagattttaagggaaaaaaaaaattttttttcaccttcaaatatttgagtacctgtttaatrccaagcctggaacacaaattataagatgttggtttaaatttaagctattgtgacttcatttagaataattactatttgagattatggaatcatattccttagaaattttttaaaattaccacctgtacctaaatttctcccccaaaatacttttttttttccagattcaaatgtcataggcatttacctgcacctgttttggaatctatcttgatacatgaaattgaagtgcttcagctcgtctttaagtcagtagtggtttattaaacggttatatcacatctggaaaacattattcaa

SEQ ID NO: 30090 - DNA, 601 bp, Human
cttcccataattcatttatagcttttggtaggcatattacatatcttggaaggatggatgcgtgaagagatggatttatatatttgtatttgtcctggttccttggtcaatgataaaaatcctgttcacgaaagatggtatctttcctatttatgtactcaacatgactttttaataaagattgtagactaatgtagtggttctgagattgaaatggtattttcccagcagaggatgctttttccttcagtttgaaaattcttaagaagaaataagggaattaagatgaaatgaattaggyactagttgtctaacgtcgtggtgctcagagaatttgtcatgagtctgtaagaagttaggcattatatatttcttatatttaaatttttgactagattatatttgagcaagggaaaagtaaaacttacctgcaacatgtagatgttttgtaaatatccttttcttagcctagcagttcatcctgatcggatcacgatagcaacaggacaagttgcgggcacatcgaaggatggaaaagtgagttacgttaccttttcattgtttcataatgaactggtaacacaaagtaatttttagaaaa

SEQ ID NO: 30091 - DNA, 601 bp, Human
catggtgctggtgggagtgtagcagtgaggacaaccagaggtcactcttgtcgccatcttggttttggcgggatttagccggcttctttactgcaagcggttatatcagcaaggtttttatgacctgtaccttgtgccaacctccatctcattctgtgacctagaatgcctaaccacctgggaatgcagcccagtaggtctcagcctcattttccccagcccctattcaagttgctctggttcaaatgcctctgacatttctcccctcccttttataagagaatccttaatcctaagggtwgtaaagggacaaagatccatcttctgtaacttcttcgggctgaatagggatgatgatattcctgcctaactattagggtctcttgtatttggggtagagaagagctcagtcagaagacgtcagtatggcaaggtgatatctggaagattattaagtgttcaacttaagaaaacattgagtaagcttatcctgcattcctacacaaagagtgcaacagcaatatattccacaacagtaaaacaaaataaacaaaattatcccaagtaaactaagtaagaaggctttttattaactgggcaa

SEQ ID NO: 30092 - DNA, 601 bp, Human
tcgccatcttggttttggcgggatttagccggcttctttactgcaagcggttatatcagcaaggtttttatgacctgtaccttgtgccaacctccatctcattctgtgacctagaatgcctaaccacctgggaatgcagcccagtaggtctcagcctcattttccccagcccctattcaagttgctctggttcaaatgcctctgacatttctcccctcccttttataagagaatccttaatcctaagggttgtaaagggacaaagatccatcttctgtaacttcttcgggctgaatagggrtgatgatattcctgcctaactattagggtctcttgtatttggggtagagaagagctcagtcagaagacgtcagtatggcaaggtgatatctggaagattattaagtgttcaacttaagaaaacattgagtaagcttatcctgcattcctacacaaagagtgcaacagcaatatattccacaacagtaaaacaaaataaacaaaattatcccaagtaaactaagtaagaaggctttttattaactgggcaactattggaaccaagctgatatggggtcgctagctgattccagtgtgtcca

SEQ ID NO: 30093 - DNA, 601 bp, Human
tagggtctcttgtatttggggtagagaagagctcagtcagaagacgtcagtatggcaaggtgatatctggaagattattaagtgttcaacttaagaaaacattgagtaagcttatcctgcattcctacacaaagagtgcaacagcaatatattccacaacagtaaaacaaaataaacaaaattatcccaagtaaactaagtaagaaggctttttattaactgggcaactattggaaccaagctgatatggggtcgctagctgattccagtgtgtccagaattggaatactgatccagatayttacattacccattgcttttatttcttctgagccgcagtcagagatcactggttggttcacaggaataagcagggttagtttaaatagcagaaaaaacttaaaaacgactgatgaaactagaatctaatgacaaatgtaccatagttcttgaaacataatttctgtctccagtctcccatttttactaaagacaaaccataacaggactgattagtttggaaaaataagccttagtcttgtatacttggcttgattatttgtataaagtgcagcaagaataattatttttcacataggct

SEQ ID NO: 30094 - DNA, 601 bp, Human
gatgacagaaagtcttaggacagccacaattaaagccacaattgacaaggaaatttggttactcctggagcatacaataatttaacataacaagtacaactattaataacatacactaagtcatatcagaattataggagtttcacctaattttggaacacatgccagtaacatatttatacaaatacagcccaaagaaagccaatttcctatttgacaatgcttcctgtatgacttttataccaaataagccaaatttcacctttacattagtgtactattgatgttaaatattcttaayaaaatctcatagataaatctattcattttttttttttttttgagacagagtctcactctgtcacccaggctagagggcagtggcatgatttcagctcactgcaacctccacctcccgggttcaagcaattctcccacctcacctccctagaagctaggattacaggtgcacaccaccatgcccagccatttttttgtatttttagtagagacgggtttcactgtgttggccatgctgatctcgaactcctgacctcaagtgatccacccgcctcggcctcccaaagtgctggggttacag

SEQ ID NO: 30095 - DNA, 601 bp, Human
acaattaaagccacaattgacaaggaaatttggttactcctggagcatacaataatttaacataacaagtacaactattaataacatacactaagtcatatcagaattataggagtttcacctaattttggaacacatgccagtaacatatttatacaaatacagcccaaagaaagccaatttcctatttgacaatgcttcctgtatgacttttataccaaataagccaaatttcacctttacattagtgtactattgatgttaaatattcttaacaaaatctcatagataaatctattcwttttttttttttttttgagacagagtctcactctgtcacccaggctagagggcagtggcatgatttcagctcactgcaacctccacctcccgggttcaagcaattctcccacctcacctccctagaagctaggattacaggtgcacaccaccatgcccagccatttttttgtatttttagtagagacgggtttcactgtgttggccatgctgatctcgaactcctgacctcaagtgatccacccgcctcggcctcccaaagtgctggggttacaggtgtgagccatcgtgcctggccaat

SEQ ID NO: 30096 - DNA, 601 bp, Human
taatctaggcaaaaaaaaatccacatttccatgccttcttataatctattaccaaaagacatttcactttctttatacaccttacatataaaacagtttttatttcccaaaaattacttaattcatgtgaactgaaaggcattacactttttacttttcttacaaaatatttgatttaagcttattattattattacaccaattaatcaaagctctttcatatataaacatcacacacataatacatgtaaatacacagacagaaaataaaggactcattccctaagccaggaattgaacsctgatcccaggctgccactgtgatggcagagaccaagataaagtactgccacgtgttacaaggtcaagctcccaagcacacgaaacaagataagagagaaactttatccagttttttttcaggaacctgccacaaaatttataactgaccagtttgctgtgctactttgaacagtgggcttatagggtcctaggcccacattctatcctatggtacccctctttatgacagaatgatatagaagacaaatttataacacaaagcacaacagattttctacagcttaagattaccctcaca

SEQ ID NO: 30097 - DNA, 601 bp, Human
cttacatataaaacagtttttatttcccaaaaattacttaattcatgtgaactgaaaggcattacactttttacttttcttacaaaatatttgatttaagcttattattattattacaccaattaatcaaagctctttcatatataaacatcacacacataatacatgtaaatacacagacagaaaataaaggactcattccctaagccaggaattgaaccctgatcccaggctgccactgtgatggcagagaccaagataaagtactgccacgtgttacaaggtcaagctcccaagcacrcgaaacaagataagagagaaactttatccagttttttttcaggaacctgccacaaaatttataactgaccagtttgctgtgctactttgaacagtgggcttatagggtcctaggcccacattctatcctatggtacccctctttatgacagaatgatatagaagacaaatttataacacaaagcacaacagattttctacagcttaagattaccctcacaaatccttttttcccattaatcaaaactttacaggagataaatagtgatttttaccattcattcagccagtttgcagagag

SEQ ID NO: 30098 - DNA, 601 bp, Human
agagagagaaaggccagaagtctgactggtaagaaattcttaccattttgctggcatgccaggcttctgggttccctttccctgaggcggccctagtgatccagctggctgcaccacagccctaggggccaagccacatcataaaggaaaattatctttttctgtcctggccagagcaaaatatgtgtgacaaaacatagatattagccattcagctcagcacccagcacccaaaatcaaactggcagggctcagacatgcccctggtcggccccatcgttgttaatccagcctccaaccrggagcttcaacttacggtctctgggcaagatggtggccctgagtaatagaaaacataagaaagggaaaaaggagagagagaaaagcattccctgtggcagggcggggaaggtgaagagctcagggaggccagagaaagacctgcccactgcagtgacactgaaaagttcaggtggctgcctgttgataacgaagggatctttcccagcagtcccgtcagctcttaaatttccccttttggggaggaaaaagttccccatgtcccatgatcttgtacatgcctaattctgtcacccttagc

SEQ ID NO: 30099 - DNA, 601 bp, Human
attggaggtttcctcagtattgtcccttctgtggtctccagaaagatgtcactggaccccaccacttacccaaagtcagcgtttgggttgggggtttcctcagtgtcatcgcttcatggtcaccagaaagatgtgatcataaaggggtcccaatccagaccccaaaagagggttcttggatctcacgcaagaaagaattctaggcgattccataaagtgaaagcaagttttttaggaaagtaaaggaatagaagaatggctactccatagacagagcagccccgagggctgctggttgccyatttccatggttatttcttgatgatatactaagtgagggatggattattgatgcctcccctttttagagcatatagggtaacttcctgacgttgccatgacatgtataaactgtcatggtgctggtgggagtgtagcagtgaggacaaccagaggtcactcttgttgccatcttggttttggtgggatttagccagcttctttactgcaagctgttttatcagcaagatctttataacctgtgtcttgtgccaacctcctatctcattctgtgacctagaatgcctaaccatctgggaat

SEQ ID NO: 30100 - DNA, 601 bp, Human
cattttcccattcagagccgccctggcatagtggtagccccctttcagcgggctcattcccaccccagcccttgtgtatgacgccttcaccttagaatcgtttggccccgatccctgtcccatcatgggactttgaccccaggtcctgttagggttttttctcttttcgccatgtctgtaagattgttttcttcctcatttcatagccactacccttttaattcatccagtcatgtatttgctggctgttcctttcatttgcttggcacaccccgagtgcctgccacgtgctcgcacggcrcgtggaggcccggaaatgtgctcaggcgtgaggtgggcttgctgcctgagcccctgcagccgcaggaagggcaggtatgggcaggggccgccagcacgggggctcctccaaagtggcacagactcaggaaagaccagcgggagccccgagctaaaccccaaatccttcccaacaggattcctcctgcgaggggccccttgggacttctttgaccgcctctaatccgttttgcacaatatgtcaaattcccttgccttgactgacctttttctatttctattttctattggaagcctattt

SEQ ID NO: 30101 - DNA, 601 bp, Human
tctgccaccacctccctgaggcttgtttcgaggacccctttattctggtgctcggaccctgccctttaggctgacagcatagccccacccttctccccggtcagtaccctcctccgcttgctgtctgcagctttatgattccccagccacttggggttgctagaaatcgctttgtcttagagcagttaatctcacagcagaagttatgtaatagtagacagaaatgcaaggtgtgcagggtggtcacagaagctgacactatccagcttgggaccactgcgaatctagatgttattagtayaaatgaaaggttgtctggaatatatatatgttgtatggattaaatatatatataatttttttactacattctacagaaacaagaaaagccaaagtttgtcctctgtgtgactttctctgaaaacggtgacaccattactggagattcaagtggcaacatcttagtatggggaaaaggtaataagtgattgttcccaaaaccaatggtttttggtaatgttgtaagagatcaaacatgagtgctttaagaattgtctattaatacaacgtacaggagtaggatgaaatttcaagttacaga

SEQ ID NO: 30102 - DNA, 601 bp, Human
tcaaggatcttagagtttgaattggggctgaaggtggagacggacttgtaaatgcaatttcagaagcattggtgacatttccagtatccctgctgctcttggctctaggtgtcttattcactgctcacttaatccttagaacaatcctgcagggtaagcagcagccccattccaccaagggggaactgagggtagagtaactaagcaatttgtccagagaaacagctcactagagagctgggatctaaactcagagcccacgttctcagccgcgtggtgcttcaaccatgcggcttcaacratgcatattttccttcattctaaggtaacccatttcatgcttgtctggtgctctgcgaacgtctagaaattggatccttcatagattcatattgcaatgatgtgctcacggacaatattgcgttttaaaacctaagtcagatgagattagaaaatgggcagaggcaaccttttgacaatgtgctaatgatggttttcttggtgtgtttaggtacaaatcgaataagctatgcagttcagggggcccatgagggtggcatttttgcactttgtatgttaagagatggcacactggtgtcgg

SEQ ID NO: 30103 - DNA, 601 bp, Human
tgtgactccttttgatacccggtgtacctccccattatctacttggcagccctgcattccggtaggcaccagaggcaagatatttaatattccttctgcccactcagtgaattttctcccccaggttccaggaaatcgtgagcagacactgcaaaattggcctcattctgaagggtgatgcttttcatccctagcttagaatggacagactttaggactttgaacccagatacacacaaaacacttatattttacatcagagagcaacatggcaccaccctctggcagtgtgaaaatttgrttctgttgattatttcccttaataaaggaagatcttcatctgagctttggaaatcacttccccttgcctggagattctgttgtgagaacatttttaataataagatttgaccagcatttggttgaacatattgtgaattgctagagtcatagacatgcccaagtcatattataactgtaaagaaagctccaaagccccatctaatttcataaaagctattcactgtttgttagtatctgattcttcctcattagcatgggtcatcatcaacttgactcaaatctgtgctaacatgccaca

SEQ ID NO: 30104 - DNA, 601 bp, Human
tgggcacggtggctcatgcctgtaatcccagcactttgggaggccaaggcaggcagatcacctgaggttgggagctcgagaccagcctgaccaacatggagaaaccccgtctctactaaaaacacaaaattagccgggcatggtggtgcatgcctatactcccagctccttggaaggctgaggcaggagaattgcttgaacccggaaggtggaggttgcagtgagccaagatcacgccattgcactccagcctgggcaacaagagcaaaattctgtctcaaaaaaaaaaaaaaaaaaaaaagtcaacatctctgtgaattttgcaaaagaaactctgatgacctgtcagagtgttgaaatgccctttccccacgtgtattacttgagcactgactgtttgcatgccaagcactgtgcgtgtattatccttaatccctgtagcagctctgcaggttgaagaggttttttttttaactctgattttattgaataggaaattgaggtgtagagaagttaaataacttgccaaggtcactaagttagtgagtgacctagctagtgttagaacccagctcagtctgactcctaaactctggttctt

SEQ ID NO: 30105 - DNA, 601 bp, Human
caaaattctgtctcaaaaaaaaaaaaaaaaaaaaaagtcaacatctctgtgaattttgcaaaagaaactctgatgacctgtcagagtgttgaaatgccctttccccacgtgtattacttgagcactgactgtttgcatgccaagcactgtgcgtgtattatccttaatccctgtagcagctctgcaggttgaagaggttttttttttaactctgattttattgaataggaaattgaggtgtagagaagttaaataacttgccaaggtcactaagttagtgagtgacctagctagtgttagracccagctcagtctgactcctaaactctggttctttccactgcattgcactgcagcgaatcggaagctcattctctgttgccggtgccctaatgatctgtgcaatcccattgcacagaggaaatagcccttctgtaaaccaacacatcatcctttcatcccccatagagttactggcatgtcccaggtgctaggttcaagttttggctcccttcccttcattttcacggaaggggtgctggtcactggtggccagctgagccgtgaggtggaagggcccaaggggcaggcactgccactc

SEQ ID NO: 30106 - DNA, 601 bp, Human
gtgtccacttctcaaaattgttacgaggcttagatgaatgacacagacagaagtgctttgtaaatggtaaagcttcaagtgaacacgatttctgtttgtgtattagtggcagctctgagcttaattacagctcccactgtagaaagaaagcattgaaataatgtaatcatatatcaagtttctttctcttggttttttagattatccagtggatctcagggcctcctattttcattcccattgctacttttcttcctgatcttccttaatctcttctctcttcatcctaaacactcctgcmaagtgccctttatctaaaacacatgttcaatcatgtcactctttttattgaaaggacaagaccattcaaagtgttcttatttcctagtgatcaaagtccttaccatggcagtgacatcactaatgtgatatactctgtgctgtaagcccattgacctatctgccactcctcaaatatgcccacagctgtgttgcttccatcacttttactatattactgcccccttcaccatggtccaaaaaacgactggagtggccacatctcaccttcaccagtgataattcttcctctcctgggagg

SEQ ID NO: 30107 - DNA, 601 bp, Human
catgttcaatcatgtcactctttttattgaaaggacaagaccattcaaagtgttcttatttcctagtgatcaaagtccttaccatggcagtgacatcactaatgtgatatactctgtgctgtaagcccattgacctatctgccactcctcaaatatgcccacagctgtgttgcttccatcacttttactatattactgcccccttcaccatggtccaaaaaacgactggagtggccacatctcaccttcaccagtgataattcttcctctcctgggaggcccaagtccagtcgtctgtacygcgaagccttggcccagcttcccagtgtcacctcatccctccctcccctgtgtatctctttcatggatctctttcatggatcattccatcttgtatccgagttagtgatgactgtgtgtgtgttccactggatcaaaacctagaacatgccttgctcatctcatgatccttccaggcctccatagtgttttgcacccagtgggcactcacccagtctccgtgtcatggagttgggtgccgtggttgtctttctggagcaatcaagcacactattcagtgagcttaccactcagcacgggg

SEQ ID NO: 30108 - DNA, 601 bp, Human
agtgttttgcacccagtgggcactcacccagtctccgtgtcatggagttgggtgccgtggttgtctttctggagcaatcaagcacactattcagtgagcttaccactcagcacggggagtcaactgaaggggctgggttctataagctgtgactttgtagaagggcatttacctgtctttcatcagattactgtagaaatgagaggatgtaagacaaaaagggaaaaatcctaaaaggacagaaatttaagtcaggctcaatggcttacacctataatcccagcactttgggaggcagagrcaggaggatcacttgagcccaggaattcgagaccagcctgggcagcatagggagactccatctctacaaaattaaaaattaaaaaattagccaggtgtggtgacacacacctgtagtcccagctgcttcagaggctgagccaggagtgtcacttgtgctgcaataagtcatgatcatgccattgtactccagcctgtgcaatagagtgagatcctgcctcaaaaaagggtgggggtaggtagaaatttagcattattgaaacgcagcattcattcaagcaggaaaacatttttctctaga

SEQ ID NO: 30109 - DNA, 601 bp, Human
ttgggaggcagagacaggaggatcacttgagcccaggaattcgagaccagcctgggcagcatagggagactccatctctacaaaattaaaaattaaaaaattagccaggtgtggtgacacacacctgtagtcccagctgcttcagaggctgagccaggagtgtcacttgtgctgcaataagtcatgatcatgccattgtactccagcctgtgcaatagagtgagatcctgcctcaaaaaagggtgggggtaggtagaaatttagcattattgaaacgcagcattcattcaagcaggaaaasatttttctctagaaaagagacttttcaaatagagccatatagccctaaggaattagaagtgtgagcgtttgtgtgtgcacgcactcacgtgtgtgtgttttatgctatagtgttctatctgttcatcaatttacacttcctttaaaatattttaggatccagctcagtcttctggttttcatccttcagggtctgtggttgcagtcggaacactcactgggaggtaagtccatgccaacagcgcttgtgcttgcaaagcttatggaaaagaggcctgttgtttctatttccccaggaaca

SEQ ID NO: 30110 - DNA, 601 bp, Human
ttgaaacgcagcattcattcaagcaggaaaacatttttctctagaaaagagacttttcaaatagagccatatagccctaaggaattagaagtgtgagcgtttgtgtgtgcacgcactcacgtgtgtgtgttttatgctatagtgttctatctgttcatcaatttacacttcctttaaaatattttaggatccagctcagtcttctggttttcatccttcagggtctgtggttgcagtcggaacactcactgggaggtaagtccatgccaacagcgcttgtgcttgcaaagcttatggaaamgaggcctgttgtttctatttccccaggaacaggcccccgttcagctcttggctacatgttcgaagcttctaatgacttaccaagaattaagttaaaagcgaaacttgaaacagtggcccattacattttgagccttggggaatctgaggaaagccatagaccctctctcctggaaaaggaccctctacctccactagacacacacacactttttttgtttgttttttgagacaggtctctccttgtcacccagactgaagtgcagtggcacaatcacagcttactgcagcctccagggct

SEQ ID NO: 30111 - DNA, 601 bp, Human
gttagaaactgcagcaacagtttatccatttatccttatccatttatccatttatcctgaaaacaccaggggctcaccaccaccccttgagaatataacaggcaggagagttcagtcattctgatgttaacactcatttagtgggtactgtgtgcttatcagaggatacaaagcacttccatgtccattatcattcgactttaatattgagcctgcagagtagacctgggctcttctccccatctcaccactgaggaaatggcccagcgaggtgaaattagaagaccagtcctccactccratttctcccatttgctctgtgctttccctcgccctgttggttgcaggctagcatccccataaggcctgtactcttggcctgctctgtctgcagcaccattgggaacaccaccaccccggagttgtcccagccccatcctcctgcatggtcctgcttcgccctggaaacctgggtgagctcttgcaggtggtccttcactgcttcctctcaccatatgccctggcactaggtattggcatcttccctgcccagagctttctctccatgtgtaaatgacaaagcacaaacacagagaaacca

SEQ ID NO: 30112 - DNA, 601 bp, Human
ctaccgtggaacagtgttggcagggacttctaaggccaatgaaatgaagacagtgttttaccctcccagggtcattccagcttcattactcacctggactggtctgtaaactcacagttcctcgtgtcaaattccggagactacgaaatcctctactgtgagtaccaccccggggttgtatgaagtctcgatctcagaaagcgttcactctgagatccagggggcctctgtgagaacccacctcctgtatgacttaggcacgtgccatcatctctaggtcatggtttccgcctctgtaacrtaggggagtggggctgcgtggcttcttgggtccttcccggtttcctgctgactgtgagcccctatggaggagaagatccagggcctgccccaaggggaagaaggccaagccctgcagaggggggcttggggcaggcggatgtggcagaagggggcgggtccgggtggatgtggccgaagtgggtgggtccggagctgtccaggcaggaggagggcctgtaaaggtgttatcctcacaggagggaccatgaagtccatccccgctgggtggacggcagccctgggacccctcctcctcccc

SEQ ID NO: 30113 - DNA, 601 bp, Human
aaaggtgttatcctcacaggagggaccatgaagtccatccccgctgggtggacggcagccctgggacccctcctcctcccctcccaacctgaccctggccagtctctgggcccaggcagtgcttgggaacagcgaggatgatcgtggcgggcacttacaagcacatcctcatgccacgcactggttccttagacacccaccaggcacctgccacgtgccccactctgggccacgcagggcggcgcgtgggcacaaggaaggcctcgctgctcccctgctggaagttactggaaagcgcagygctcctcctctgcgtcttctcagatgacctacagcactttctggcttggccgcatgatgcagggaagggctcagagcccaaaacacaggccccaagagcccacgggggtgggcgggtcacactcacttgagcgtccccacttgttgaggaccaggacaggcaggaccactggcggcagggaaagcagggcagtgtgtaccgagactgagctcgctccagtgcggagggcggccgcaccgtctcacctcctccctgtccagctcctgcctgacacaggcacaggaacggtatgattttcag

SEQ ID NO: 30114 - DNA, 601 bp, Human
agccctgggacccctcctcctcccctcccaacctgaccctggccagtctctgggcccaggcagtgcttgggaacagcgaggatgatcgtggcgggcacttacaagcacatcctcatgccacgcactggttccttagacacccaccaggcacctgccacgtgccccactctgggccacgcagggcggcgcgtgggcacaaggaaggcctcgctgctcccctgctggaagttactggaaagcgcagtgctcctcctctgcgtcttctcagatgacctacagcactttctggcttggccgcatsatgcagggaagggctcagagcccaaaacacaggccccaagagcccacgggggtgggcgggtcacactcacttgagcgtccccacttgttgaggaccaggacaggcaggaccactggcggcagggaaagcagggcagtgtgtaccgagactgagctcgctccagtgcggagggcggccgcaccgtctcacctcctccctgtccagctcctgcctgacacaggcacaggaacggtatgattttcagggacaagccctgggtctagagccttctcagatgtggtctcgtactctgctggtgag

SEQ ID NO: 30115 - DNA, 601 bp, Human
aagttactggaaagcgcagtgctcctcctctgcgtcttctcagatgacctacagcactttctggcttggccgcatgatgcagggaagggctcagagcccaaaacacaggccccaagagcccacgggggtgggcgggtcacactcacttgagcgtccccacttgttgaggaccaggacaggcaggaccactggcggcagggaaagcagggcagtgtgtaccgagactgagctcgctccagtgcggagggcggccgcaccgtctcacctcctccctgtccagctcctgcctgacacaggcacrggaacggtatgattttcagggacaagccctgggtctagagccttctcagatgtggtctcgtactctgctggtgagagctcatttggggaacacacaagtcccctgggaggcccttggtttgactggtttcaataacctccattcctgacactgatctgaagggactgaggggtatagggaggcgagggggcctgaccgcagaggcagagctgtgttcaggggctcgggtgggggtgggcagcaggcggagacccaggaaccagaggctagagaagccagactgtgggaaacagacttgga

SEQ ID NO: 30116 - DNA, 601 bp, Human
ggtctagagccttctcagatgtggtctcgtactctgctggtgagagctcatttggggaacacacaagtcccctgggaggcccttggtttgactggtttcaataacctccattcctgacactgatctgaagggactgaggggtatagggaggcgagggggcctgaccgcagaggcagagctgtgttcaggggctcgggtgggggtgggcagcaggcggagacccaggaaccagaggctagagaagccagactgtgggaaacagacttggacggagatgggaaaaaaacaaagaagagggcayctccacccaggcccatgggctcgggctcagttccaggggaactcacatctgtgcacacgtggttcctgcccgactgggaagtggaaggtctccctctccaggaagggctctgtacccaacggggcacagctctgggggctcagccttgcttaggggaggggtggggccttggcttagatgttgccagactgtttgctttttgcaggggttccctctgcctgtaagcaagtcgtaagtgtggaaactacaagagacattgaatgggctacctatacctgcactttgggattccatgttttt

SEQ ID NO: 30117 - DNA, 601 bp, Human
aagggctctgtacccaacggggcacagctctgggggctcagccttgcttaggggaggggtggggccttggcttagatgttgccagactgtttgctttttgcaggggttccctctgcctgtaagcaagtcgtaagtgtggaaactacaagagacattgaatgggctacctatacctgcactttgggattccatgtttttggtaagtttgctgcagatttcactggttccaacaaaagagtgtctccttttaaaatatttcttcagttgctacggagtctcatggtcaccagtcttgtcagaytgctcggctgctacgggaggcccatgagacacacctcctgccgcaccctggggtagggcctgggcttgcctggccgtggcccactgagaagaaccagagagatgggtttttaacccttctccactgtacagggcagcaggtcctaagataattccctggaaccctctcctatcaggttgtgccacatggacctaggtggaccagatggcactcagtcaacttaccatttgtgagggttattatttatatattttttgttcttaaactaaaaatttcactttcttcaacattcactttagg

SEQ ID NO: 30118 - DNA, 601 bp, Human
ggctattgtgcttttttgacccttgtttctaaagctggacttcaggcagtttcatgttcaggaccgttcagtgggcgcttcctgcgccatgtggccctgtggcccctggtgtttccagcgccctgtttgtggtctttgttttaggagtgtggccagaaggctcggacggaaccgacatcaatgccgtctgtcgggcccatgagaagaaactcctgtcaacaggcgacgactttggcaaagtgcacctcttctcatacccctgctcgcagttcagggtaaaggacttgtttcttcactaatmttatcccccatggggcatgcacgtacacccgacctgtttggagactaagtggaaatgggctgtgagcgactgctgccagccacaaaggcagatgtgactctgttctttgcgccctgagcacttccagccgcccttagggaaaccccaagccccacaggacccacaaagccgttcagagctgctcatccacctctgcagccccacaggctcacgaccccgccctcccccacggctcccttgctccggccctgctcagccgcgccagccctgagccctgggacgcccttcttcatcctccgt

SEQ ID NO: 30119 - DNA, 601 bp, Human
ctttgcgccctgagcacttccagccgcccttagggaaaccccaagccccacaggacccacaaagccgttcagagctgctcatccacctctgcagccccacaggctcacgaccccgccctcccccacggctcccttgctccggccctgctcagccgcgccagccctgagccctgggacgcccttcttcatcctccgtgatcctgaccctggagacccctcaccctcagccccgggcatctggttaggcccacctttggggcgacctcatacctggcacctctgatactgagcatatctctcrgctgagggcggtcatttgctcgtgtctgtcccctaccaggccacgaggactgtgggctttgtttctgtgtcccttctgtgtcacacacagagcaggtacccaagtgagagctgccgagcggagggcgagtaaaggaattaaggcatgcagtgagaattcaagcactttcccatcccagatggttcgccttgtagtaaaggaagctttcccccgtatcattccctccaggctccaagccacatctacggcgggcacagcagccatgtcaccaatgtcgatttcctctgtgaagacagccac

SEQ ID NO: 30120 - DNA, 601 bp, Human
acaggctcacgaccccgccctcccccacggctcccttgctccggccctgctcagccgcgccagccctgagccctgggacgcccttcttcatcctccgtgatcctgaccctggagacccctcaccctcagccccgggcatctggttaggcccacctttggggcgacctcatacctggcacctctgatactgagcatatctctcggctgagggcggtcatttgctcgtgtctgtcccctaccaggccacgaggactgtgggctttgtttctgtgtcccttctgtgtcacacacagagcaggtwcccaagtgagagctgccgagcggagggcgagtaaaggaattaaggcatgcagtgagaattcaagcactttcccatcccagatggttcgccttgtagtaaaggaagctttcccccgtatcattccctccaggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacac

SEQ ID NO: 30121 - DNA, 601 bp, Human
ctgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgtttcaccatctagcttgctaagtcaaatatttatgatgataatgaggtactgaaccaygatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacgcccacctggcttgc

SEQ ID NO: 30122 - DNA, 601 bp, Human
gaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacrcccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtc

SEQ ID NO: 30123 - DNA, 601 bp, Human
tctgctcggtccgctctctggttaaaccctcaaaagagcgcgtatcccttcccgctcggagcagagtgccgacctccctttgcgcccgcggaggcgcagtccctcggctcacccggacgctgggggccaggcctaggactccagggctccgcgccccggagtcctgtgggccaacaggtgatgggagaggggctagactgggggcgcgccctgacagacccaggcaacgaccgcgcgggcaaaggctggcgtcccggggctggggcggggccgtcggaggggcggggcgggggctgccagrcgggcgcgccagccgcgccaagcatccattacgcctctgccagacctgggcactccagggagccggtggcgccctcgctcgagaaggagtcgggaagaggagagtggctttcgggaagaggagagtggctttcgggaagcatctcctctgaggaagaggcggcggcggcggcggcatttacggagagaaaaagtaagcagctgcactttgccttcaagcgtcagactctgacacgcgctccctgtagcgatgataactgaccaacccgagagaacgtgcacaaggaaagtgagggaaggg

SEQ ID NO: 30124 - DNA, 601 bp, Human
ccccaagttctaagtataccctctctaatcagggaactcaatgtctcattataaatgcaacataatattggacaagatatttggaattaaacagtttatacatgaagagtgtgaataattaccctggagggaagggaaacgttttgtttcttattttaaaaaagtgatattttatgatgaaaaaaacttaccccattgggtggagaggaaatccactccaactctgtttgttgtgctttagaatccagcagtagtactgaaaaagaaagttgtatttccatatgttacatgaaacacttamgcacacatgtagacatttttaaggtgaatcttttcatataactatcactatatgacttaagatctgtagttatttatgtaaatcaatggtgaaatgaacaccctcctgatacatgtatattccacttccttaaaggaaaaaagatattaagacaccaatattatatttggtatgctttaattacaatattaaatcttaaaatgcaatattagaatgagggtagaaattttatatgtgatacattaattccacagtaattatatattacggttttgtaaaccattgagctgttcaaatttg

SEQ ID NO: 30125 - DNA, 601 bp, Human
agataacattgacagtcataatttgtcattttgtgtattacatggatgaaatactacaatcatatatcagtttacttctcctcagagataaaaccatcctctatctctatttgttttaattgatggatggtagaaaatgggctacatctgtcattggcaagaaaggtgtttcattttttatcatgaatggctgtctataatgtatattattttacttacagaaaccacttatctcaagaaaggtgttatattcatacctccaactcatggaatttttatatttaatctgtaaaatggttgycattgatttataatttatcataaccaatacagataaccacaatatgaatgaaaggaatcttaaaaattaaatttaatgaaaactctaaatatcttaaacagatttgttttgttcatattttacattcttaaactttcagttcctgacatgctgattttatgatctcaacaatctctttcaaactttcattcttctctttgcaaaatatgctacagtttttgtatcataacttacactccacacggtttttaataagccaaagataaacacaaatagcaatagggtatcttctcctttctc

SEQ ID NO: 30126 - DNA, 601 bp, Human
attcagaaatttctttgatgatgttatatatttggtgtgattttgttatacacagtctaataccatcaaaggtactcaaatgtagtaaagaacccattttaatgttcagcttttactcagttcaacttgcatttgtgactagttaacagtgtgcctagcttccctttgtttcagttagctgcctacaatctgaatggcaatcagccaaacataaccaaattcatccatttggatggctagatttcagtctcttaattagattgaaattgctaaaagaagtaaaactagtaatgatatctaycaaaaaatcaaaagctccaaagataaatgtgctcctttttaacaactctgcagtttgaagaaaccaaagctaattattttaaaagaatatagcctaagaattcctttatctaacttcgagaacaaatttattcatttattctgtataagaaaaatcaattttactacccttgaaacccaattaatttttatttttatttaaaattttattccagaggggaatgcttcaggaaaactatgatgtagactacaaacattgagactacataaattcatttaacacaactgttgttttattatc

SEQ ID NO: 30127 - DNA, 601 bp, Human
atttttggtagagacggggtttcaccatgttggccaggctagtctcgaactcctgacctcaggtgattatgatccacccgccttggcctcccaaagtgctgggattacaggcatgagccaccctgcctgactgaccctaataacttttaattttacttatgattcttatgagatacatgtgaaaaatattaaaatgcatcttaattttgcagacacggaaataacaccaaagttgatgtaagatatatttatattactaaacctatctgcttatgaaagaaaattttatcttaatattttmaaataattttaatatttaagtataattaagaatgtatcacaaattcaatatctatttcattgatgtcacaacagtacaaatgagtggaagggattggaaagtcctttactttcataatacaactcacttgtgcatgcaacgtatggtgggtcagatggagccctgtaatacccatcttcacattcacatctggaggagccttctttatcagaaaaactgtgagttggacaacgagagcactgaagatcttgagaggaagacttgtagaacccacggccacaggctgggaatgcaaaagaa

SEQ ID NO: 30128 - DNA, 601 bp, Human
tatagcaatgtctgagattggctttggatttggatctctcaaacattcattaattgaagaaccaagatgtgagatttgctctatttagtgaggtctgctctatttagtaatggaattttaattcagaaaccattactttttaataacatttaatatccatgcaagaccctaataacttttttttttttttttgagacgaggtttcattcttattgtccaagctggagtgtagtggcacaatctcggctcactgcaacctccgcctcccaggttcaagtgattctcctgcttcagtcttccrcgtagctgggattacaggtgggcgccaccactcccagctaatttttgtatttttggtagagacggggtttcaccatgttggccaggctagtctcgaactcctgacctcaggtgattatgatccacccgccttggcctcccaaagtgctgggattacaggcatgagccaccctgcctgactgaccctaataacttttaattttacttatgattcttatgagatacatgtgaaaaatattaaaatgcatcttaattttgcagacacggaaataacaccaaagttgatgtaagatatatttat

SEQ ID NO: 30129 - DNA, 601 bp, Human
cagttaatgcacctaaaaaaaacagctgtgcagtagtttaaaaatagttctccttttaaccacataacagggaatacatttattcattttaatgtactcaagaatgatttatagcaatgtctgagattggctttggatttggatctctcaaacattcattaattgaagaaccaagatgtgagatttgctctatttagtgaggtctgctctatttagtaatggaattttaattcagaaaccattactttttaataacatttaatatccatgcaagaccctaataacttttttttttttttttgagacgaggtttcattcttattgtccaagctggagtgtagtggcacaatctcggctcactgcaacctccgcctcccaggttcaagtgattctcctgcttcagtcttccgcgtagctgggattacaggtgggcgccaccactcccagctaatttttgtatttttggtagagacggggtttcaccatgttggccaggctagtctcgaactcctgacctcaggtgattatgatccacccgccttggcctcccaaagtgctgggattacaggcatgagccaccctgcctgactgaccctaataa

SEQ ID NO: 30130 - DNA, 601 bp, Human
tacatgtatttatctcaaacgaaagacctaggcataactcaggtgacacaaacatcacgcatgcgtgcatatacattacaatataatacaatacaatattattattgtcttttagttgcctaatatgcaaatttagtgaatgtagatttctgtaaggccaaaaaatgatttgaacatatttattctagagaaaatatttgcaaaatatttcagatttatattgtaagaaactttactcttaccacctatgtgtttcattgcttttgaaattggatgcaatttaagcagagaatataactgwtagctctcatgggaaaacagatataccaaaaccagcattaaaaacaataatcccctctaaaacacatttgttgggacgataaatgaagcatataaaatgcaaccttagccatgaagtcatgaattcataatgtaagtaacaagcaaaaatattttaaacttaatctgaacattaaaacaaaatcatattttaaactaatttttctttaaaaaaacaaaggtatctattgccaatgtactatatacatttcaatttatttaatcatgtccattcatccccaaagttttctcaaagctttaa

SEQ ID NO: 30131 - DNA, 601 bp, Human
atcctatcattatcaaacatattttatgtgcatatatagtaagattaagaagggaataaatgtaaaaactcaagcatataaaaactccatcaaaacaatatttaaataaataaaaatttaaatcttccttgatatgattctcacaagctatttatgaataaaagttgtaaaaattatacttcataatatacaatattagagagttcttatttggtgtataataaatacatgtgttcaactttatctggcaatgaaattcttcattgaaatcttaaaatgtcaatcaagttgtttgatttgmcttcacagtgagatttgcaaaagtgtaaataaatatatacttaagcttgattcactcaaactgatctgtgattgtcctcattataatcatttataaaaatgatagtttgtattacatgtatttatctcaaacgaaagacctaggcataactcaggtgacacaaacatcacgcatgcgtgcatatacattacaatataatacaatacaatattattattgtcttttagttgcctaatatgcaaatttagtgaatgtagatttctgtaaggccaaaaaatgatttgaacatatttattctag

SEQ ID NO: 30132 - DNA, 601 bp, Human
cttgtccacctcactacacattctggcttcatttgtgggtttctgtgaagtagctgctttgatggacacacttagaataagattgtttcgaggtcgacaaacacatcttgtgtcaatacacaaattgaatcagtcctgcttctgtttctaatttcacctttttcaaaaaataaatcttgtatgcgttaaagaaactaatttaaatcacaaggttctaaaattgctaaacaaaacagcaaatgttaaattattatgaacttttacaaagtacatttatatgtacatatatatttatttgtawatgtaaaaattatgatggtgcaaatgatcacctcaatattgaaaaaaatattaatatatgctagagttattgagagtaggaatccaaaccaaaggcataattaccttcaaacattttacctgtagcttcctctagtgtagcaacatcaagtctgggactgtaatttccataaccagcagcagtaaaagcccgaatctggaaaacatacactgttcctggtttcagattattaatggaggctgaagtagacttggtttttactgttgagtaggtccgttccctttgatcctagaaacaata

SEQ ID NO: 30133 - DNA, 601 bp, Human
aaacattagttaatgcaaaggatatttatcaatttactccaccttttgaagatctatacaattcttcctttaaagccaaaataattctttaatcaaaatattaatttaatttgtttaaatatttttaattgagaaaagtcatataatattttccaacttaattttgattagaattttggaggaaggctggattggcaaggagaagagataacacctgggtaaaccatgtgcctgagcagtaacatcaggaggaatcaaaactccaaaatatagaaacatgtactgagacatcagctctgtkgaggagcaacagcagtggtattcagggtgttctgaacttggactctgacagcaaatggggacatccatcccaagatatatctgcttacttcttatacactatatatacacatgcatttttactataatcttgttgcattgtaaaacataaaatgataaaggggcttcaaagatactggttatattctatttttaagatgagtggtcatagggatattcatttaattatctcccttatatttcatatctactttaaatagattccttagtatgcatgaaatattccataacaaaaatgaaa

SEQ ID NO: 30134 - DNA, 601 bp, Human
ttactagagcacattttaacactaaccactcaaatgtttaaatgttgaaatcttaacttaaaatgctttaatgttttgggggacactaaactttgatatgctgattcttgatcttatataatctatttaaaaagaataatcatgaataatggtattaagtttaccacatcaaattatgtagtaaatttttaaactgatgcctttatgtttacaactctatgtgaatgatttatatgtcaaaatgatttcagcatacgtttttattatttgtggctataagagttacagatttattttaaartgtaacaaaatatgtggaagaataatactgctagcaaactttacaaacattagttaatgcaaaggatatttatcaatttactccaccttttgaagatctatacaattcttcctttaaagccaaaataattctttaatcaaaatattaatttaatttgtttaaatatttttaattgagaaaagtcatataatattttccaacttaattttgattagaattttggaggaaggctggattggcaaggagaagagataacacctgggtaaaccatgtgcctgagcagtaacatcaggaggaatc

SEQ ID NO: 30135 - DNA, 601 bp, Human
gtgagataactgacattttaagtttaaactatttattaaaagatgaaaaacataatttgaagtatcttattatatctgaatttacagggtgatattatgatatagatctgagttgaaaattactagagcacattttaacactaaccactcaaatgtttaaatgttgaaatcttaacttaaaatgctttaatgttttgggggacactaaactttgatatgctgattcttgatcttatataatctatttaaaaagaataatcatgaataatggtattaagtttaccacatcaaattatgtagyaaatttttaaactgatgcctttatgtttacaactctatgtgaatgatttatatgtcaaaatgatttcagcatacgtttttattatttgtggctataagagttacagatttattttaaagtgtaacaaaatatgtggaagaataatactgctagcaaactttacaaacattagttaatgcaaaggatatttatcaatttactccaccttttgaagatctatacaattcttcctttaaagccaaaataattctttaatcaaaatattaatttaatttgtttaaatatttttaattgagaaaa

SEQ ID NO: 30136 - DNA, 601 bp, Human
tctgaacaaagaagattatacacattctctaatttatcacctgctgaattgctccctgagggaacttaaaaaggttaaaaaaacagaagaagaaaacaactttcaaatactaatttctgaattacagcctattatcacacaacagagaaaagatgacttcaagtcttttaaaaatttgcttattttttgtttttagtctgttttttaatgtacattttaagaaagaaaaagaatggagtagttccagtcatgaggaagaaaaaattatgtacatatgttatgaaattctttccattcaacygatgtgtcccatgggcctaattctctgcttgtcttaggctcagtttttcccttagcttcagaaagagaactctaatgagaaaaatgaactcaggtgaatgatgaatcagaatttgtgcatatttatttatacatttttgtatattgtcagggtcgtactttaatctttccatagttgacattatggttaatattttcatctatttcagggcaatacatattaaaagtaatttgctaaggctataaacagaatgtcatggtttaaaaactcgaaacagtagataggatactgcacagaagg

SEQ ID NO: 30137 - DNA, 601 bp, Human
tctgacagtctctttgggaagaagtacatgtttgcatgtcttttaaaacaccttctgatatagaatttttgcacttatcacttccatttttccaaactagtgaagttttatttatatgatgattcacaattgtcatattttcccagagtttcatattttcagtagcaatacagactttataaaatcatcaaggacatatgaaacaatgaaaatgaatattccaataaatgatccagttgcaaatatcataaaatacataatgtcaaactaatataatttgctatctctgaaacaatcaagrgctgcaatctttaatttaaggcaggatgggaaataccattccttcttgttgatggcaagggactagatctctagagaagtaattcatatgaaggcaaaacatatcttgccacaataggaagtataaagtttttttcagattggcctttctctagtttgtctgtctccttttgacaacttatctcttaattttgtatacctatgctaacaagagatagctcctgtgttgaaaaacaggaaaaatcgctctggtctaatagatactttctgaacaaagaagattatacacattctctaattt

SEQ ID NO: 30138 - DNA, 601 bp, Human
tattttattttttcaaattcacatcacatgattttaattctaaacatctgattcaaatgctttaaagcaacattttgagctcatggtataatttcaagcatgatgcatgaggactttgttaatgccaatgctaataaccagatttttctgttaataggggtacatcataataaagaaaagccaaacacttacaatgaaagtaaagctcttcatcgccttcttggtcagctttgctataaccacagtgccttgaagaaagcaaatttgtgacaatctcagtcattttactttatatatttamtattcagtacaatgtaccttagttactcaacaacttactagagttaaatttactgttcatagttatgaatccatttagtaataatatagcgattcacgattaaaattgcaaagaaaacaaactttttgtgtgagaaaatgtaaaaggaacattttaaaaaatacatttagattgaatacacaaaattcagtatgatttgaatccacaaggttcaatttacaaaaatattcatgagtcacaaatagtcacaggtgaatgtttacttatatttctttctggaaaagaaaaactttttaaatg

SEQ ID NO: 30139 - DNA, 601 bp, Human
actttaggatgggtataggacagtatcttcacagatattgacataagaatctaataaataacacaacaaaagatacaattcttacatcttatgtcatgggaaatttatctacacatgagaacatttgccaaagattatgggtactacaaaataataataaaattggtttttaatattcttaaggattaaaaatggggaaaataggtaaaggtaagaacatcatcaactatcataactgaagtaatttggttgttaggttttgattttgcctacataaagtaataacagttactctcagtgmtctcattttcacatgccatcttgtttcattgcaacaagaataagattaatgcagataggcatctattttatttgggtccctaagctttcttctaaatatgatttctaaaatgaacttttaagaataagctaactcaaatccataggaaaacatcagaagtatgaatcttattattatactatttatgtcctatgaaatatctatcaatgataggtaatttatagtagctgaagagaaagaggctccttaatttagccttttgtggtagcatcactcattggattaaaaaagggcctatct

SEQ ID NO: 30140 - DNA, 601 bp, Human
actgccccatgatgcttgcttcacacaaaaagtctctcctttgtttttctgtgtaaccaactttcagggtttttatggctactgcaacatctcttttccctggaagtttcaaacggccactgcagacttcaccgaattctcctgaagtaacagaacaagcaggcatattttagtttctaaatattgtaattttcttttaagagtaaatgcgttgaattatttttctttaacttttagtaaattatttgaaagcattttaaaatattttcaaaaatacttggtaaagccctgtgagttacaytgaatacattcccatatataggggagtctatttcctagacacaaaagttgtttatgaaaataatggcataaatgaaattaaaacttgaagatacagttcagagctctttcatagaagttacgctttcctaaactgttaaacaggctactatttttcaattgaattaaccaacactcagggtcaacatttagatttgaattatgctattatatattatatatttaaaaatttttttatatatattatattagtatattacctagactacctactaaagcatgaggacacatcagcaaattc

SEQ ID NO: 30141 - DNA, 601 bp, Human
ctcttgaagagaaataaaaacatttatcagtcattccatctatcagagttattcttcaactctaatcttgcattcattttttttctgctttcttttcccttgaggtgataacataaaggaagaattttttgattagttacataccaagaaaacacattcatttagactgtgcaacatatttcataatttgttttattgtgtacataataatactaatttctgacactcagtctttttgataaaataaagatataaccaatatctacctcttgtaacaaccccttccaaatggacaacattygggtggtcaaactgccccatgatgcttgcttcacacaaaaagtctctcctttgtttttctgtgtaaccaactttcagggtttttatggctactgcaacatctcttttccctggaagtttcaaacggccactgcagacttcaccgaattctcctgaagtaacagaacaagcaggcatattttagtttctaaatattgtaattttcttttaagagtaaatgcgttgaattatttttctttaacttttagtaaattatttgaaagcattttaaaatattttcaaaaatacttggtaaagccct

SEQ ID NO: 30142 - DNA, 601 bp, Human
agctaagtgttttccccacatgccaaaaagtctaaataatataaaagtatataaagaaattaatatacatataataaggtttattttcctctaaatgctaaaaaagagcaacgggggaaatatttgaggcaaaatgaagagaaactaaaatgtagaaagtaattgtagtggccactttgtttccatttcattttttcttagttttgctactgataggagcattacttgtaacaaggattctctaggacagatgtactagcaaatgggattgagaactgtttgcaaccagactggccacttycaacccattttaaccaaaaaattactccagctgaatataaacatgctggatgaagtatgctagtctgagttgattaattttctagttgatacttttatcatgatgatgcagcaataaaagtttctctaaatcctatgactgtttatacgcctgagttaaatatgattctagatcatattaaataactttgcatgttctctttttctttagattattttttctttgccatttggaaaaatgttcacatgttaatattcttagttaaaaagcctctgagaataaaaatatctatgtttatat

SEQ ID NO: 30143 - DNA, 601 bp, Human
gagttcaagatcagcctggcaaacatggtgtaaacccgtctctactaaaaatacaaaaaaaattatccgtgcgtggtggtgggcgcctgttatcctagctactcggaaggctgaggcaggagcattgcttgaacccgggaggcggaagctgcagtgagccaagattgtgccattgcactccagcctggacaacaagaacaaaactccatctcaacaacaacaacaacaacaacagccacaacaaagacaaactaggcaaagttactatgaaaatgaaataaaatatggataatttaaatamattctcacatattttctttttttctaatcttacaaaagttataaggattagcatagttaatattcctttaaatctttatttaaaatgtgattacagttttctacaaatatgagtgctagtagctagatgtttttgtacgtaactatattctatgactctcccaatatagggcagtcatgttatcaacactttccttcttagtctatatatatattgtacaaacaatgattcttccagaaaaacaaaaaacaaaaaacaaaaaaagcaacctcaaaatgcttagctcaatttgcttcattt

SEQ ID NO: 30144 - DNA, 601 bp, Human
tgtggacttctcagttaatgaaaaaatttgtagggcaagtatcaaaaataaccttatcaacaacatataaaacagtctaattgtagttgtctaaaaatcactactgtaagttttaagacccaatgtagattttccttaaacactacttatttttttgactccacactccaagaatttgcattagtatcatttccagactcctctgaaaactccttcatcaatttgtccaaacctacatcttcatttctaattaccacaagtgtactacatctctgttatagaaaagtgagtccatttgatyggtcttcatacacctctaaaccttaacttctcaactttccagtgtgcttccttagagaattggctcatcagctctgaaccaaggtatccaccagatttttagtacaatcctggatatcttcctagatttcatactggctctacatttatctaattttcactcatatttcaataggttgaactataagtgctcttggcctacaaaatggccattttaacaaactcaacctaataaaagcaactttttttttgcacttttgctatattgttttataagtggtctcttggtgtgagatgtata

SEQ ID NO: 30145 - DNA, 601 bp, Human
attatctaataagaagaatatgaatatcaatttcactgtacaaactgacctatctaggtaatctctcactgctaaacaaacctgtgaccaaatttattaattattttagaccttctaaataaaaaaattaaagaatgtgccaaatattttaggttaaaactaaactgcacaatagacataattatgtcatttgactaataaaatattaatccttggtatagtaaggctatattcataatgttcatttttaagaaaaacaaaaaacaatacttaacacattttaaaatttaaaattggagawattaatttttttcttcttaaccatttccattatttgtttttggaagttaagtgaactctgaatttgtcagtcctgtcagtccctttatgtttgaatccaatacagaaggaaggtgtcaaaagaaatgaaactccatggagtgtctagggaatgtaaatatttctctttctctgccctaaggatttgtttgtccaaattttgacagtccatgaaatctttgacactgagacctgtcaaatattaacaactttgcctctgccaaacagactcatcatttagacttttatctttgaaaaacaa

SEQ ID NO: 30146 - DNA, 601 bp, Human
tcttcaggttacaaaaacctcaccttatccagcattcagcctggaactgtgtggacttgcttagaaatgtaaccatcactgtacatcttgttttcttgtgtcttgtaaaaaatcttttaaaatctgaggcatttaaaatttgagggctttctaaaatccctgacaaattcctagcaactaaattttaataatgtagagttaattggttcacttgataaatccatctaggctaattaaaagacaatgaatacatctgaaaatctgaggaaggcaaccttcccagaaaaaaaataatatattsacacatacacagcagtttccacatgtatcaggggttcacaggggttcatagatctaagtctctccatgaactcctaccacagattcctagaaaaaagcttttatctagaaaattttatcccagaatggaaatcattatcctaaattatctaatttttctccatttgcatattgaaaattaaacatataattgttcaaatagcactctactgacataattataaaataatgaatattatctaataagaagaatatgaatatcaatttcactgtacaaactgacctatctaggtaatctctc

SEQ ID NO: 30147 - DNA, 601 bp, Human
aaaatactgctagaagaaaaaaaatctatatagtaaaaaacttcaaaatttcataatttgagggtaaaaagttgatttggatgaatcaagatataaaattcagttaaaagatggctgctgtgaaaaccaaaaggatattttcaatttccacaatatttcttatatttgactacatttacatacatgaagatttttctttgaaaagtcattaatggaaagagctaaatgtttgcagattttttagaagaacgaaagttggaaatttatttggaaagctcaacctcttggttttaattgcaastaactgaatccgactgtttccattgtagttaaaacttaagaaaataatagacacataaaaatacaaatgagtgcccattcaagggttaactaatggataacctatttgagtatgagtctggtcatgtataggtatattagttttccctaggtttttcttgttcattgccttgtccagagttacacaaactgttcagatagtccagaactttctcactcattagcttcttctacaccacccttttgtgtctcttcaggttacaaaaacctcaccttatccagcattcagcctggaactgtg

SEQ ID NO: 30148 - DNA, 601 bp, Human
gctagtagtattttttcttatattacaatacattaaaatactaatgtaagaaaaatactgctagaagaaaaaaaatctatatagtaaaaaacttcaaaatttcataatttgagggtaaaaagttgatttggatgaatcaagatataaaattcagttaaaagatggctgctgtgaaaaccaaaaggatattttcaatttccacaatatttcttatatttgactacatttacatacatgaagatttttctttgaaaagtcattaatggaaagagctaaatgtttgcagattttttagaagaaygaaagttggaaatttatttggaaagctcaacctcttggttttaattgcaactaactgaatccgactgtttccattgtagttaaaacttaagaaaataatagacacataaaaatacaaatgagtgcccattcaagggttaactaatggataacctatttgagtatgagtctggtcatgtataggtatattagttttccctaggtttttcttgttcattgccttgtccagagttacacaaactgttcagatagtccagaactttctcactcattagcttcttctacaccacccttttgtgtc

SEQ ID NO: 30149 - DNA, 601 bp, Human
atgattggcttctgtcctctgctcaatactcattttctatttcattaacctcacaataacatgacccacattttatgcaattaaatatgttggacttcacttatgagattttggcaaagttttacataaaacaacatcataattttgcttctatattaacatgaaaaaatataaagtcataaatcagtgatgacttttaaaaggaaaatgaggtctcacaatttagctgagaatacatttacttatgaatatattatattttccaagcccttaaatgacttttcttatatggctttaaggrattatctttatgtctcatatctttaaaaaagcttaaattttttaacatcctaatatctacctactaggaaaattaacaatttactggcctagttttatataagaaaaaaatactttcttacgttatttttttaaaaatacttttttcttatgttaactattaggatactaatttactatatagattttattctttttatgctagtagtattttttcttatattacaatacattaaaatactaatgtaagaaaaatactgctagaagaaaaaaaatctatatagtaaaaaacttcaaaatt

SEQ ID NO: 30150 - DNA, 601 bp, Human
attatcttatttgattcttacaaaaaccttattaggtttaagtatcattattatactgattctagagataaagaatgtgtggcgcacaggaaaaaaaagagagggccagtcagtatcaggtagctgttagtagaaaagacagaatttgacgtaggccacagaccagagcctgtgctgttaagaatggcattatttttccaatgaaaaaataggtacattcttcatatagttagatattcttggaaaaacaatgcacagaggtaagatagctggccctccacttcttagaggattatgtaaytggttcactgaattcatctgaaacatattcttgtgaaattactagaaactccttgtatttgccttagtattctaataaaattcattcataaccaattctatatctaaatagttcccagaggaaccagaagtgatttgggtaaatgtaattttaaaaaagatctctgggacacaacagggaccacttctttggcaaatgctgtaaagcaatacttagaaataaaaacaaaagttacttactgagaagtgtttccatattattacagtatgaccattgtaattaagagaaaaaggaacacag

SEQ ID NO: 30151 - DNA, 601 bp, Human
atagcactgtacttggattcaaaaatgctatgttaaaaaatgtgaataaaagtaaaagtaatttacttttagaaagttgggttaagtgatttaaatagcagatcaagctgggaataaataaactaataacttctgaaattttatatattcaaaatgaccacacaataagcaattgggggtatttttttcattggaaaatgagcggctttttgtctttgaggctgcttctatttaaacacatacagtctatttctgatttgacatgactgcattctaatgctcataacattaattcagtccycattatttcccaccacctcctaacctatttccctgcttatagcttatcttcaggtgtcctgaaaggaacaatgtaagtcgagtgatctttccttttttctttccctccaaataatgttttaaaatgtaaatctaaatcttatcatgccctcttgacataatacttttcaatagcacttcaagctttcagaataacacttaaaattattgattctttagctttcaacacaatatattcttaagtttttgtagcactgaacataggaccattaaatgattattagaaaaataagttaatgaa

SEQ ID NO: 30152 - DNA, 601 bp, Human
ttaaaaatttccttttatgatcccgtaattacaaatgttgcatatcactgtaaatattcctctaaaatatcccttttaaaagctatacatcaaacaaatacatacaaatggtaactctgcaaggatcacaaatatataagtacaggagaaattatattttttaaaaaacattttaaatgctaagaatttcagtggttttgcaaaacattccagtaatagcactgtacttggattcaaaaatgctatgttaaaaaatgtgaataaaagtaaaagtaatttacttttagaaagttgggttaartgatttaaatagcagatcaagctgggaataaataaactaataacttctgaaattttatatattcaaaatgaccacacaataagcaattgggggtatttttttcattggaaaatgagcggctttttgtctttgaggctgcttctatttaaacacatacagtctatttctgatttgacatgactgcattctaatgctcataacattaattcagtcctcattatttcccaccacctcctaacctatttccctgcttatagcttatcttcaggtgtcctgaaaggaacaatgtaagtcgagtga

SEQ ID NO: 30153 - DNA, 601 bp, Human
ccttaagtgaccttaatcagtgttggtactaaatgcaatggaggtcatatgacagaacttaaaaatttccttttatgatcccgtaattacaaatgttgcatatcactgtaaatattcctctaaaatatcccttttaaaagctatacatcaaacaaatacatacaaatggtaactctgcaaggatcacaaatatataagtacaggagaaattatattttttaaaaaacattttaaatgctaagaatttcagtggttttgcaaaacattccagtaatagcactgtacttggattcaaaaatgytatgttaaaaaatgtgaataaaagtaaaagtaatttacttttagaaagttgggttaagtgatttaaatagcagatcaagctgggaataaataaactaataacttctgaaattttatatattcaaaatgaccacacaataagcaattgggggtatttttttcattggaaaatgagcggctttttgtctttgaggctgcttctatttaaacacatacagtctatttctgatttgacatgactgcattctaatgctcataacattaattcagtcctcattatttcccaccacctcctaaccta

SEQ ID NO: 30154 - DNA, 601 bp, Human
ggttctttcattctccctctctctctttttaaaaacaaacaaacaaacaaacaaacaacaacaacaaaaaacggagtcttgctctgtatccaggctctgtcatccaggagtgcagtggcacgatcacagctcactgcagccttgaactccagggcctcacatcctgatcctcctgcctcacatcctcttatatacacaattagtcaccactttctgatgattttctacttcccaaatacaatatatgctcaaatactagaaaaagtatttttccatatctatatctacatttatatatctytctctatatatacatatccctgaagtgatggagtgattatctcatagttaagtctttacaaagtttcacactgaggtgtttctttaagtattttattttgaacaacaattatggagaaaacaccttggccttaagtgaccttaatcagtgttggtactaaatgcaatggaggtcatatgacagaacttaaaaatttccttttatgatcccgtaattacaaatgttgcatatcactgtaaatattcctctaaaatatcccttttaaaagctatacatcaaacaaatacatacaaatggtaa

SEQ ID NO: 30155 - DNA, 601 bp, Human
aaaatttatataagtataaaatttaagaccaaactctctcctaatcactaggttgtatttctatcagtttattaaacttttcatctgaattgtccataggtacctcccctgtatatatttaaaattgaatttatcacctctcttcccaatcctttactatttcaactaacggcacatccagtcccagtcagaaagctgaaaactgtcccaggttctttcattctccctctctctctttttaaaaacaaacaaacaaacaaacaaacaacaacaacaaaaaacggagtcttgctctgtatcyaggctctgtcatccaggagtgcagtggcacgatcacagctcactgcagccttgaactccagggcctcacatcctgatcctcctgcctcacatcctcttatatacacaattagtcaccactttctgatgattttctacttcccaaatacaatatatgctcaaatactagaaaaagtatttttccatatctatatctacatttatatatctctctctatatatacatatccctgaagtgatggagtgattatctcatagttaagtctttacaaagtttcacactgaggtgtttctttaagta

SEQ ID NO: 30156 - DNA, 601 bp, Human
tgaaaatttatataagtataaaatttaagaccaaactctctcctaatcactaggttgtatttctatcagtttattaaacttttcatctgaattgtccataggtacctcccctgtatatatttaaaattgaatttatcacctctcttcccaatcctttactatttcaactaacggcacatccagtcccagtcagaaagctgaaaactgtcccaggttctttcattctccctctctctctttttaaaaacaaacaaacaaacaaacaaacaacaacaacaaaaaacggagtcttgctctgtawccaggctctgtcatccaggagtgcagtggcacgatcacagctcactgcagccttgaactccagggcctcacatcctgatcctcctgcctcacatcctcttatatacacaattagtcaccactttctgatgattttctacttcccaaatacaatatatgctcaaatactagaaaaagtatttttccatatctatatctacatttatatatctctctctatatatacatatccctgaagtgatggagtgattatctcatagttaagtctttacaaagtttcacactgaggtgtttctttaag

SEQ ID NO: 30157 - DNA, 601 bp, Human
gtaaatagatggacttagttatagtaatttttgaaaatttatataagtataaaatttaagaccaaactctctcctaatcactaggttgtatttctatcagtttattaaacttttcatctgaattgtccataggtacctcccctgtatatatttaaaattgaatttatcacctctcttcccaatcctttactatttcaactaacggcacatccagtcccagtcagaaagctgaaaactgtcccaggttctttcattctccctctctctctttttaaaaacaaacaaacaaacaaacaaacaacaacaacaaaaaacggagtcttgctctgtatccaggctctgtcatccaggagtgcagtggcacgatcacagctcactgcagccttgaactccagggcctcacatcctgatcctcctgcctcacatcctcttatatacacaattagtcaccactttctgatgattttctacttcccaaatacaatatatgctcaaatactagaaaaagtatttttccatatctatatctacatttatatatctctctctatatatacatatccctgaagtgatggagtgattatctcatagttaagtcttt

SEQ ID NO: 30158 - DNA, 601 bp, Human
tgtaatttctcccagattccattcccttaggcatttcttacctactacaagttcccaggggagttttcagactatttgggtttcgaatcattttgtctagaattccaactatctgttcaaattttggcctttcagcacgctccttttgccaacaatccaacattagctggtgaaggccagctgggcagtccatgggtgctggtaaacgataaccttcttctattgcttttataacctaatagccaaaaggacattacaaatattactgatttaggttcaattataataaaccaaatttccyggtaggcaaaatgatttatccagagaagaatgaggcacaatgcttcacaaaagacttacttttttcccaaaatttccatgaatattaagcatgttattaaggagtgcgtgaagtgcaggatatgatgacatttcctagttaattcagcaatagggaacagcaattaagttcatccagggtacaatagatggaaatagttttaacatcatcccagaggctttcaaaagggaacatgttatggaactatcttacttgtatatctttgtgagtatccatatgtgcccatacatttaataattc

SEQ ID NO: 30159 - DNA, 601 bp, Human
cagctatggagccaaattagttattacttactagttaacttggcttaggggaaatatttaaattttctgaactttagccttgttggcaacaacataggtatgaaactatagacttcatacaattattgttgtgaaggttaaaaaggtaatatgtttaaaggtctatttagtataatgcctggtacgcagtaagaacttgttaaagaagtattttttttatcttgattttgggattcaaattcttttaatataaagaagataacctaatgtataaagtgtagattgtacctaataaatcctkaaatacaattttaagagtttaagcttactcaatagtcatcctggctactgattcaagggaattgtagccagctgccgtgaaattatctttatatctttccatcttaatagcttgtagccattctccaactgaacaaaaggtagtgaaatcaggagtgttttgatccagaagagggcttattggcctagataaaaatgaaacagaaaagcgaacattatcctgaaataccaaagaaagaatgttttggcccatataaaattaaggtataaagaacaaaattagatgttttaattggtgtac

SEQ ID NO: 30160 - DNA, 601 bp, Human
agcattgagtataaagttttgaaattatttaagttcaacacaaacatggtgaaagaaatcctcctttgcaatggagaaagtttccccagtgaataggaatctaaataatacagaagttaactacagaggaagcctcactggatggtgtttagaacaccagctatggagccaaattagttattacttactagttaacttggcttaggggaaatatttaaattttctgaactttagccttgttggcaacaacataggtatgaaactatagacttcatacaattattgttgtgaaggttaaaarggtaatatgtttaaaggtctatttagtataatgcctggtacgcagtaagaacttgttaaagaagtattttttttatcttgattttgggattcaaattcttttaatataaagaagataacctaatgtataaagtgtagattgtacctaataaatccttaaatacaattttaagagtttaagcttactcaatagtcatcctggctactgattcaagggaattgtagccagctgccgtgaaattatctttatatctttccatcttaatagcttgtagccattctccaactgaacaaaaggtag

SEQ ID NO: 30161 - DNA, 601 bp, Human
aaatgttgtattcttgaacctaatagggatttagaaatttctaactggaaaaagcttgataaaggataatgaaaacagtttgtgggatctagtagaaaaattggaactcatcaatgaccatgtaagtttttatactggattcaattaacgtgtggtaattctgagcatattattggttatctacttatttcagtgagttcaatcatttcattatatgttataaaaactatcttttaaaatgtacatctaaatttaatagcttaaatttgaattaagaattggatctgtgttttgcctttcytaatagccagatacaatgagctgatgtctttacaagcagctaaaatattgcaaaactatagcaccgtagtttttcatggcagtgactgagaaacatgggttttcaggggtacagattgctttggggacccaagtgtaaaaatgcccacatagtgactggaagaaaactgaacaaaatagcatgcacacacttaaacccatgtacgtgacatttcctggcatataccagaaaataatatttgattgctggtcttcatctcattggaaaaacgatgacagtacaatataggatcccacaaat

SEQ ID NO: 30162 - DNA, 601 bp, Human
aaaggataccaatgttctaacagagatgtatcttcaatcatgctatttcttttgaaatttgagattctttcaaaggtacccagtgtagtaatgttacagatttaacactaaaaaggtccaaagctataaacagctttctaaaacaaagtccttatgaagaataaacacaaatgattttaaaaaggaatagtctgaaatcacatatttaaggaaaatatttcattaattttaacaataagatcatgattttatttgacaaatatattctttcttaaattctttatgtacattttaaaaagtstataagacaaaaaggaggttagagagctcaaggtgtttggatgtttttcaggtagtactttgtttattgtcactgctattttcctggccaccgatggtggatcctaaattccctttttatatattctggtggcacttaggagttcaagtctataggtgcttcttaaatcttctcttcactgttggaaggacccaggacatcacttgtcttctagcagcattctatgcatatactgaaggccagtactgttctcttgcagtctgtaatctcccttaaaagggagaaatgcatatcacactt

SEQ ID NO: 30163 - DNA, 601 bp, Human
cagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagyttctcccaggtggactttgggggaaggctgatgaaggtaaacacagaagtcaggagctttgggcctcttactcggaatggtttttacctcgcttttcaggattatggagcctgtatgtctcttctttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggatggggaa

SEQ ID NO: 30164 - DNA, 601 bp, Human
ttgcagtgagcctagatcacaccactgcactccagtgtgggtgacagagcaagactttgtcaaaaaaaaaaaaaaaaaaaaaaagactggagcttttccactgagtgagatatggagctatagcaggttgaggagcggaggagggacaagatctaacttacattttggatggatcatttaagctgttccactgaaaacagagcctagtagatctacaattattaacgaggatgatggtgtaatcagggtaaaagcagagggctgttgaaatgtagttgatttccagatcagctaaaggcasagccaacaggatttccagcaagttggatttcgggcatgggaaggttttagcctgaaccactagaacgatgtagccggcactgactgagaaggtgatcactgtgggtagagcatatctgatgtgaggaaaggaacagaagttcagttcagtgtctaaaatgcttgtaaaatggccaagcagagatgtgagataggcagcaagagattcacatctggagttcaagggaggggaccgggtgaagatatccacctgggagttgtcagtatgtagatgataagaaagtcctgagcctgggtgagg

SEQ ID NO: 30165 - DNA, 601 bp, Human
tggtgtaatcagggtaaaagcagagggctgttgaaatgtagttgatttccagatcagctaaaggcagagccaacaggatttccagcaagttggatttcgggcatgggaaggttttagcctgaaccactagaacgatgtagccggcactgactgagaaggtgatcactgtgggtagagcatatctgatgtgaggaaaggaacagaagttcagttcagtgtctaaaatgcttgtaaaatggccaagcagagatgtgagataggcagcaagagattcacatctggagttcaagggaggggaccrggtgaagatatccacctgggagttgtcagtatgtagatgataagaaagtcctgagcctgggtgaggtcttgcagtgggtcaatggaaataaggagaggaacagaaacagagacctatgggcctgcaacagggaggccatgctgaatagtgggacatgactgcactggcagcagaagccctcgtttccagtgccctgtgcagctaaccagccatggagctgtggtccaattacttaaccactctaggtcacagttttacatttatagaatggtagcagtttacctccctgaaagcggaggt

SEQ ID NO: 30166 - DNA, 601 bp, Human
gcattctccatcctgcatcctctgtctcccacatacttataattagtcataagcaaccaataataataaaaaaaagcaactttgttcatggctcttactgatttgcctgaaattgattaatgattttgtggggaacaagaactaatattcattttaatcactgaacttcttcaagaatgtttggactataaagtgattatggagtaatgtttggtcctcacaatccaaataccaatgatgtattaaaacagtttttcaataacagctatccagtcactgcttcatatttatcagccagtgcctgatttcagcagattctattaaaaccagagaattcaggcagctgcttggattttgtagcaatgggattttattcttatttgcaaggtgacttggtgattttcacagtttcagatctcagatctccactgtgtcaaagtagaaatgatcaaagttctggatgacatcccttctatagtggacagcctttcttctgaatccctgagtgggggtggggaggatccccttgtgtttaaatagatcaaatagtgggtgggcagctcctctgcaggcagtctctcccagggcccagtagacatcc

SEQ ID NO: 30167 - DNA, 601 bp, Human
cattcatccatgtggctaatttatttcatcttttgtgactcaactcaggtcaccctttccctcagtcactctgcatctcctctgaagtctgggctggatggtcccctgctgtgcccccacaatcccctgaactgctctctgccaactcactcaatcaacactgctgtcatcttctatttatttaccagtccacccacagatgttacatccccagaggaaaggaaccatgcctttgtacctgcagcccatgtatagcacccagagatagtagtgtgtcataaatgtaactggctggccaaamgaaggaatgagtaaataaatacacatcaggtcatctttgacttcgcaaagtaggcttttatatattttaaacaatgggaatttcttatcactgtactgtattctttacatatatttacataaaatatattctttatatgggaatttcttatcactgtactgtatcctagctcagctctgtttcttctgtcattttaccgagaatacagtttacaatttgtaaagcatgcttcttgaaccattgtgcctagaactcatctcagtaccccagatctgcacaggggacacagggacttggatc

SEQ ID NO: 30168 - DNA, 601 bp, Human
caaagagaggcaggcagggggcagatggatgttgcctagtttgcgtctgctgaggtcagagacttgaggggattttgcaaagctggatgtgctatgttatttcacctctgaacccttggggaggaggactagagaatgacaataagcttcctcgccagtccctgagcactcagtcatttccctgggccccttttttcagagtgtggccacctcatagtccagacctgaccctacattcccttggcccagatcagacttcttgtccccatccagagggatggcctggagctgatgacaactkctagcagatatgcaggaccaagaaatgatggggcctgaatactccagggtggagtgggctgggggtgtagccttcaggaatgggatagtgaccctttcccttgctttcttttaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacggtaagggtcggggagggcagtgg

SEQ ID NO: 30169 - DNA, 601 bp, Human
ttggatttgcctctgaagggtctcttgccatgtgtgatcttgcatttcagcagtgagactcatacctgtctcatggagccagtgtgccctcttgcctaggtatccaggtccagatgcctctgtttcaccctcacgcccacttcactcctctgtgcttatggtctgaaagctgagctcatggcctagtttcatgagccaaggtcttcagggaggaaatggagagacaaaatgtgggatgtggcagtctcatgcacctgggatctcagaaatttgaagcaacttcacatgtgacccccagtaygtcctgctcggatgtctccagagagaatagccaaggtgtcctcaaggccagaaagtctatcaccataaatatacttctacctttgggttttattagttccctattatcactatctgccccactcctctgagaccacccccagcaatagttctgaaaaatctgatttcccagtagcctcagcattgtgctcaagtgatctatctgactgtgcctaccactttctctctcttagctagccatttaccatagtttatgtaattatttgtgtatctgcctacctacctatatatctatatttat

SEQ ID NO: 30170 - DNA, 601 bp, Human
agcctcagcattgtgctcaagtgatctatctgactgtgcctaccactttctctctcttagctagccatttaccatagtttatgtaattatttgtgtatctgcctacctacctatatatctatatttattattcacttatgagctgtttcctgatagttttccaaatgtcagtctattcctgactccccaaattgaaagctttccatttttccttcattaattaaattatccataaaacagtctgtccttatatagcattttattttaggccaatgctctcagtctgggtgtttgatagggyttgagattttatcttgatgcacattgtattttttaacaattttgaaattaattggaaacttttaaaatcagttgggttcttatacaaatcaggatgttgatgttcttgtgaaaaaattgtaagagaagccaatacttgtgggcactctggagtgaggaccttgccttaaagctgagaggcagctgtctgcatatggtacccaccacttccaatatctctaacctggatactttgatgtgaaacgtctggcccctgtaggactggagtttgcaatctattgtgagtttatttgaggtgaac

SEQ ID NO: 30171 - DNA, 601 bp, Human
tgtccttatatagcattttattttaggccaatgctctcagtctgggtgtttgatagggtttgagattttatcttgatgcacattgtattttttaacaattttgaaattaattggaaacttttaaaatcagttgggttcttatacaaatcaggatgttgatgttcttgtgaaaaaattgtaagagaagccaatacttgtgggcactctggagtgaggaccttgccttaaagctgagaggcagctgtctgcatatggtacccaccacttccaatatctctaacctggatactttgatgtgaamcgtctggcccctgtaggactggagtttgcaatctattgtgagtttatttgaggtgaactttctctcatattttgaggatggtgagatggggtagagaggtgagccagttaattcaggttgataatgctactggtatgaaaagaacacagactgtcttctttttccttaagggctctgtcctccactttgcacctcacttactgtctagatttataggcactctggcatcaggacgtacacaggattaaaagcccaaaactcaaaatgctccgagtgctggtctcttggcaattctgctag

SEQ ID NO: 30172 - DNA, 601 bp, Human
ggtttgagattttatcttgatgcacattgtattttttaacaattttgaaattaattggaaacttttaaaatcagttgggttcttatacaaatcaggatgttgatgttcttgtgaaaaaattgtaagagaagccaatacttgtgggcactctggagtgaggaccttgccttaaagctgagaggcagctgtctgcatatggtacccaccacttccaatatctctaacctggatactttgatgtgaaacgtctggcccctgtaggactggagtttgcaatctattgtgagtttatttgaggtgractttctctcatattttgaggatggtgagatggggtagagaggtgagccagttaattcaggttgataatgctactggtatgaaaagaacacagactgtcttctttttccttaagggctctgtcctccactttgcacctcacttactgtctagatttataggcactctggcatcaggacgtacacaggattaaaagcccaaaactcaaaatgctccgagtgctggtctcttggcaattctgctagacaaatcaagaagtaacaaatttctcccaagaaggctgtttcttttacatttggca

SEQ ID NO: 30173 - DNA, 601 bp, Human
tcattggggcagggaggacctgtggaatcctgcccagagtcaatggccacactttgggctggtaacctccacatagggcagacccactatggccctgggctgctcttagctacactgttctgatttttgacgtagctgcctaatttttaaaaaatcattcaagtttcatattacattatgaagtttttaatttataaagacattgttaaggatgcttcattggggttccctgtgtatttttctatcgccaactttatgttttaaatacatatattacagaaagtctcagctgagggcaacwgaaaattttccttcagtctttaaaatcgacttccgtctttaaaattctagagaatgggaggcttcaagaaccaatatccttgttcttagaaatctttctcctccaacatggttgaaggacagttctcaaacattggggaacattagaatcacctggactgtttgttaaatatgcagataccctgctcttcacccagaggatctgattcagtagatctgaggaggggtctggaaacagtcatgtttaacagtcgggctcaggtaattctgatagctcatgggaaacctcactttaagaagt

SEQ ID NO: 30174 - DNA, 601 bp, Human
cattcgcctggagggtgtggtcaccaagagtcggcctgtcatgatcatcacagagttcatggagaatggtgcattggattctttcctcagggtaagagcaactcaggggtttgatgatgcacttggatgcaggtgaatgatggctggggagaggggttccatgagcacaacctaccaatcaggaatcgcctgatccagtgtgaatgggcattggagatgttagcagagatttgttgctaaaagaagagaacaaaacagggcttgtgggatcctcaggaggaggatggcatggagtagggcrttgacaaatgcttattggatgaataaaatgaatagagagggacaaagaatggccattggcatctgcatgaatcacagagattgaagagacttttggctgctgcacagccctgtgtgattcatgcagacatccgcggccatatctgcctttcatcagcacagccaccctcccagactgctctctgcatttacaggttcagaagtaaaacaggttgccattttctgatgcctgggccacctgccctctgaggaggcacttctgagtagggaaggggaagactgcatcacaagcatccacggg

SEQ ID NO: 30175 - DNA, 601 bp, Human
tgaatgatggctggggagaggggttccatgagcacaacctaccaatcaggaatcgcctgatccagtgtgaatgggcattggagatgttagcagagatttgttgctaaaagaagagaacaaaacagggcttgtgggatcctcaggaggaggatggcatggagtagggcgttgacaaatgcttattggatgaataaaatgaatagagagggacaaagaatggccattggcatctgcatgaatcacagagattgaagagacttttggctgctgcacagccctgtgtgattcatgcagacatccrcggccatatctgcctttcatcagcacagccaccctcccagactgctctctgcatttacaggttcagaagtaaaacaggttgccattttctgatgcctgggccacctgccctctgaggaggcacttctgagtagggaaggggaagactgcatcacaagcatccacgggtatttctgtgattggcgaagattcccaaccaacttgcagcagaagtggggagttgctgaaggcctttggctgggagacctgtaaaagatcattgtcagaatatgcccaaagtagagccaggcccacaatgaaa

SEQ ID NO: 30176 - DNA, 601 bp, Human
ggctggggagaggggttccatgagcacaacctaccaatcaggaatcgcctgatccagtgtgaatgggcattggagatgttagcagagatttgttgctaaaagaagagaacaaaacagggcttgtgggatcctcaggaggaggatggcatggagtagggcgttgacaaatgcttattggatgaataaaatgaatagagagggacaaagaatggccattggcatctgcatgaatcacagagattgaagagacttttggctgctgcacagccctgtgtgattcatgcagacatccgcggccatmtctgcctttcatcagcacagccaccctcccagactgctctctgcatttacaggttcagaagtaaaacaggttgccattttctgatgcctgggccacctgccctctgaggaggcacttctgagtagggaaggggaagactgcatcacaagcatccacgggtatttctgtgattggcgaagattcccaaccaacttgcagcagaagtggggagttgctgaaggcctttggctgggagacctgtaaaagatcattgtcagaatatgcccaaagtagagccaggcccacaatgaaaccattttc

SEQ ID NO: 30177 - DNA, 601 bp, Human
gggttccatgagcacaacctaccaatcaggaatcgcctgatccagtgtgaatgggcattggagatgttagcagagatttgttgctaaaagaagagaacaaaacagggcttgtgggatcctcaggaggaggatggcatggagtagggcgttgacaaatgcttattggatgaataaaatgaatagagagggacaaagaatggccattggcatctgcatgaatcacagagattgaagagacttttggctgctgcacagccctgtgtgattcatgcagacatccgcggccatatctgcctttcaycagcacagccaccctcccagactgctctctgcatttacaggttcagaagtaaaacaggttgccattttctgatgcctgggccacctgccctctgaggaggcacttctgagtagggaaggggaagactgcatcacaagcatccacgggtatttctgtgattggcgaagattcccaaccaacttgcagcagaagtggggagttgctgaaggcctttggctgggagacctgtaaaagatcattgtcagaatatgcccaaagtagagccaggcccacaatgaaaccattttcatttctgtaggg

SEQ ID NO: 30178 - DNA, 601 bp, Human
aagggtagctgggggacttgtctagaagcacactactgaagctacctttgtacaacaggaacatgctttttgcccagtctgggtcactaggaagtagtggcttttgtttttctgagggtgcaggggtggagaacaactgatgtagattactgagcccatgtactttccctaggacagcctccttgagggtatggggttatgctttgtatttggaaactccaatacctaacacagtgcacacctggtaaatgctagttgactaaaagattatttctcaaacaaaaatgctagggagtggcaygagagctctagtcatcctgtgtgtacattatctctcactgtccttgctgccacacctgtcatgtcagtgcaatcattgtctatgctttcctggggacattcatttattatcagagatctcatgaagacagttgaataaacaaagttgaatgaagttgagttgaataaacaaagttgaataaacttgaataaaaggcaatgtgagaaggaaaagcattttctggaaccactgtcaagacccttttgggagtcatttatttcctaccagtcacctgattgtacttcagagagagtcactgct

SEQ ID NO: 30179 - DNA, 601 bp, Human
aagcacactactgaagctacctttgtacaacaggaacatgctttttgcccagtctgggtcactaggaagtagtggcttttgtttttctgagggtgcaggggtggagaacaactgatgtagattactgagcccatgtactttccctaggacagcctccttgagggtatggggttatgctttgtatttggaaactccaatacctaacacagtgcacacctggtaaatgctagttgactaaaagattatttctcaaacaaaaatgctagggagtggcacgagagctctagtcatcctgtgtgtacattatctctcactgtccttgctgccacacctgtcatgtcagtgcaatcattgtctatgctttcctggggacattcatttattatcagagatctcatgaagacagttgaataaacaaagttgaatgaagttgagttgaataaacaaagttgaataaacttgaataaaaggcaatgtgagaaggaaaagcattttctggaaccactgtcaagacccttttgggagtcatttatttcctaccagtcacctgattgtacttcagagagagtcactgcttgatttggggactgtgatcacactc

SEQ ID NO: 30180 - DNA, 601 bp, Human
atctcatagtggttttgatttgcatttctctgatggccagtgatgatgagcattttttcatgtgttttttggctgcataaatgtcttcttttgagaagtgtctgttcatgtccttcatccactttttgatggggttgtttgtttttttcttgtaaatttgtttgagttcattgtagattctggatattagccctttgtcagatgagtaggttgcgaaaattttctcccattttgtaggttgcctagggcctgttttcatttggggctcaggtcacggaggcatgttggacaccagcatttmtcatgttgatgagctgagcttgcaggggaagaaaacctgggggcatgagaggagcacgggaaaacagaggagcaggcatggtaagaaaggagtggtgggagcaggcagtgccaggaggagagggggaaatgaagcgtttctgactcctcacactgcatggaggcaggtaatctataaatctaatttcagccttactaccgaaccctggagcatagcaacattaattgacatatctgctgcttgataaaatcgaaaaataggtcatcagttcagttctacagggtccatcttctgggaagt

SEQ ID NO: 30181 - DNA, 601 bp, Human
taaatttttccttcttgatactcaaattcaagggattcaacctggtggctcttccgtaatattagaaacaattcggctgggcgcggtggctcacgcctgtaatcccagctctcagggaggaaagaggctggaggatagcttgagcccaggagtttgagacctgcctgggccatatagcgagaccccgttctccagaaaaaggaaaaaaaaaaaaaagacaaaaaaaataataataagcgaaacaattcctgaagctgtgaccagtatcccatggtttagttaacatggttcttgacatgckccataaggccttcttgcctaaagcttggctttgtggttgctgctggttctttcacagataatcataactggaagactcttgaaagtcgctgagtaatgtcaaacggggacatttctcatcagagaagctcattcatgggctgcagctagaagatagcaacccagaagtcaggaagagaacaccagattggaagtcctgagaccaaggttctgctttggcttctgctgtgagtcaccctgtggcctggagcaaacctgttaactcaattttccaatttataaactaaaggcattgagctag

SEQ ID NO: 30182 - DNA, 601 bp, Human
gattgaagtgtattagtgagaaggaagatctgcatcactcactgcacatccagctcacagatgggcaacgtgctgaaaaccagtcagagtttccaaaaagtagctctaaactttctttttgagttgcttagaagaatctattatggagaaagcatacattcaatctcctgggcaggtttggaggtggttaaagttagagttagaaatagcctggaacttgaagtgtgtcaaacacaatatgtttgggggcccttctactggcagacatctttaggagggagaaagtcaatttgctctattycttcaattgatcaaggagcataacccccagaacatggatccaggcttgcaatcttgcatgaggaacagagtttccaacaattcatgcaatcattgttagactttttgattgttgttgttgttgctcctaagtagagtatttttataacaggtcttttatttttccttgcttatttttgcatagaaaatgcttttgcaggagcatatgcatgtgagtgcattgtgtaacatctcgcatacagtagatgctcaatgatgggagctcctctcattgtctatgctttctgcatttcacataagg

SEQ ID NO: 30183 - DNA, 601 bp, Human
agcataacccccagaacatggatccaggcttgcaatcttgcatgaggaacagagtttccaacaattcatgcaatcattgttagactttttgattgttgttgttgttgctcctaagtagagtatttttataacaggtcttttatttttccttgcttatttttgcatagaaaatgcttttgcaggagcatatgcatgtgagtgcattgtgtaacatctcgcatacagtagatgctcaatgatgggagctcctctcattgtctatgctttctgcatttcacataaggactctgggatgcaggtsgtggttgccttgcagagtgcctatgtttagcagtaaacatagactagaccccaggtgtcctgcttccatctctcctccagtcagagcattctaatgactaggctgtgctctacttatagaacataattctcagccctttggggagcatttggggctagattagatgggaaaatatgttcttggcagtatagcttagggtctactgatttaactggtgtgtgcaaagtcaagacccaggagccttggggagataggaggaagacactgttttattcactgaagagtctgttgtctaaccag

SEQ ID NO: 30184 - DNA, 601 bp, Human
aggttgccatgaagaggagcagcaacagctcccattcactaggagagttccctgtgccagacgctgtgcatgaggttcccctgacccactgtccctatgaggtaggtgtggttataccagtctaagggctgaaagccctgggattacccagagaaggtgctttacatgcttgattttggaaagaggaaaagatgtattcatcattcattcaacttgtgtttattgagattttctatctaccttaaagtttacagcactgataatactatggtgaccaaaaaggacagagttcttgtcctcsaagagtataaaatcaagcagcagagacagacagacagaaagacacacacacacacgattaaaacttgtgatatgtgctaagaagactaagagtatgcactaaacatttgtcatgagaaagtgctaatcatattttgggggggagttaaagggatgtcctctctaagaaagtgacatttaagcggagaactgaagggcaagtagatgtcgattgttggagggaaaacagagggaatagcacatgttgagggccctaaggcaggaagagtttgtcttggaaaagaagaaagggtgccagtca

SEQ ID NO: 30185 - DNA, 601 bp, Human
acccccattgaagggatcccaaaggcagtagcataccaattcctcctgttttcagctcacggcctcataatctgaacctgcagtgttcagggtaggggatacagggacacccttagcatggatgttggaactaatcaaagagcccagcatggaggtgtgaaaggccctataaccacaaagcctgtagaggtgccaaggccacagtctccaacccaagagacaatgggctgtttccaaatggctgaggaccatgaatagatcagccccaaattaagcagtaaagtctaccctgcttctaagygttcaggttctgtgttttccttccctgtgaacgacagaggggaaggaggcactggactgggggccagggcctgggttcccatcctgctctgcctctgacggctatgctccattgagccagtcgcagtttctgtgtgggacttgtacctcttagctttaaagagagtaattggaaagggcccttcttccttgagaattcactcttctatgatcccatatcacctatcagtgaaggaagaggtggaaagctttccaaagctgggcagcttcagatgggccacaggagagggtccctgtctgt

SEQ ID NO: 30186 - DNA, 601 bp, Human
gggggccagggcctgggttcccatcctgctctgcctctgacggctatgctccattgagccagtcgcagtttctgtgtgggacttgtacctcttagctttaaagagagtaattggaaagggcccttcttccttgagaattcactcttctatgatcccatatcacctatcagtgaaggaagaggtggaaagctttccaaagctgggcagcttcagatgggccacaggagagggtccctgtctgtggggaggtcaacactcccccaggatgccctcaagggaaaagggtgagaaaggaagagawgggtcatctaacatgctttaaatagaggctttttggaatgttccacatgagaacctttgctccatacttactaaaaggtgaggaagcctttttcggatgatttgctttgataagtctccaatgaaaagtcctgcctgaatttcaacactgcctctcaccctctccagggaccaggcctcttttgtgttttgcatacataccctcccgttggagctgagaggattacaatttgcaaagctgcatacctatgttctctgcttgcccttcccatcactttgggagggggcagtttttatcctt

SEQ ID NO: 30187 - DNA, 601 bp, Human
aagcctttttcggatgatttgctttgataagtctccaatgaaaagtcctgcctgaatttcaacactgcctctcaccctctccagggaccaggcctcttttgtgttttgcatacataccctcccgttggagctgagaggattacaatttgcaaagctgcatacctatgttctctgcttgcccttcccatcactttgggagggggcagtttttatccttcccaactgacagctaaaagagaaagaatggtccccagttcagatctgagtccactggcagccagccacactgtaaccccctctrtgctagggtggacactgaggaacttgtcagctatggagtcagcaagccttctatcctgtgaaaggtttagtgccatggcagctgctcggaagattgagaaaggtggcaacttcccagagagactgtggaaagaggagctggggtacttctatgacagtactccctgttgctatgggcagagtggctccagcctggagtgggtgaaatggctgcaccattaaccgggtcctgaagtcaactatggctggtgtctaggtcctctattatctgggattagcaacaccttgcctctgctcctga

SEQ ID NO: 30188 - DNA, 601 bp, Human
atctgggattagcaacaccttgcctctgctcctgaagcacatcaaatcagtaagcggtggagttagtgcaaagcctgcttttatgaaatcagctgcaccctggttctgtctataccagctgctaaataagtataacatgttagtagaaaaagcagacccagcagggcgcagtggctcatgcttgtagtcccagcaccttggaaggtggaggcaggtggattgcttgagaccaggactttgagaccagcatggtcaatgtggtacaactttgtctctgctaaaaatacaaattagccaggtrtggtggcacatgcctgtaatctcagctactcgggagactgaggcacgaaaattgcttgagcttggaggcagaggttgcagtgagccaagatcgcgccactgcattccagcctgggtgacagagcgggaccctgtctcaaaaaaaaaaaaaaaaaaaagaaaagaaaagaaaagaaaaatcagacccatcttatcctgcccaagaccttaatctgactaagaacaattcagcacttacagaatgaattacaaaactgtctgacaagcaagatttcacattcaagatattttctgtcaatgc

SEQ ID NO: 30189 - DNA, 601 bp, Human
tattcatttaacacacaatcagtgtatgctagttgtgactaaacactgtgcttgctgattctagaaggttttacagtccggtggcataaacatggggctttgagaacatttgagtggaggaggtaagggaagacttcctggatatttgacgtttgagatgggtctcagagggaataagaacatctgtagagtagcagtttattctaattttgcgtgctccttcaaaataaagcccctaagcattgtctcaagtgcagttttgctcctcgtgggaggcaagaggtgacttcatgcccattcrgaaagcttcttacaacctggcctgggagagagccaggaggggctcccagctgccgggctgaagcctcactcatcagaaaccaccaagttggtggtggtaaaggattttacagatgacaattgaaaggttttaaggaagagaattgcagaggcaagttggagtgccggtaattaggcttccagagcacaggaaggtctttgaacatgtacagagagtttgtcagccagagagagcaacttggaagttctgctgcttggatctgattgacagagataatgagagtggcagtgtctgtggaga

SEQ ID NO: 30190 - DNA, 601 bp, Human
ctcccagctgccgggctgaagcctcactcatcagaaaccaccaagttggtggtggtaaaggattttacagatgacaattgaaaggttttaaggaagagaattgcagaggcaagttggagtgccggtaattaggcttccagagcacaggaaggtctttgaacatgtacagagagtttgtcagccagagagagcaacttggaagttctgctgcttggatctgattgacagagataatgagagtggcagtgtctgtggagaggagctgcagtcttattgaaacatcagagcttgacttaacccrctctgccctggtttctccactgctctgagttcctccacttccctctccccagtgcaaggtcgactaggcactacccacagcctgactcactaatgggaaatacatgtctgggggcagccgggagcaggccctgaaaatacaagggcaacaggaggggctctgcccacttcccagaggcgttctagtcactccacccagtcccagagagcacctggggtcagactacctgcacctgatccctacagaacctgtgtacctaccatttctcagtacaggtgaataaaggcaacccctcaccac

SEQ ID NO: 30191 - DNA, 601 bp, Human
tgcttacactggcctttgcaatggccaaaagagttgttgctgaactttcaaaatgagacagcagagagctctgggtaacagttgcctagactggtctccttgcccccagagctttacttttacttctctctggaaatgccatctgatttcattctaatcttcaatcttctcaatagccacttatctcatcctcttgtggaccaatgaaaggagcccagaattcacttctgttttcaactctgctcagtaggacaccctatgcctccaaccttaggccatatctttccatacaattcaaacstggtcattgtcatttacagccatcatcacatggccagaatgaaggtgcttttccactcctccttcctgttccccatacctgctagtgaggcaagtgtgacagagaatgatttcaaagtcccattagaagaccaaagctattttttgatataatgatattgtaatttgactaaattttattgctcagaaatttagaaaacacgcatatcctaaagaagagaataaaaatctccaaaggcattgtacttcaaagacttgagtggataaatgctactcatataccaatgaatgatctcagtat

SEQ ID NO: 30192 - DNA, 601 bp, Human
tacaattcaaacctggtcattgtcatttacagccatcatcacatggccagaatgaaggtgcttttccactcctccttcctgttccccatacctgctagtgaggcaagtgtgacagagaatgatttcaaagtcccattagaagaccaaagctattttttgatataatgatattgtaatttgactaaattttattgctcagaaatttagaaaacacgcatatcctaaagaagagaataaaaatctccaaaggcattgtacttcaaagacttgagtggataaatgctactcatataccaatgawtgatctcagtatttttttctttgggctgaagggtaaaggacacttttttccctatgtgcaagaagcattaatgctcccagattatcagctcaagtaataacaacaaaattatttacaagaagtaacaaatggagtaaagtcccattttctaaacacaaacatggtagtgggttcccatggctatgctctaccctgaaaagtgagaaaagtccttggtgcttttcaaatactatcttcctggacctccaaaatgagcagtagtaactcccttctttgctgggaagacatctactaaaatag

SEQ ID NO: 30193 - DNA, 601 bp, Human
aaaaaaaatcggcccgtgcctgtaatcccagcactttgggaggccgaggcgggaggatcacggggtcaagagattgagaccatcctggccaacgtgctgaaaccctgtctctactaaaaatacaaaagtttgcagggcataatggtgcatgcctgtagtcccagctactcgggaggctgaggcaggagaattgcttgaacccaggaggtggaggttgcagtgatctgagattgtgccactgcactccagcatgagcaagagagcgagacaccatctcaaaaaaaaaaaaaaaaaaaaaaargccaatgagatgccatgatgccatgcagtggagacaataagggaaacagaattgagttacattcggtctagagctcacaggcagaagactcagcatgtgcatgggtccccattctcttgatcccttgccaaaagaggttgggtcagctggtcacatcatggagctgcgctctctcagaaaggccctgactccagtgctccttcttgttccaggacaggtggtaaagctgtcttgtcagtgaggaaaattagtatctggggctctagcatctaatgatctgagcagagatgccattagttt

SEQ ID NO: 30194 - DNA, 601 bp, Human
acaccaaaaacaccctgaactccaaattatttcctttgttgtttaaaatgctttaactgtttattttaatataaaattaatgcaggattattatagaaaataaaaaattcaaacaagcaaagagaaacacatgaaaaatattcaggtttctgcctatccagaggcaactgctattaacaccatgctgtatatccttccaaggtcttttctatgcatgtctataatagttggtttttgttttttacaaagcaagattatactatttctgaagttatgcagccagctcttttacctgttacartatgagcatatttccatctcaatagatggatttttgtagtattactttaaggcctacattgtattttaggccttctgttgcattatgggtgtaccataataaattcatatgtttagcacttgcgtcacttacaattatttttttaatgtaaaaagcacagtgtaggcataattgatttaaatgcatttgaagttagttaagatgtactggatgaaaaaacacaaagatctgaaaaacagacaatgtacttaacgttcctaaaatctttacaaaattactctctggcgtttgtgaaaatta

SEQ ID NO: 30195 - DNA, 601 bp, Human
taaaatgctttaactgtttattttaatataaaattaatgcaggattattatagaaaataaaaaattcaaacaagcaaagagaaacacatgaaaaatattcaggtttctgcctatccagaggcaactgctattaacaccatgctgtatatccttccaaggtcttttctatgcatgtctataatagttggtttttgttttttacaaagcaagattatactatttctgaagttatgcagccagctcttttacctgttacagtatgagcatatttccatctcaatagatggatttttgtagtatyactttaaggcctacattgtattttaggccttctgttgcattatgggtgtaccataataaattcatatgtttagcacttgcgtcacttacaattatttttttaatgtaaaaagcacagtgtaggcataattgatttaaatgcatttgaagttagttaagatgtactggatgaaaaaacacaaagatctgaaaaacagacaatgtacttaacgttcctaaaatctttacaaaattactctctggcgtttgtgaaaattaccaaaatctgattgacggtattcattttggaccaccttgttat

SEQ ID NO: 30196 - DNA, 601 bp, Human
agtgtaggcataattgatttaaatgcatttgaagttagttaagatgtactggatgaaaaaacacaaagatctgaaaaacagacaatgtacttaacgttcctaaaatctttacaaaattactctctggcgtttgtgaaaattaccaaaatctgattgacggtattcattttggaccaccttgttattttgactgttgtcattgatttgaaccaattatttgtttaaccaagcccattcatgttgctgcctcatgaggaatatggcaaataatgcagaggaggcatctagagggtctctagcrtggagtaagtgctccatcaatgctaatccctttcctccctttctcttctcttccaaatgaaagaatgagtccaccacaagttttgaggacatcctttataaatagtgggttcactgggtttcccatgtgtcattgtttcatcactcctagtgccaccagcttccagtaaggcagaattgggccctatgtcttcttaaagagcggagatgctcaagctgttcactggctcattcttcaacaaacatttacagaggtccatgtgtgtcaggccctgcaccaggagctggggacataaagaag

SEQ ID NO: 30197 - DNA, 601 bp, Human
atgctaatccctttcctccctttctcttctcttccaaatgaaagaatgagtccaccacaagttttgaggacatcctttataaatagtgggttcactgggtttcccatgtgtcattgtttcatcactcctagtgccaccagcttccagtaaggcagaattgggccctatgtcttcttaaagagcggagatgctcaagctgttcactggctcattcttcaacaaacatttacagaggtccatgtgtgtcaggccctgcaccaggagctggggacataaagaagtactacaatgtggcccctgytttctaggagcccaatgtctagggggataaaccaagtgcacagaaaatccattacagcggaaggtgtgcaagcacagagcaagggcatctgagacagcctggatcagggaggctccatataaaggggataatttgtgagtgactggctggtggcagtcactcaatcacacctgttccctgtatgtcactgcaggtcatcaatgccatcgagcaggactaccggctgcccccacccatggactgtccagctgctctacaccagctcatgctggactgttggcagaaggaccggaacagccg

SEQ ID NO: 30198 - DNA, 601 bp, Human
tcagggaggctccatataaaggggataatttgtgagtgactggctggtggcagtcactcaatcacacctgttccctgtatgtcactgcaggtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgtgagtctagtgaaacrgtgatccctaaatatggctggtttcatggtcaggggcatagccagcagcctctgaccatgatcatgttcgaattttttaaagagtatctagttgcagtgtgggccttatgttgaggagagcaacatgcatgaagaaagacaggagaacattgcaatgatcatgatagagaaaatagtgtcttaaatcaggataatggttgtggaaaaaagtaaacgagttttggggatttgagagacaaaatctttatgacttggtgaaggattggacatggatattgagggtgagggagatgtcaagat

SEQ ID NO: 30199 - DNA, 601 bp, Human
atgatcatgatagagaaaatagtgtcttaaatcaggataatggttgtggaaaaaagtaaacgagttttggggatttgagagacaaaatctttatgacttggtgaaggattggacatggatattgagggtgagggagatgtcaagatagcacccggatttctggtttggatacctgggtgtctgctttgaaaatgtgccagagaaggtcggcaatgggtctcactgctccattttttttttcaaatagctaaggatgaaactaggaaaaacaatgttaccaatatatctggggaggttgtgrtaaaatatgcatatttttaaaaggactacgtctttgaatggtgaggctcctaaattttggtttacaaaggagttgggagccttccgttcccttcagactgaacgctatgtcaacctgtctgtctgggttaactgaactgtgacagtgcccagaggcagagacactggccacctggatgtagaagtcatgctgatttaggattccatgaggaagaaaggttcagcccagggctccactataatcctcattccatcagggatgctgccttccatgaagtcagctgtcaggccagactggggc

SEQ ID NO: 30200 - DNA, 601 bp, Human
gcaatgggtctcactgctccattttttttttcaaatagctaaggatgaaactaggaaaaacaatgttaccaatatatctggggaggttgtgataaaatatgcatatttttaaaaggactacgtctttgaatggtgaggctcctaaattttggtttacaaaggagttgggagccttccgttcccttcagactgaacgctatgtcaacctgtctgtctgggttaactgaactgtgacagtgcccagaggcagagacactggccacctggatgtagaagtcatgctgatttaggattccatgargaagaaaggttcagcccagggctccactataatcctcattccatcagggatgctgccttccatgaagtcagctgtcaggccagactggggcactgtccatgcatctctgcaatgtgtggtcacctgcccatctctgtctcaccaggccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcag

SEQ ID NO: 30201 - DNA, 601 bp, Human
ctccctccagctggtcacccagatgacatcagagtaagtgatgagaatctctctgtccagaccacacctaggggtcagtgctccttccctgctattgcagatggtgtgagtcctatttctggcctcatccctggagctccgtctctgtatagaccaggcctggacggggagcaccttggaaagatgaagggggatgtgagggtgggatggggaggtggagatccactctgggacccaaatgagagttcttcaaagttatagccatatgtcatttgcctaatcacccagagtctcttccccrtttaagtttttaaactcaactcatcaaagagagcatccagatggaaagaacacagccatctagtactttaaataacagcaggaaaagcattgcactgattcagcaacagtctgagatatgtggggagcttgtccttatacttagatagcagttgtcaacaagcatgcatttccatcccccacaattatttaccagtctgtggctccctcaggagtttggaggaatacacaaaataaaattattcaaataagacgagagccagaaagagttttaaagatccatgtggtccagcatttcccc

SEQ ID NO: 30202 - DNA, 601 bp, Human
acacagccatctagtactttaaataacagcaggaaaagcattgcactgattcagcaacagtctgagatatgtggggagcttgtccttatacttagatagcagttgtcaacaagcatgcatttccatcccccacaattatttaccagtctgtggctccctcaggagtttggaggaatacacaaaataaaattattcaaataagacgagagccagaaagagttttaaagatccatgtggtccagcatttcccccaagaatgttctgagaagcaccagttgtgggaaatgttaataggttctcyttggaaaaaaggtcccactgtcaaataaatttgggaaatattgtgtactttatcaccctcttggagattcactgctcatattagcattataaaggccatgagaaatcctgaaataaaggaacccatttaaaattattaaataccatagaaccatatttttgaggggcagggttttatagaactgtagtctgggaaatatttatctggttccaccccttccattcagcagattctgaaattacatgacattggtcctcacaggtggcaaagctgggacacaagcctgcttttctggctgcc

SEQ ID NO: 30203 - DNA, 601 bp, Human
agatggtttgaatgtgtgtctagctttcgatccactgaacatcagaatacatttcttaaaaactagattaatttcctggtgatgccaaaaaaagatggttccttccattaagaatgactgtcaaatagacagcaaaaataaataaatagaaaagaagcacttaccagtgggaaaccagcttcctcatcttttagagtgaaaaattgatgcccctagataatcagagggactgagttcagggatagaaatgggtgtttatgaagactggctactcccattttcccactgtgatttgactgcstatgggggccattgtcacgtaatcccccaggatctaaaagaattctcttagtctgagaataatcaatgacaaagataaggggaagaccaaaaggaaagtgaaactataaattaagggatttcattcaaagtaaaacatgtccacacactattagagcaatttgatttgtttcttgagaggtaaaagatggaaaaagaaactgagcaacttaataaaatagattgtgggacaatctgtgaattcaaaattcaagcatgcttccctaaagtatttgccaaaaagacatgaacactttgagca

SEQ ID NO: 30204 - DNA, 601 bp, Human
ggagactccgtgggcataggaccctccgagccaggtgtgggatataatctcgtggtgcgccgtgttttaagcctgtcggaaaagtgcagtattcgggtgggagtgacccgattttccaggtgccgtccatcacccttttctttgactaggaaagggaactccctgaccccttgcgcttcccaagtgaggcaatgcctcaccctgcttcggctcgtgcacgcacccactgacctgcacccactgtctggcactccctagtgagatgaacccggtacctcagatggaaatgcagaaatcaccygtcttctgcgtcgctcacgctgggagctgtagactggagctgttcctattcggccatcttggctcctccaatcactgttaattaaatttttatcatcattgtgtttgcagtggtttctctatttttatgaaatgctttcacataggtttaaatgagatagtgtatggcacgtgggatgcattcaagcagtgttatgtattattattaacctaggaagaatgcatgggtctagcacaggtcaactataagccatgaacttgttcttattaatccaattcagtgctctatcctggacatatt

SEQ ID NO: 30205 - DNA, 601 bp, Human
cctgaccccttgcgcttcccaagtgaggcaatgcctcaccctgcttcggctcgtgcacgcacccactgacctgcacccactgtctggcactccctagtgagatgaacccggtacctcagatggaaatgcagaaatcacccgtcttctgcgtcgctcacgctgggagctgtagactggagctgttcctattcggccatcttggctcctccaatcactgttaattaaatttttatcatcattgtgtttgcagtggtttctctatttttatgaaatgctttcacataggtttaaatgagatagygtatggcacgtgggatgcattcaagcagtgttatgtattattattaacctaggaagaatgcatgggtctagcacaggtcaactataagccatgaacttgttcttattaatccaattcagtgctctatcctggacatattccttgggttcctgattgggcagatattttagttattttgagcccactcttcttaaaaatgcatacattaaaattcacatggaggcagcaaatggaaactcaggggaaaacatcagaagaccaggtgagccccacatcttttcagtctcagtgggtgatcac

SEQ ID NO: 30206 - DNA, 601 bp, Human
agtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcrggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatgggga

SEQ ID NO: 30207 - DNA, 601 bp, Human
gccgtcctggctgacctgtccctgcccccgcaagccgccctgggcatgagcgacttttgcgtggttcccggtggttgcgctccccgtttcgtcccctccgtgagcatcggcgcttaccggtattttaacccgagggttacacatctgaggcaatgtgggtgggttacgcgggagaggacgagtgagttttttggtaagcggaatgaactatgcagataacatcacatgaaggccgtttctggaatgaagtctgactcctccagtttcaccacctcttccggagctctccccgccttgctgycttccatcgcttcatcctcggtgcttcctgagttttaaaatcgcctatctacgcttccaagttccaatgagttatctaacgtctatggattagctaggtggttggtggaaggtcagaacttggttttacttagatttttatctgcctcatgcctgtactatttgtttaatgaatgcataggaggtgtttttattccaacaagaaaattattcgtacgcgattattgaatgaatagacaaattcagccaagttcttctggtctggaccagcctggctgatttctgtaacttttttgggcca

SEQ ID NO: 30208 - DNA, 601 bp, Human
gtgaagaccttgattttataaaacttactttttagtggaagagagacaatttaaaaaagcgaatgtacagtttttcacgtggagaaaagcactgcagaggaagatactagcagggcaagggatctgagtgcagtcagacctcatttgggtccagacttcattcctctatgtctctttcctttctacagaaagactgttagagaaaatggtagcattggtttcctgttgggagggaaagtgggtggtcatggtaagtgggtagagaaagacttcacagtatactgtttttgtacattttgartttttttaaaagcgagacttgagctattctagctctgataatatggtgcagtatttgttatgttagttgtagtctttctgggcagtttttacatccccatgagccgttaaaaaaatacctgaacctttaattaggggaaataaattggaaaaatacatttcccttcacttaacattatcttagtttctctttttttttttttttttttttgagatggagtcttgctctgttacccaggctggagtgcagtggtggcgggacctcagctagatgcagcctccgcctcctgggttcaagcaa

SEQ ID NO: 30209 - DNA, 601 bp, Human
tttgtacattttgagtttttttaaaagcgagacttgagctattctagctctgataatatggtgcagtatttgttatgttagttgtagtctttctgggcagtttttacatccccatgagccgttaaaaaaatacctgaacctttaattaggggaaataaattggaaaaatacatttcccttcacttaacattatcttagtttctctttttttttttttttttttttgagatggagtcttgctctgttacccaggctggagtgcagtggtggcgggacctcagctagatgcagcctccgcctsctgggttcaagcaattctcctgcctcagcctgctgagtagctgggattacaggcacctgccactacgcccggctgattttttggtatttttagtagagacggggtttcaccatgttggtgaggctggttttgaactcttgacctcaagtgatctgctcgccttggtctcccaaagtgctaggattacaggcgtgagccactgcacccggcctttttttttttttttttgaggggggggtctcactccatcgtccaggctagaatgctgtggcctgaacatgactcactccagttttgact

SEQ ID NO: 30210 - DNA, 601 bp, Human
ctgataatatggtgcagtatttgttatgttagttgtagtctttctgggcagtttttacatccccatgagccgttaaaaaaatacctgaacctttaattaggggaaataaattggaaaaatacatttcccttcacttaacattatcttagtttctctttttttttttttttttttttgagatggagtcttgctctgttacccaggctggagtgcagtggtggcgggacctcagctagatgcagcctccgcctcctgggttcaagcaattctcctgcctcagcctgctgagtagctgggattrcaggcacctgccactacgcccggctgattttttggtatttttagtagagacggggtttcaccatgttggtgaggctggttttgaactcttgacctcaagtgatctgctcgccttggtctcccaaagtgctaggattacaggcgtgagccactgcacccggcctttttttttttttttttgaggggggggtctcactccatcgtccaggctagaatgctgtggcctgaacatgactcactccagttttgacttccttggctgaagccatcctcccacctcggcttcctgatcccgagtagc

SEQ ID NO: 30211 - DNA, 601 bp, Human
cgttaaaaaaatacctgaacctttaattaggggaaataaattggaaaaatacatttcccttcacttaacattatcttagtttctctttttttttttttttttttttgagatggagtcttgctctgttacccaggctggagtgcagtggtggcgggacctcagctagatgcagcctccgcctcctgggttcaagcaattctcctgcctcagcctgctgagtagctgggattacaggcacctgccactacgcccggctgattttttggtatttttagtagagacggggtttcaccatgttggygaggctggttttgaactcttgacctcaagtgatctgctcgccttggtctcccaaagtgctaggattacaggcgtgagccactgcacccggcctttttttttttttttttgaggggggggtctcactccatcgtccaggctagaatgctgtggcctgaacatgactcactccagttttgacttccttggctgaagccatcctcccacctcggcttcctgatcccgagtagctgggactccaggcacgtgtcaccaatgcatggctaatttttaaatttttttgtagacacaatgtctcgct

SEQ ID NO: 30212 - DNA, 601 bp, Human
catttcccttcacttaacattatcttagtttctctttttttttttttttttttttgagatggagtcttgctctgttacccaggctggagtgcagtggtggcgggacctcagctagatgcagcctccgcctcctgggttcaagcaattctcctgcctcagcctgctgagtagctgggattacaggcacctgccactacgcccggctgattttttggtatttttagtagagacggggtttcaccatgttggtgaggctggttttgaactcttgacctcaagtgatctgctcgccttggtctcycaaagtgctaggattacaggcgtgagccactgcacccggcctttttttttttttttttgaggggggggtctcactccatcgtccaggctagaatgctgtggcctgaacatgactcactccagttttgacttccttggctgaagccatcctcccacctcggcttcctgatcccgagtagctgggactccaggcacgtgtcaccaatgcatggctaatttttaaatttttttgtagacacaatgtctcgctgcattgcccaggctggtcttgaactcctgagctcaagcgattttcccacct

SEQ ID NO: 30213 - DNA, 601 bp, Human
ttcacttaacattatcttagtttctctttttttttttttttttttttgagatggagtcttgctctgttacccaggctggagtgcagtggtggcgggacctcagctagatgcagcctccgcctcctgggttcaagcaattctcctgcctcagcctgctgagtagctgggattacaggcacctgccactacgcccggctgattttttggtatttttagtagagacggggtttcaccatgttggtgaggctggttttgaactcttgacctcaagtgatctgctcgccttggtctcccaaagtgytaggattacaggcgtgagccactgcacccggcctttttttttttttttttgaggggggggtctcactccatcgtccaggctagaatgctgtggcctgaacatgactcactccagttttgacttccttggctgaagccatcctcccacctcggcttcctgatcccgagtagctgggactccaggcacgtgtcaccaatgcatggctaatttttaaatttttttgtagacacaatgtctcgctgcattgcccaggctggtcttgaactcctgagctcaagcgattttcccacctcagccttc

SEQ ID NO: 30214 - DNA, 601 bp, Human
gctctgttacccaggctggagtgcagtggtggcgggacctcagctagatgcagcctccgcctcctgggttcaagcaattctcctgcctcagcctgctgagtagctgggattacaggcacctgccactacgcccggctgattttttggtatttttagtagagacggggtttcaccatgttggtgaggctggttttgaactcttgacctcaagtgatctgctcgccttggtctcccaaagtgctaggattacaggcgtgagccactgcacccggcctttttttttttttttttgaggggggggtctcactccatcgtccaggctagaatgctgtggcctgaacatgactcactccagttttgacttccttggctgaagccatcctcccacctcggcttcctgatcccgagtagctgggactccaggcacgtgtcaccaatgcatggctaatttttaaatttttttgtagacacaatgtctcgctgcattgcccaggctggtcttgaactcctgagctcaagcgattttcccacctcagccttcaaagtgctgggattacaggtgtgagccactgcacccaaccagtttctctctgcaaactag

SEQ ID NO: 30215 - DNA, 601 bp, Human
tgggattacaggcacctgccactacgcccggctgattttttggtatttttagtagagacggggtttcaccatgttggtgaggctggttttgaactcttgacctcaagtgatctgctcgccttggtctcccaaagtgctaggattacaggcgtgagccactgcacccggcctttttttttttttttttgaggggggggtctcactccatcgtccaggctagaatgctgtggcctgaacatgactcactccagttttgacttccttggctgaagccatcctcccacctcggcttcctgatccygagtagctgggactccaggcacgtgtcaccaatgcatggctaatttttaaatttttttgtagacacaatgtctcgctgcattgcccaggctggtcttgaactcctgagctcaagcgattttcccacctcagccttcaaagtgctgggattacaggtgtgagccactgcacccaaccagtttctctctgcaaactagggaaaaaatttacgcttagcagatattgagggctgattatttctatcacagaagcatttggctatagaatttcagggtttagtaaacttgatttacactgaatt

SEQ ID NO: 30216 - DNA, 601 bp, Human
ggctgattatttctatcacagaagcatttggctatagaatttcagggtttagtaaacttgatttacactgaatttttaggtgcatatcagtaaatctacgggcatatgccgcctgcaagttgtgtggcatcacccaaaagccgagagtaatggaaagagcaggctgttagtaatcaggcagatctggctcctgtccaatctaaatcctgttatttagactaatatcttaagtctgttattaagtccgatttctgacgctattaagttaggtgaacaaccttggtaacttaacctctgaacyacagttacttcatctgtaaaatagggatgtatgtatggtaacgattttttaaccacaacttcccaactctaagatggtctgaaaagaattttttgagtgtttggctcagaatcacttggcagcaaaacctgacttgaagttgaggcttcattcatcccacttagtatattcaaatgttttgctaaagaaataattatgaggtgctacttcacactgactagggttgtatatgcattttattgcctattttctaaaacactaaaaatgctaaattctgccccaggtcttgccacagatgtt

SEQ ID NO: 30217 - DNA, 601 bp, Human
ctacgggcatatgccgcctgcaagttgtgtggcatcacccaaaagccgagagtaatggaaagagcaggctgttagtaatcaggcagatctggctcctgtccaatctaaatcctgttatttagactaatatcttaagtctgttattaagtccgatttctgacgctattaagttaggtgaacaaccttggtaacttaacctctgaaccacagttacttcatctgtaaaatagggatgtatgtatggtaacgattttttaaccacaacttcccaactctaagatggtctgaaaagaattttttsagtgtttggctcagaatcacttggcagcaaaacctgacttgaagttgaggcttcattcatcccacttagtatattcaaatgttttgctaaagaaataattatgaggtgctacttcacactgactagggttgtatatgcattttattgcctattttctaaaacactaaaaatgctaaattctgccccaggtcttgccacagatgtttcagtggactatgggcctgtgagaccttaaagggttgattgagtaaggatcacaggtgatgtccgcattgtgcttggcatggagttaagtgcttg

SEQ ID NO: 30218 - DNA, 601 bp, Human
tacgggcatatgccgcctgcaagttgtgtggcatcacccaaaagccgagagtaatggaaagagcaggctgttagtaatcaggcagatctggctcctgtccaatctaaatcctgttatttagactaatatcttaagtctgttattaagtccgatttctgacgctattaagttaggtgaacaaccttggtaacttaacctctgaaccacagttacttcatctgtaaaatagggatgtatgtatggtaacgattttttaaccacaacttcccaactctaagatggtctgaaaagaattttttgwgtgtttggctcagaatcacttggcagcaaaacctgacttgaagttgaggcttcattcatcccacttagtatattcaaatgttttgctaaagaaataattatgaggtgctacttcacactgactagggttgtatatgcattttattgcctattttctaaaacactaaaaatgctaaattctgccccaggtcttgccacagatgtttcagtggactatgggcctgtgagaccttaaagggttgattgagtaaggatcacaggtgatgtccgcattgtgcttggcatggagttaagtgcttga

SEQ ID NO: 30219 - DNA, 601 bp, Human
cgggcatatgccgcctgcaagttgtgtggcatcacccaaaagccgagagtaatggaaagagcaggctgttagtaatcaggcagatctggctcctgtccaatctaaatcctgttatttagactaatatcttaagtctgttattaagtccgatttctgacgctattaagttaggtgaacaaccttggtaacttaacctctgaaccacagttacttcatctgtaaaatagggatgtatgtatggtaacgattttttaaccacaacttcccaactctaagatggtctgaaaagaattttttgagwgtttggctcagaatcacttggcagcaaaacctgacttgaagttgaggcttcattcatcccacttagtatattcaaatgttttgctaaagaaataattatgaggtgctacttcacactgactagggttgtatatgcattttattgcctattttctaaaacactaaaaatgctaaattctgccccaggtcttgccacagatgtttcagtggactatgggcctgtgagaccttaaagggttgattgagtaaggatcacaggtgatgtccgcattgtgcttggcatggagttaagtgcttgata

SEQ ID NO: 30220 - DNA, 601 bp, Human
aaatagggatgtatgtatggtaacgattttttaaccacaacttcccaactctaagatggtctgaaaagaattttttgagtgtttggctcagaatcacttggcagcaaaacctgacttgaagttgaggcttcattcatcccacttagtatattcaaatgttttgctaaagaaataattatgaggtgctacttcacactgactagggttgtatatgcattttattgcctattttctaaaacactaaaaatgctaaattctgccccaggtcttgccacagatgtttcagtggactatgggcctktgagaccttaaagggttgattgagtaaggatcacaggtgatgtccgcattgtgcttggcatggagttaagtgcttgataaatggtggttatcaatctgattatgtaaatttatgtaaattcagttctcaagtttgtggtttttttcccctcctggagaaatctattctattttaaagtgaggaaggctccgtggagggctggtagctggtagctgttcacttgtggaactttcagcctgaggctggagccccttcctgggagtctggtcttgtcgtcttcctgaccacccccacaccctt

SEQ ID NO: 30221 - DNA, 601 bp, Human
gtacaatatcatagttcactgtaacgtgtatctcctgggctcaagcgatcctcccacctcagcctcctgagtagctagtcttcagtagctagactataggtgggcgccaccacagctggctttttaaaaaattttttatgaacacgaggtctcactatgttgcccaggctgccctcaaattcctgggctcaagtgattctcccaccttggccttccgaagtgcagggattataggcgtgcgccactgcacccggccctgttggataaatgattccagtctctcccaaaaagaactgttgtragactgtggggtgaggggagggaagggacaaataggaacccgccgtattttccactccctgtgggcctaaaactgctctaaaaaatagtccatgaaaaaatacatagtacaaacagcaactctttctgatatgcttgcatttaaaatcaggctttttctcccttttggaaaaacacagtccttgtttgctttagggaagagtaaaggtcagtgcgctgcattgcattaatttcgaagggaaagatgagaagacatcttgaaaggaatggctggctttctagagaatagtagaggcttaat

SEQ ID NO: 30222 - DNA, 601 bp, Human
ccaccttggccttccgaagtgcagggattataggcgtgcgccactgcacccggccctgttggataaatgattccagtctctcccaaaaagaactgttgtaagactgtggggtgaggggagggaagggacaaataggaacccgccgtattttccactccctgtgggcctaaaactgctctaaaaaatagtccatgaaaaaatacatagtacaaacagcaactctttctgatatgcttgcatttaaaatcaggctttttctcccttttggaaaaacacagtccttgtttgctttagggaagartaaaggtcagtgcgctgcattgcattaatttcgaagggaaagatgagaagacatcttgaaaggaatggctggctttctagagaatagtagaggcttaataggtgtcatagaaaaaccagggttggacagtggtagtaaaacggcaaaacagattttattcagaaaaactactgcagtaagaggagagagacctcggtacagaactgctccactgcgaatacaaagaaaagtaggaattgatggcgggggagccggatgtcagtggatggaaaattattacgaggaaacacaggggtgtgc

SEQ ID NO: 30223 - DNA, 601 bp, Human
taaaggtcagtgcgctgcattgcattaatttcgaagggaaagatgagaagacatcttgaaaggaatggctggctttctagagaatagtagaggcttaataggtgtcatagaaaaaccagggttggacagtggtagtaaaacggcaaaacagattttattcagaaaaactactgcagtaagaggagagagacctcggtacagaactgctccactgcgaatacaaagaaaagtaggaattgatggcgggggagccggatgtcagtggatggaaaattattacgaggaaacacaggggtgtgcrttcttgctgaaggcaggccagagttatcagacatcacctgagggatggagggggatgtggaacctaatcggctgtctagggtgatcagatactgaagttgggggattctggtcaaatcaatttagcaggattcttggtaaaactgggcgatgcaaagacagatgcgttgagtacaaagtccaggccttattgggaagaggatttcagcggagcccgagtagagtttggtctagggagactctgtcactgggaggacgagcgagccgctcggaagtgcgctgggttctcttagcggccagt

SEQ ID NO: 30224 - DNA, 601 bp, Human
caaaacagattttattcagaaaaactactgcagtaagaggagagagacctcggtacagaactgctccactgcgaatacaaagaaaagtaggaattgatggcgggggagccggatgtcagtggatggaaaattattacgaggaaacacaggggtgtgcattcttgctgaaggcaggccagagttatcagacatcacctgagggatggagggggatgtggaacctaatcggctgtctagggtgatcagatactgaagttgggggattctggtcaaatcaatttagcaggattcttggtaaaaytgggcgatgcaaagacagatgcgttgagtacaaagtccaggccttattgggaagaggatttcagcggagcccgagtagagtttggtctagggagactctgtcactgggaggacgagcgagccgctcggaagtgcgctgggttctcttagcggccagtgggttctggtgagaagggcaacagcgggaggaggcgccggtgcggagcgggaggccgggggcggggctgcggggctgcggggcgggcccgttgtgggtcggcccagcgcgtattcgagtagagggcgagcccgtcccgcctct

SEQ ID NO: 30225 - DNA, 601 bp, Human
gagacctcggtacagaactgctccactgcgaatacaaagaaaagtaggaattgatggcgggggagccggatgtcagtggatggaaaattattacgaggaaacacaggggtgtgcattcttgctgaaggcaggccagagttatcagacatcacctgagggatggagggggatgtggaacctaatcggctgtctagggtgatcagatactgaagttgggggattctggtcaaatcaatttagcaggattcttggtaaaactgggcgatgcaaagacagatgcgttgagtacaaagtccaggcyttattgggaagaggatttcagcggagcccgagtagagtttggtctagggagactctgtcactgggaggacgagcgagccgctcggaagtgcgctgggttctcttagcggccagtgggttctggtgagaagggcaacagcgggaggaggcgccggtgcggagcgggaggccgggggcggggctgcggggctgcggggcgggcccgttgtgggtcggcccagcgcgtattcgagtagagggcgagcccgtcccgcctctcgtcgggcgcttcccagatctgcttgagtctatggaggaaaaa

SEQ ID NO: 30226 - DNA, 601 bp, Human
aactgggcgatgcaaagacagatgcgttgagtacaaagtccaggccttattgggaagaggatttcagcggagcccgagtagagtttggtctagggagactctgtcactgggaggacgagcgagccgctcggaagtgcgctgggttctcttagcggccagtgggttctggtgagaagggcaacagcgggaggaggcgccggtgcggagcgggaggccgggggcggggctgcggggctgcggggcgggcccgttgtgggtcggcccagcgcgtattcgagtagagggcgagcccgtcccgccyctcgtcgggcgcttcccagatctgcttgagtctatggaggaaaaactccgcggggtccgcgattcccatggccgcagccgcctgcggcaccaaggccatggccctcttcaagcgcaccttggtgctgagtcccgccgcggcgcccaggggcccgggcgcaggcaccgccccgcggggctgctgcttgcctcctgccgcctggccctgcaaggactggcctcggggagagggcggcaggctgtggagccgcctgccccagtcccactcccactcccactcccactcccactcctgctcctc

SEQ ID NO: 30227 - DNA, 601 bp, Human
tgcctcctgccgcctggccctgcaaggactggcctcggggagagggcggcaggctgtggagccgcctgccccagtcccactcccactcccactcccactcccactcctgctcctcgacgtctcccaccgccgtgtgtgttgtctgcccgcaggactcgctcagcagcagcctgaaaacttgctacaagtatctcaatcagaccagtcgcagtttcgcagctgttatccaggcgctggatggggaaatgcggtgagtgatggaggcagcgcctctggcttggaggaaagcttgtccgggacytttgagtgtgttggaagctaccttttgatatagcgctcagcgttgcagcctcgttgctgtggcttatccagaacatagcccggccctacgtgtttactttagaaagcccttccaggctctttgccatctagtagagtccctgcgggcccagcctttcagagaagaggggggagggggtgatgtttattaactttttttagtcttggcagctgaacctgcctgtgagcaggtcgtgtatttctcggcttcccttatccaactttgcatttctatttctagcatattgggttgattcttttg

SEQ ID NO: 30228 - DNA, 601 bp, Human
gcagcctgaaaacttgctacaagtatctcaatcagaccagtcgcagtttcgcagctgttatccaggcgctggatggggaaatgcggtgagtgatggaggcagcgcctctggcttggaggaaagcttgtccgggacttttgagtgtgttggaagctaccttttgatatagcgctcagcgttgcagcctcgttgctgtggcttatccagaacatagcccggccctacgtgtttactttagaaagcccttccaggctctttgccatctagtagagtccctgcgggcccagcctttcagagaagrggggggagggggtgatgtttattaactttttttagtcttggcagctgaacctgcctgtgagcaggtcgtgtatttctcggcttcccttatccaactttgcatttctatttctagcatattgggttgattcttttgaagctgcctctgtgcacattacacccatgaacttagaccagttgcctttatgtatgatcgtatttatactgagaagttactgtgttttttgactttcttttctatttgctacatattagttcggtctaaacgtttggtcttctggtctccatagttctacattgg

SEQ ID NO: 30229 - DNA, 601 bp, Human
gctaccttttgatatagcgctcagcgttgcagcctcgttgctgtggcttatccagaacatagcccggccctacgtgtttactttagaaagcccttccaggctctttgccatctagtagagtccctgcgggcccagcctttcagagaagaggggggagggggtgatgtttattaactttttttagtcttggcagctgaacctgcctgtgagcaggtcgtgtatttctcggcttcccttatccaactttgcatttctatttctagcatattgggttgattcttttgaagctgcctctgtgcasattacacccatgaacttagaccagttgcctttatgtatgatcgtatttatactgagaagttactgtgttttttgactttcttttctatttgctacatattagttcggtctaaacgtttggtcttctggtctccatagttctacattggttaaatgcaactcacttctgggagtagtggtgacattcaactagtaggctttttaataaactacagaagttcattactctcatgtaaggaaggaaaactaatgtaactttcgttaagtatgaaaagcgttggatatccttatagttctttag

SEQ ID NO: 30230 - DNA, 601 bp, Human
aaacgtttggtcttctggtctccatagttctacattggttaaatgcaactcacttctgggagtagtggtgacattcaactagtaggctttttaataaactacagaagttcattactctcatgtaaggaaggaaaactaatgtaactttcgttaagtatgaaaagcgttggatatccttatagttctttagagttaagggtgagatgggtttagaaagtggccaggcacaagttattttaaaataaaaaatctttggctgtttgttccaatatattaatagttttcccttttttacagcaaygcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacggtgagtggggttacgcatcttgtctacggactgttgtgttcataattgctaacgtggttgtccggtagcctccatacatgtggagaaaggttaaataagcattctgagggcagcataatg

SEQ ID NO: 30231 - DNA, 601 bp, Human
taattccgccattgtttgccttgtgatctttggtgccatgtctgtacatatttcatgatttctgtgtttttacggtttccatttcagatctcccttgagtttagaaatctggctgagaaataccaaacagtgattgccgacatttgccggagaatgggcattgggatggcagagtttttggataagcatgtgacctctgaacaggagtgggacaaggttagtctcataaaacagtgtctgtgtgtgatgtattagacagagctggcagtcctcatagtgaagctcagaacaagaaaagttrtccagtattttcagcccctctggttttacaattcatctgtttaggttgaatgtctcatcataaacagtttattccagagttaattccaaaccagcagctatgtaggatatcagccaggctaggagtagggtactggagagaagtgcttatctagacaaagggatgtaattgaccatgaagattaaaactacacatcaaaacataaggtagggttaggagtcttgcctatttttcataggaatggtgtttgtgagacttactcatcacttctgtggaagtaaagacattttatttatttat

SEQ ID NO: 30232 - DNA, 601 bp, Human
tcagcccctctggttttacaattcatctgtttaggttgaatgtctcatcataaacagtttattccagagttaattccaaaccagcagctatgtaggatatcagccaggctaggagtagggtactggagagaagtgcttatctagacaaagggatgtaattgaccatgaagattaaaactacacatcaaaacataaggtagggttaggagtcttgcctatttttcataggaatggtgtttgtgagacttactcatcacttctgtggaagtaaagacattttatttatttattttaaagccartcagatttagcaggcagagacatttcagacatctaaagtgttgatgtatttcatacctttaactgtgcttaaattaggatctccgaaaagatgctgctacatggtcactacgttagtgtaggtccaaggtcttgggcctcttaatttttcaaacctcaaaacttgacagcagttatctttggaactgctgatttgtgcttcctaagttaacagcatacaatgactgctagaaatcaatttctgcatttaaggtgaagttagccgggtactatggtttacctgtaatctcagcactttggg

SEQ ID NO: 30233 - DNA, 601 bp, Human
ggattgcttgagcccaagagttgaaggttgcagtgagccatgattgtgccactgcactccaacgtgggtgacagagcaagacaccatctgaaagaaaataaagttgaagttaaaacttctggccaagaaccagcactggttatgatagtaactcattttctgttgtgcagatttattcaggaaacttaattttaggttgttgaatagaagttttgatcagataaaattgaattaaaaaaaattttttttgagacagggtcttgctgttatccaggctggtgtgtagtggtgtgatcacggytccccgcagcctcaacctcctgggctcaggtgatcctcccacctcagcctaccgagtagctgtaactacagtgcatgacaccataccaggctcatttttgtacattttttgtagagagagggttttgccatgttgcccaggctagtctcaaactcctggcatcaaacagtcctcccactctggcctctcaaatgttgggattacaggcatgaccagccaattatttcaaggagttattttttttcttctactttgggggaagatgaattatataagtctccattttaggagtatttctac

SEQ ID NO: 30234 - DNA, 601 bp, Human
aatttctgtctacctaatttcagcaagatttcactcttttcatgttacttttgtcccagaacaaatttcaagtgctttctcttcacctgtgcattcttccccctgattagtctctggctttgtattactttcagtcagagacgactttttttttttgagacagggtctcactctgtcacccagactggaatgcagtggcacagacaaggcagccttgaccttctgggctcaagcaatcttccttgccctcagcctcctgagtaactgggaccacaggcacgttgccaccatgcctggctartttattttaatttttattatttttgagacagggtattgctctgtcacccaggctggagtgtagtggcatgatcaaggctcactgcagccttcacctcctgtgctcaagcagtcctctcacctcagcctccccattagctgggactataggtccacaccactacaccaggctaatttttgtaattttttggtagagacagggtttcatcgtgttgcctaggctggtcttgagctcctgggctcaagcgattcacctgccttagcctcccaggtgtgagccactacactcagccttttaaaa

SEQ ID NO: 30235 - DNA, 601 bp, Human
gactttttttttttgagacagggtctcactctgtcacccagactggaatgcagtggcacagacaaggcagccttgaccttctgggctcaagcaatcttccttgccctcagcctcctgagtaactgggaccacaggcacgttgccaccatgcctggctaatttattttaatttttattatttttgagacagggtattgctctgtcacccaggctggagtgtagtggcatgatcaaggctcactgcagccttcacctcctgtgctcaagcagtcctctcacctcagcctccccattagctggractataggtccacaccactacaccaggctaatttttgtaattttttggtagagacagggtttcatcgtgttgcctaggctggtcttgagctcctgggctcaagcgattcacctgccttagcctcccaggtgtgagccactacactcagccttttaaaattttttacagagatgaggtcttgctttgttggccaggctggtctaaaactcttgggctcaagcagtcccctctccacagcctcccaaaattccgggattacaggcgtgaacttcggtcatttcctaacttttacccttccta

SEQ ID NO: 30236 - DNA, 601 bp, Human
cctgacctcgtgatccgcccgtctcagcttcccaaagtgctgggattacaggcatgagccatcgtgcccggctgaatgtgcagagttcttaaaacagtgtcaagaacataaaatagttatttgttctttcatataatgatgattttgagggcctgcggatcttgacatgttatcagattggtcaaaaaaagattaaaccatagttggtattgtcctagttcctgttaccagaatattccatctttcatcgttgccttctctcatagttttatgtatcaaaaagtttattgtaaagctaggscgggcacggtgtcttgggctggtaatcccagcactttgggaggccaaggctggcagatcagttgaggtcaggagttcgagaccagcgtggccaacatggtgaaaccccgtctctactaaaaataaaaaattagctggatgtggtggtgggtgctttaattccagctactcaggaagctgaggcaggagaatcacttgaacccaagaggcagaggttgcagtgagttgagattgtgccactgcactccagcccaggggacaaagtgagacttgatctcaaaaaaaaaaaaaaaaaaaagtt

SEQ ID NO: 30237 - DNA, 601 bp, Human
ttggcctttcccgtcttttctcagcctcagagtttgaagaccccttagttggtgaagatacagaacgtgccaactctatgggcctgtttctgcagaaaacaaacatcatccgtgactatctggaagaccagcaaggaggaagagagttctggcctcaagaggtaacagattcagggtattttgggggaaaataactttagacattctctgaaaaatcctttaactcttgtggttgcgggtgacagaaaaacaagtcaggcctcccccaggcagcataaggggatgtggaaaataggatagwttgacatgagtttgcttcaggtagactggctgactcccaggattcacaccacgtaatcagtatattcaagccttgctgtccttgatttctttcagacggtctttctccaagtggtggatatggtaacaacccatgtgcactagcttaacaaaaagttcttaggaatggctttgttcggcctggcgcagtggctcatgcctgtaatcccaacagtttgagaggccaaggtgggcggatcacctgaggccaggagttcgagaccagcctggccaacatagtgaaaccccgtgtttactaaaa

SEQ ID NO: 30238 - DNA, 601 bp, Human
ggaggaagagagttctggcctcaagaggtaacagattcagggtattttgggggaaaataactttagacattctctgaaaaatcctttaactcttgtggttgcgggtgacagaaaaacaagtcaggcctcccccaggcagcataaggggatgtggaaaataggatagattgacatgagtttgcttcaggtagactggctgactcccaggattcacaccacgtaatcagtatattcaagccttgctgtccttgatttctttcagacggtctttctccaagtggtggatatggtaacaacccaygtgcactagcttaacaaaaagttcttaggaatggctttgttcggcctggcgcagtggctcatgcctgtaatcccaacagtttgagaggccaaggtgggcggatcacctgaggccaggagttcgagaccagcctggccaacatagtgaaaccccgtgtttactaaaaaatacaaaaattagccgggcgtggtggcaagggcttgtaatcccagctacctgggaggctgaggcaggagaatcgcttgaacccaggaagcagagattgcggtgagctcagattgtgccactgcactccagcct

SEQ ID NO: 30239 - DNA, 601 bp, Human
ctgaaaaatcctttaactcttgtggttgcgggtgacagaaaaacaagtcaggcctcccccaggcagcataaggggatgtggaaaataggatagattgacatgagtttgcttcaggtagactggctgactcccaggattcacaccacgtaatcagtatattcaagccttgctgtccttgatttctttcagacggtctttctccaagtggtggatatggtaacaacccatgtgcactagcttaacaaaaagttcttaggaatggctttgttcggcctggcgcagtggctcatgcctgtaatcmcaacagtttgagaggccaaggtgggcggatcacctgaggccaggagttcgagaccagcctggccaacatagtgaaaccccgtgtttactaaaaaatacaaaaattagccgggcgtggtggcaagggcttgtaatcccagctacctgggaggctgaggcaggagaatcgcttgaacccaggaagcagagattgcggtgagctcagattgtgccactgcactccagcctgggcgacagagtgagactccctctcaaaagaagaggaagggcttggttcttctgctcagccctgaatcagtta

SEQ ID NO: 30240 - DNA, 601 bp, Human
acctgaggccaggagttcgagaccagcctggccaacatagtgaaaccccgtgtttactaaaaaatacaaaaattagccgggcgtggtggcaagggcttgtaatcccagctacctgggaggctgaggcaggagaatcgcttgaacccaggaagcagagattgcggtgagctcagattgtgccactgcactccagcctgggcgacagagtgagactccctctcaaaagaagaggaagggcttggttcttctgctcagccctgaatcagttactgttgctacacagctgagttctctggcctcrcctggattacgtctacacagtacacacagaatggatttcccccaaagaaagaattctgcggcaggaaggggaaagggatggcaggtagacaaaaactccaggtgtctgtaataagggacagggtcgatctttaattaaaacatggacagggaacagaaagcttttgatactgattttgttcagaaggaaagtagaaaattttatgactgttccctgaatttattccagcatttaccttttgctttccataaaagtgtttcctgcagccaagtactttaaagttttaaaaagacgggtgag

SEQ ID NO: 30241 - DNA, 601 bp, Human
aaaatacaaaaattagccgggcgtggtggcaagggcttgtaatcccagctacctgggaggctgaggcaggagaatcgcttgaacccaggaagcagagattgcggtgagctcagattgtgccactgcactccagcctgggcgacagagtgagactccctctcaaaagaagaggaagggcttggttcttctgctcagccctgaatcagttactgttgctacacagctgagttctctggcctcacctggattacgtctacacagtacacacagaatggatttcccccaaagaaagaattctgcrgcaggaaggggaaagggatggcaggtagacaaaaactccaggtgtctgtaataagggacagggtcgatctttaattaaaacatggacagggaacagaaagcttttgatactgattttgttcagaaggaaagtagaaaattttatgactgttccctgaatttattccagcatttaccttttgctttccataaaagtgtttcctgcagccaagtactttaaagttttaaaaagacgggtgaggctaagtgtggtgtctcatacttataatcccagtgctgaggccaggagttcaagaccagc

SEQ ID NO: 30242 - DNA, 601 bp, Human
tgtggtgtctcatacttataatcccagtgctgaggccaggagttcaagaccagcctgagcaacacagcaagataccatctctataaaaaattgttagaaaatgattctgctgaaagagcaaaaataaaaattaaagaaagtagaaaaaataaaactaaatttaaaagattaactgggcatgttggcatgcacctgtattcctaggtattcgggaggctaaggcacaaggatcccttgagcgcaggagctcaaggttggattgagttgtaatcacaccactgcactccagcctcggtggcasaatgaaactgtctcaagaaaaaaaaaaagtgacagagggaaacaatatttgcaattcatagagcagatacagggttcatattcctaatattaaaaaaaacttctaaaagttaagaaaaaggccaactgccccacagaaaaatgggcaaggagataagaacaagattgttcacaggaagagacacacagatgattattaaaaatctgaaaagatgctgagtcttactcctaagaaaaattcacatttaaactactctgggggctgggcaaggtggctcacgcctgtaatctcaacactggg

SEQ ID NO: 30243 - DNA, 601 bp, Human
acttctaaaagttaagaaaaaggccaactgccccacagaaaaatgggcaaggagataagaacaagattgttcacaggaagagacacacagatgattattaaaaatctgaaaagatgctgagtcttactcctaagaaaaattcacatttaaactactctgggggctgggcaaggtggctcacgcctgtaatctcaacactgggagaccaaggcaggaagatcactgaagccagggtatcgagaccagcctggacaacgtagtgagaccttatctcttaaaacaaaacaaaacaaaacaaaamaaaaaaaacagtaaaaattggccgggcacagtgactcctgcctataatcccagcactttgggaagcccaggtgagtggatcacttgaggtcaggtgtttgagaacagcctggccaacatggcaaaactccgtctctactaaaattacaaaaattagccaagtgtggtggcatacgctggtagggccagctacttgggaggctgatgtgagactccatttaaaaaaaaaaaatcaaaaattagctgggtatagtggcacacccctatagttctcgctccttgggaggttgaggcaggagga

SEQ ID NO: 30244 - DNA, 601 bp, Human
tcctaagaaaaattcacatttaaactactctgggggctgggcaaggtggctcacgcctgtaatctcaacactgggagaccaaggcaggaagatcactgaagccagggtatcgagaccagcctggacaacgtagtgagaccttatctcttaaaacaaaacaaaacaaaacaaaacaaaaaaaacagtaaaaattggccgggcacagtgactcctgcctataatcccagcactttgggaagcccaggtgagtggatcacttgaggtcaggtgtttgagaacagcctggccaacatggcaaaaytccgtctctactaaaattacaaaaattagccaagtgtggtggcatacgctggtagggccagctacttgggaggctgatgtgagactccatttaaaaaaaaaaaatcaaaaattagctgggtatagtggcacacccctatagttctcgctccttgggaggttgaggcaggaggattgcctgagcccaggagttcaaggctgcagtgaaccatgatcacaccactgcattctagcagcctgggagacagagcaaaacccttgtctcaaaacaaacaaacaacaacaaaaaaacaaaaaacac

SEQ ID NO: 30245 - DNA, 601 bp, Human
ctcctgcctataatcccagcactttgggaagcccaggtgagtggatcacttgaggtcaggtgtttgagaacagcctggccaacatggcaaaactccgtctctactaaaattacaaaaattagccaagtgtggtggcatacgctggtagggccagctacttgggaggctgatgtgagactccatttaaaaaaaaaaaatcaaaaattagctgggtatagtggcacacccctatagttctcgctccttgggaggttgaggcaggaggattgcctgagcccaggagttcaaggctgcagtgaaycatgatcacaccactgcattctagcagcctgggagacagagcaaaacccttgtctcaaaacaaacaaacaacaacaaaaaaacaaaaaacacttccctcagctcagacatggccttttaagtttcctaggtgactcgtgtgcagccagggttgagaaaccactcttgtcttacccctcttttgcagacacagggctcagagaagggaaggggattgtctggggatgtatagtgaggcagtggctgccttggaagtggagtctcagtctcccggctcctaggccagcccctgaccactgtt

SEQ ID NO: 30246 - DNA, 601 bp, Human
gagaacagcctggccaacatggcaaaactccgtctctactaaaattacaaaaattagccaagtgtggtggcatacgctggtagggccagctacttgggaggctgatgtgagactccatttaaaaaaaaaaaatcaaaaattagctgggtatagtggcacacccctatagttctcgctccttgggaggttgaggcaggaggattgcctgagcccaggagttcaaggctgcagtgaaccatgatcacaccactgcattctagcagcctgggagacagagcaaaacccttgtctcaaaacaaasaaacaacaacaaaaaaacaaaaaacacttccctcagctcagacatggccttttaagtttcctaggtgactcgtgtgcagccagggttgagaaaccactcttgtcttacccctcttttgcagacacagggctcagagaagggaaggggattgtctggggatgtatagtgaggcagtggctgccttggaagtggagtctcagtctcccggctcctaggccagcccctgaccactgttccattgtctcccagacagaacatcagccacgggcatgtgatgcatgagcgtgagccacaccatct

SEQ ID NO: 30247 - DNA, 601 bp, Human
aacagcctggccaacatggcaaaactccgtctctactaaaattacaaaaattagccaagtgtggtggcatacgctggtagggccagctacttgggaggctgatgtgagactccatttaaaaaaaaaaaatcaaaaattagctgggtatagtggcacacccctatagttctcgctccttgggaggttgaggcaggaggattgcctgagcccaggagttcaaggctgcagtgaaccatgatcacaccactgcattctagcagcctgggagacagagcaaaacccttgtctcaaaacaaacaaacaacaacaaaaaaacaaaaaacacttccctcagctcagacatggccttttaagtttcctaggtgactcgtgtgcagccagggttgagaaaccactcttgtcttacccctcttttgcagacacagggctcagagaagggaaggggattgtctggggatgtatagtgaggcagtggctgccttggaagtggagtctcagtctcccggctcctaggccagcccctgaccactgttccattgtctcccagacagaacatcagccacgggcatgtgatgcatgagcgtgagccacaccatcttgc

SEQ ID NO: 30248 - DNA, 601 bp, Human
tggccaacatggcaaaactccgtctctactaaaattacaaaaattagccaagtgtggtggcatacgctggtagggccagctacttgggaggctgatgtgagactccatttaaaaaaaaaaaatcaaaaattagctgggtatagtggcacacccctatagttctcgctccttgggaggttgaggcaggaggattgcctgagcccaggagttcaaggctgcagtgaaccatgatcacaccactgcattctagcagcctgggagacagagcaaaacccttgtctcaaaacaaacaaacaacaacaaaaaaacaaaaaacacttccctcagctcagacatggccttttaagtttcctaggtgactcgtgtgcagccagggttgagaaaccactcttgtcttacccctcttttgcagacacagggctcagagaagggaaggggattgtctggggatgtatagtgaggcagtggctgccttggaagtggagtctcagtctcccggctcctaggccagcccctgaccactgttccattgtctcccagacagaacatcagccacgggcatgtgatgcatgagcgtgagccacaccatcttgcacacaca

SEQ ID NO: 30249 - DNA, 601 bp, Human
tcgctccttgggaggttgaggcaggaggattgcctgagcccaggagttcaaggctgcagtgaaccatgatcacaccactgcattctagcagcctgggagacagagcaaaacccttgtctcaaaacaaacaaacaacaacaaaaaaacaaaaaacacttccctcagctcagacatggccttttaagtttcctaggtgactcgtgtgcagccagggttgagaaaccactcttgtcttacccctcttttgcagacacagggctcagagaagggaaggggattgtctggggatgtatagtgaggsagtggctgccttggaagtggagtctcagtctcccggctcctaggccagcccctgaccactgttccattgtctcccagacagaacatcagccacgggcatgtgatgcatgagcgtgagccacaccatcttgcacacacaggagcagagccctgctcttctcattcacttactttatctgtaaaatagcatcatttctaccacacggtggtggtgtgaataaaatgagatgaacttctagcatagagtgcttagtaaaggttctggacatttcgtagtagttgaatcatgccaaatgtggtc

SEQ ID NO: 30250 - DNA, 601 bp, Human
aggagcagagccctgctcttctcattcacttactttatctgtaaaatagcatcatttctaccacacggtggtggtgtgaataaaatgagatgaacttctagcatagagtgcttagtaaaggttctggacatttcgtagtagttgaatcatgccaaatgtggtcctaggtgattggcttcttttgctagcatgttttcagggctcctccatgctggggcattgcatcactgctttattcctttttatcgcctagtattattccactgtgtggatagaccacatttatccattcatcagttgraggatatttgggttcttcccattttttttggctatggtgaatagtactgtgtacatttgcatataaggttttgtgtagatgtgtgttttcctttttcttgggtctatgctgagaagtggaattgctggttcatacagcagctcgaaccttgtgaggagctgccagacgcttttccaaggtcgctccaccattttacattcccgtcagcagtgtgagagtcccagtttcaccagcacttgttgttatctctttttaactgtatgtatatatacttaacattttatttataataaatgtaca

SEQ ID NO: 30251 - DNA, 601 bp, Human
ccaaatgtggtcctaggtgattggcttcttttgctagcatgttttcagggctcctccatgctggggcattgcatcactgctttattcctttttatcgcctagtattattccactgtgtggatagaccacatttatccattcatcagttggaggatatttgggttcttcccattttttttggctatggtgaatagtactgtgtacatttgcatataaggttttgtgtagatgtgtgttttcctttttcttgggtctatgctgagaagtggaattgctggttcatacagcagctcgaaccttktgaggagctgccagacgcttttccaaggtcgctccaccattttacattcccgtcagcagtgtgagagtcccagtttcaccagcacttgttgttatctctttttaactgtatgtatatatacttaacattttatttataataaatgtacataatagagaatttgccattttaactatttttaagtctattattcagtggcattaagtacattaatgatgttatataaccatcaacactatgtttccagaactttcgctagcttcagagaatcctctaaataatatcattaaaaatcatcaa

SEQ ID NO: 30252 - DNA, 601 bp, Human
aaaaatcatcaagccgaatcccactgttagaattaaaggttttatttcactttcaagttatcaggatccagggaggtgtaatacacttagaggatagactcagctcatttcccagctatgcctttcagcagcattcttaccagagtaggaatataatgttagtcattatttagaggcctggccatcttgagaaggtttactgtttagtctgcagtacaattataactgtttttgtatattgggttatttttttcagaagtaggccagtagctctaacaggagcctctttagcctgaattcrtccaagtagtgcagtgttgcactagttgtccctcgggacatgctccccaatacgtaactcacttccaggttgcaactggacacttactggtagtcagaaatagctattgcatggagcttaaaatgaacttgatcttcgtgaaagatgagtctgcagctaagagactttactgtatatcatagtgtttttttttgttttgttttgtttttgtttttgtgacggagtctcactctttcacccaggctggagtgcaatggcgagatcttgactcactgcaacctccgccccctaggttcaagc

SEQ ID NO: 30253 - DNA, 601 bp, Human
tcatagttcttatgcacaaagaccctttaatattgtttgtaaattctcccctatgcacacgctgacctgttccttaatcttcttatctgtctaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtagggaacggggctcctctgggtggatayggggctaaagggagtggggtaggagtaagggtggattttgctgtgctatattcaaggatatgattccttaaaaagacgatgactccagtttattacgctgggagtttcatagcacccgcctttgcttccagccaccaaactcagctcagccttgaggttaagcctgctccttttcagaaccttctttctggatttactattttctacagctatcctaaactagttaggttcttttcctcacagttaagtcaaggtctttggcttagatttatggggagtgctgggtaaaacctgggtgaa

SEQ ID NO: 30254 - DNA, 601 bp, Human
actgcaccacatcccagatgtcatcacctacctttcgagactcagaaaccagagtgtgtttaacttctgtgctattccacaggtagggaacggggctcctctgggtggatacggggctaaagggagtggggtaggagtaagggtggattttgctgtgctatattcaaggatatgattccttaaaaagacgatgactccagtttattacgctgggagtttcatagcacccgcctttgcttccagccaccaaactcagctcagccttgaggttaagcctgctccttttcagaaccttctttcyggatttactattttctacagctatcctaaactagttaggttcttttcctcacagttaagtcaaggtctttggcttagatttatggggagtgctgggtaaaacctgggtgaagctgttatcattaaaaagtcttcattaagcacctaattactgctgtccttttcctagacccggcataaaaagaacctggtccggtagacctagcctctcagtatgctaggaacttacactttttagttgcctttaccaagtattgcagatactactgcaaataagtgaagaaagtaacagcatttaact

SEQ ID NO: 30255 - DNA, 601 bp, Human
gcaattgcccattcaacagaaggttttcttacctttttgtgataatgatagctaacgacatcatttcttcttttttccctctcttcttgttgtctctaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagaggtgggtttttatttaactacttggataatttgtagctacttttatgatktagtaatgtcactgtttaaccaggtttggatattagatgatcctaacaattcactatcctgtggcctaaagagacaggaattgatatcctttataaggaaaaaagtctattcacaggagccgagcagattgctcactgctgtgtagtaccctggtgagaggagataaatggagcaaggctgtaggttggagcccctcagtagaatcatagattttgagctgcaagatgatgcaggaggccaaccaagcttcttgttgctggtgaggaatgtgaggttgaagcttgtctgtgctgatgcag

SEQ ID NO: 30256 - DNA, 601 bp, Human
gaggccaaccaagcttcttgttgctggtgaggaatgtgaggttgaagcttgtctgtgctgatgcagtgcgtgattgagtggatctctggctcccgtccatgtgtcctgacacccagtctggtactttcattatgccacaggcctcaattgaaaaatcacagtagggaatttaggccaaggaaagccatcaagttgcaattatttcctaaattttctttggaaaatttcatttcaaataccaaaaccatcctataaaaagaaaacttaccttcttaggtcaaatctctaatatttgactagrttcaaaaagtttatttctggccaggcacagtagcttactcctgaaatcccagcactttgggagaccaaggtgggaggatcacttgaggccaggaattcaagaccagcccgggcgacatagcaagaccccatttctacaaaaaatttaaaaattgtcatggtggtgcacgcctgtggtcccagctactcaggaggctgaggcaggtggatcacatgagcctgagaggtcgaggctacagtaagctgtgtgatttcatcattgcactctagcctgggtgatagagtgagactttgtctcaaa

SEQ ID NO: 30257 - DNA, 601 bp, Human
tctctaggccctagagcagtggtttgtaaatggaggtgatttgctcccctccccccagaggacattggacaatgtctggagacatttttgattgtcctaaccggcaggaatcgggtgctactggcatctggtgagtagaggcccaggatgatgctgtgatcctcaggtgtgatcctgttgagaatgaaacactgtagactttatgaaaacatacaagaccctcatcatttttcctttgcctgagctccctccccagaggttacctctgttcatggttttgtgcatccgtctagtccccctrttacgcgtttacaggaatatggtttgcaacagtgttttcatctaaatagaattatacaaaatagcgatttctgatttctcttgcatattgcacattcttcttatacttcctccctacctttatctgacacagaaatgctgtatgtccagaacttctatcagaggcacctatggaagtctaagggaagaccacatcgcttttaaaaaccctaaaattttgtagtcactagatgaaaatattcagccagtgacccaaaaaattgctaccaatgagactctccattttgccatgtagccagaa

SEQ ID NO: 30258 - DNA, 601 bp, Human
atcgcttttaaaaaccctaaaattttgtagtcactagatgaaaatattcagccagtgacccaaaaaattgctaccaatgagactctccattttgccatgtagccagaacttactttgatctatgtgcctggggtagtgaccaagtaggtgggtaggagtaatctcagggaaacttgaggccccagcctcatggctagggtcataatttgaacccaggtctgtctgacatcagaatccatgatgttaaccccaattctaaggggttcaactaccctttctaaatggaatcctgctatattargcactatttattcattttatataaactagaaacattttatgtagtaagtagttgagagtgttttggttttgcagtttgatcactagttttagaaaccagtttttaaacactttgtggccaattccattactatattaaaattcagatttatttggtttttccttaactattgggattaaatcctggttgtaattcatagtttgagggcgagggtgggcagtctacagttggctgagccctgtttttgtgaataaatgttatcagaacacagccacacccatttgcttctatgtcttctgt

SEQ ID NO: 30259 - DNA, 601 bp, Human
ctgctgtatgtagcacagcattgcacaagagcttatttcagtctagtaaacatttataggagcctgtgtcatttaatcatcaagcctcgcactgtggctcacacctgtaatcccaaaactttgggaggctgaggcaggcagatcacttgaggtaaggagttcgagaccagcctggccaatatggcaaaaccctgtctctactaaaaatacaacatttagccaggtgtggtggtgcacacttgtcatcccagctattccggagcctgagacatgagcatcgcttgaactcgggaggtggagkttgtagtgagctgagatggcaccactgcactccagcctgggcaacagggtgaaggccctttctcaaacccctcaagtatttggcttcaactttatgccgggcatgtagatgaaaagtcggctatgacctgtccttgacaagcagatgtaactccttgattgaggctagtaggtttttaagacctgaataattgagtttgcagaaacctactgtgtgccttcaggtaaatggagagtggggtttggtctagcaacgaagcatctagaaggtccctttggccttaccggctctgttttaggt

SEQ ID NO: 30260 - DNA, 601 bp, Human
catttaatcatcaagcctcgcactgtggctcacacctgtaatcccaaaactttgggaggctgaggcaggcagatcacttgaggtaaggagttcgagaccagcctggccaatatggcaaaaccctgtctctactaaaaatacaacatttagccaggtgtggtggtgcacacttgtcatcccagctattccggagcctgagacatgagcatcgcttgaactcgggaggtggaggttgtagtgagctgagatggcaccactgcactccagcctgggcaacagggtgaaggccctttctcaaacycctcaagtatttggcttcaactttatgccgggcatgtagatgaaaagtcggctatgacctgtccttgacaagcagatgtaactccttgattgaggctagtaggtttttaagacctgaataattgagtttgcagaaacctactgtgtgccttcaggtaaatggagagtggggtttggtctagcaacgaagcatctagaaggtccctttggccttaccggctctgttttaggtaagtccacgtctgagtaccagtgactgcagctcttccagttgtgctgtcatgcttatatgttagaaatg

SEQ ID NO: 30261 - DNA, 601 bp, Human
gagcatcgcttgaactcgggaggtggaggttgtagtgagctgagatggcaccactgcactccagcctgggcaacagggtgaaggccctttctcaaacccctcaagtatttggcttcaactttatgccgggcatgtagatgaaaagtcggctatgacctgtccttgacaagcagatgtaactccttgattgaggctagtaggtttttaagacctgaataattgagtttgcagaaacctactgtgtgccttcaggtaaatggagagtggggtttggtctagcaacgaagcatctagaaggtcyctttggccttaccggctctgttttaggtaagtccacgtctgagtaccagtgactgcagctcttccagttgtgctgtcatgcttatatgttagaaatgatcatcaaaggactcaaaagttttgccactaattgtattaccggggactgtcacaaccaagatttctcttaatttattcaccttacttatctcctggaagggcatattgaagtgctcttggagttctctaaaagggtttttgttggttgtgtatattcacttgggtgccagcgattgattccaaataagtaaatcttttttcc

SEQ ID NO: 30262 - DNA, 601 bp, Human
aggccctttctcaaacccctcaagtatttggcttcaactttatgccgggcatgtagatgaaaagtcggctatgacctgtccttgacaagcagatgtaactccttgattgaggctagtaggtttttaagacctgaataattgagtttgcagaaacctactgtgtgccttcaggtaaatggagagtggggtttggtctagcaacgaagcatctagaaggtccctttggccttaccggctctgttttaggtaagtccacgtctgagtaccagtgactgcagctcttccagttgtgctgtcatgyttatatgttagaaatgatcatcaaaggactcaaaagttttgccactaattgtattaccggggactgtcacaaccaagatttctcttaatttattcaccttacttatctcctggaagggcatattgaagtgctcttggagttctctaaaagggtttttgttggttgtgtatattcacttgggtgccagcgattgattccaaataagtaaatcttttttcccaaaaggatgtaagatggcttatggttataagtacaacaggctaacaaagtacaagtagatgagaaagtaaaatgaagaaa

SEQ ID NO: 30263 - DNA, 601 bp, Human
ttgttggttgtgtatattcacttgggtgccagcgattgattccaaataagtaaatcttttttcccaaaaggatgtaagatggcttatggttataagtacaacaggctaacaaagtacaagtagatgagaaagtaaaatgaagaaataaagtcataggagccacagaattaacccaggaatgaataagtgtgtagtttggtgctgatgttatcatcctttatttgtacattgcttgtacagttgctctgagaaggtaagtcttaaattttcaaaagtgaaatgtcaccgagcatggtggctkatgcctctaatctcagcactttgggaggctgaggcaggcggatcacttgaggtcaggagttcgaaaccagcctgacttatgtgatgaaaccctgtctctactaaaaaaaaaaaaaaaaaaaaaaaaaaaaaatcaaaagttagttgggcatggtggcaggtgcctgtaatcccagctacttgggaggctgaggcaggagaatcgcatgaacctgggaagtggaggctgcagtgagccaagattgcaccactgcactctagcctgggtgacagagcgagacaccatcttaaaaaaaaaaaa

SEQ ID NO: 30264 - DNA, 601 bp, Human
gtagatgagaaagtaaaatgaagaaataaagtcataggagccacagaattaacccaggaatgaataagtgtgtagtttggtgctgatgttatcatcctttatttgtacattgcttgtacagttgctctgagaaggtaagtcttaaattttcaaaagtgaaatgtcaccgagcatggtggctgatgcctctaatctcagcactttgggaggctgaggcaggcggatcacttgaggtcaggagttcgaaaccagcctgacttatgtgatgaaaccctgtctctactaaaaaaaaaaaaaaaawaaaaaaaaaaaaatcaaaagttagttgggcatggtggcaggtgcctgtaatcccagctacttgggaggctgaggcaggagaatcgcatgaacctgggaagtggaggctgcagtgagccaagattgcaccactgcactctagcctgggtgacagagcgagacaccatcttaaaaaaaaaaaaaaatctacaatataccaaaaccattacttacctgagaaactattctcagggtcattgtagtgaatgcctattttatggcttttgatggcatcagggcactcaggtcatttacaagagta

SEQ ID NO: 30265 - DNA, 601 bp, Human
atgttatcatcctttatttgtacattgcttgtacagttgctctgagaaggtaagtcttaaattttcaaaagtgaaatgtcaccgagcatggtggctgatgcctctaatctcagcactttgggaggctgaggcaggcggatcacttgaggtcaggagttcgaaaccagcctgacttatgtgatgaaaccctgtctctactaaaaaaaaaaaaaaaaaaaaaaaaaaaaaatcaaaagttagttgggcatggtggcaggtgcctgtaatcccagctacttgggaggctgaggcaggagaatcrcatgaacctgggaagtggaggctgcagtgagccaagattgcaccactgcactctagcctgggtgacagagcgagacaccatcttaaaaaaaaaaaaaaatctacaatataccaaaaccattacttacctgagaaactattctcagggtcattgtagtgaatgcctattttatggcttttgatggcatcagggcactcaggtcatttacaagagtagtgtgtgagaccctgtgtgtcactgccactcatcttggccttcggccactgctgtagcaaccagtttccaagtagggctggacct

SEQ ID NO: 30266 - DNA, 601 bp, Human
gcctctaatctcagcactttgggaggctgaggcaggcggatcacttgaggtcaggagttcgaaaccagcctgacttatgtgatgaaaccctgtctctactaaaaaaaaaaaaaaaaaaaaaaaaaaaaaatcaaaagttagttgggcatggtggcaggtgcctgtaatcccagctacttgggaggctgaggcaggagaatcgcatgaacctgggaagtggaggctgcagtgagccaagattgcaccactgcactctagcctgggtgacagagcgagacaccatcttaaaaaaaaaaaaaaatctacaatataccaaaaccattacttacctgagaaactattctcagggtcattgtagtgaatgcctattttatggcttttgatggcatcagggcactcaggtcatttacaagagtagtgtgtgagaccctgtgtgtcactgccactcatcttggccttcggccactgctgtagcaaccagtttccaagtagggctggaccttgccttctgctccagagacctctcgcttcctgcccttgggcttctgacgagctgcaggaactgcctggcacgtgggtccccacaacccagaggaggtga

SEQ ID NO: 30267 - DNA, 601 bp, Human
ggtaggagccagttgaagggacgtgggaggcgcattccagagagaaggagtggtatgagactggaacagaggtgtgcagcagcatcgcatgggcgaaacaacagtagacagttgttcttttgtttttgtttgttttttgagacagggtcttgttctgtcatccaggctggagtgcagtggcatgatctcggatcactgcaacctccacctcccaggctcaagtgatcttcccaccccagtccccaagtagctgggggaccacaggtgcatgccacgatgcccggctaatttttgtacattytgtagaaacagggttttactgtgttgtccaggctggtcttaaacgcctgagcttaagcagtctacgtgcctcagcctcctgaagtgctgggattccaaacatgagccactgtgcctggcccggcaactgttactagactgtagagagggaggtgggcaagggctggtgacactagacaggtgcagtaggtctggaccatgggtggccttgcgctacacattacagagctcaggctttttttctccaggtgagagggctggtgccactgaggcatcaagcagaggtttgagatctccttgg

SEQ ID NO: 30268 - DNA, 601 bp, Human
cagaggtgtgcagcagcatcgcatgggcgaaacaacagtagacagttgttcttttgtttttgtttgttttttgagacagggtcttgttctgtcatccaggctggagtgcagtggcatgatctcggatcactgcaacctccacctcccaggctcaagtgatcttcccaccccagtccccaagtagctgggggaccacaggtgcatgccacgatgcccggctaatttttgtacattttgtagaaacagggttttactgtgttgtccaggctggtcttaaacgcctgagcttaagcagtctacrtgcctcagcctcctgaagtgctgggattccaaacatgagccactgtgcctggcccggcaactgttactagactgtagagagggaggtgggcaagggctggtgacactagacaggtgcagtaggtctggaccatgggtggccttgcgctacacattacagagctcaggctttttttctccaggtgagagggctggtgccactgaggcatcaagcagaggtttgagatctccttggtgacagtgtagagcagacaggtagatttgggaatttaagcttagactcacgttggagactgagata

SEQ ID NO: 30269 - DNA, 601 bp, Human
gacagggtcttgttctgtcatccaggctggagtgcagtggcatgatctcggatcactgcaacctccacctcccaggctcaagtgatcttcccaccccagtccccaagtagctgggggaccacaggtgcatgccacgatgcccggctaatttttgtacattttgtagaaacagggttttactgtgttgtccaggctggtcttaaacgcctgagcttaagcagtctacgtgcctcagcctcctgaagtgctgggattccaaacatgagccactgtgcctggcccggcaactgttactagactrtagagagggaggtgggcaagggctggtgacactagacaggtgcagtaggtctggaccatgggtggccttgcgctacacattacagagctcaggctttttttctccaggtgagagggctggtgccactgaggcatcaagcagaggtttgagatctccttggtgacagtgtagagcagacaggtagatttgggaatttaagcttagactcacgttggagactgagatagctcatctgagaggcactcagggcctaatctcaggcagtaattttagggatgtaggggaagagatggattctgc

SEQ ID NO: 30270 - DNA, 601 bp, Human
tgacgtttattgggcctggcactgtgaggtgctggggatgtgaagatcattgtggctcagccgctgctctcgagggcctctgggtgcagtatgcacacctgtgcctcctgtttgctcaggaagacaggctttgagatgagctggggctgacatccccaccttatcattgggatggctttgggtaagttatgttcatgttctctgagcctccctttcctcattggtaaaatgggtataaaatacctgccagtggagggttgttgtaagtagccatggaaaatgtaaagcacatagcacttaycattttttcctgtgtctttaacagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttct

SEQ ID NO: 30271 - DNA, 601 bp, Human
gagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgyggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggct

SEQ ID NO: 30272 - DNA, 601 bp, Human
tgtggggctcctaccgcgccgccacagctgctcctacctggggaggtgcgcccgggccccggggggcgggcagtcggggggcgggcagggaaccggtgccgccccacgcttcgtggcccctttaaggaggggaagccggcggagggaggagccggtccggtgtgtgcaggggagcgcctcgccagcggtccgcagggctggagacccacgccgtggagaggaccagcctcaggtcgccccgcctgggcccgcgccccgacctcgctgcccccgcctcgcctctctgcccgtggcgcttacsgccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtcccggtcacgaggccaccgccgctgcccgcctcgagaagcaccacgcgggctga

SEQ ID NO: 30273 - DNA, 601 bp, Human
cgtcgcccggccagttcggagcgctgggagcctgctacaaccctggcgggcagctcggaggggccagtgcaggcgcctaccatgctcgccatgctgccgcttatcccggtgggatagatcggttcgtgtccgccatgtgagccagcgtagggacgaaaactcatagacacatcggctgttcacacgttccccgcaatctgagaacgaacaggaatggagagaggactcaactgggacccacgtggaaaagaccgagcaggccacagaggctcggtctccccgcgcacagcgtaggcaccckgtgtactctgtaaacgggaggaggtggggcgaggcagccagagcccttggactggcacagggaccctcgatggagcgaagccctcaaacgggatgctttctggtattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttctta

SEQ ID NO: 30274 - DNA, 601 bp, Human
cccggtgggatagatcggttcgtgtccgccatgtgagccagcgtagggacgaaaactcatagacacatcggctgttcacacgttccccgcaatctgagaacgaacaggaatggagagaggactcaactgggacccacgtggaaaagaccgagcaggccacagaggctcggtctccccgcgcacagcgtaggcacccggtgtactctgtaaacgggaggaggtggggcgaggcagccagagcccttggactggcacagggaccctcgatggagcgaagccctcaaacgggatgctttctggyattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttcttaaagtgaggaggacaaatttgcaaaagaaataggcttttcttcttttttaaattggagaaatctctgctctggttgacctgggctggttttccctgtctctgaga

SEQ ID NO: 30275 - DNA, 601 bp, Human
gtctgtgtgcagggtgattgtctaggcagaggccaggctgtggacagtgtggaaggtttccctaaatcagaggaaggaagagaggacagaggccgagggtgaaggggcagaagcaggtggagggggtgataaggagcagcagtcgatgtgcagcccccatctcaatcccaggaggggccacccccacagtgccagccctggggcactggccatgcagatgtgcaaaagttgccttcattcgagcccctaacactagcatccttgggcctgagaggattcttgacccagctcagacaggaayccaccaagctctcttctggggaaggagagagggaaataggggagagggagggagggaggaagggtagtggggagggaagaagggaggctgcagctcagatgccaaaggtggaagaattgctcaggtaagagggagagagccgcccatatcagggcctcgggatagtataggatgtggcagcaaaatgcagcaggaggggtcactgagcctggaagaagaatggctgaccccaagggcacgtgacatatagacagctgcagaaaggaccttgagagggaggctgagtatccaggctgagtt

SEQ ID NO: 30276 - DNA, 601 bp, Human
cactcataccctctccttaactcaagtcacctgaagttttgaaattaaatatttgaggaaaagtgttttagcttgaaactcctgtgaaacaggccccctgcccagccctgcacacctccctgccttggcttaggggccccgtgaggctcctcaaaggctgaacagggcctcaccgaggatggagcgcagatgtccctccagggtctgcaggacgacgtttttgatgtcctgcacattcttacccagaaactgctcacaagccacggccaggagttccttctccgtcatgatcttcacctgycagtgacgacaaaggcgcttcagctaggctggagcgaggcagacaaaggccccagacccagaggtaggcaggatggtggctgtgcctcctcccttccttttttcagacctggaggccctggggggctggaatctgtctgaagcctctagtggggagacagcagcacaagggcttctctcactatgaaacttctcctgcactgacagccccaggccctgccacggcctctcctgggcattcggggcttgtctccccacccctccagcctactgtcccctcaccagctaattcctcccttgc

SEQ ID NO: 30277 - DNA, 601 bp, Human
aggtaagagtgggaggacagcctggttggcgctgactctgttctcagcccggtccagcatctctccctcccttccttaactcactccaaccccaaagcagcctgggtggcccttagtctcgagccatggtaagagacgccctgtgggccagggatggcttaggcctttgtagggttcctgccccctgctgaggatgctcctcatttaacccttctagccatctgtccctgtgttactcgcaaggcccagagaagttctggcacttgcccagcttgtcaagcaaggacacttgaaccctaggacccgcttgggtggaagcctcacctggggcagggcctctagcaccaaggccatcttggctgcatccccgtatttctggtaggcttctgccttgagcttcatccgctcagcctctgccttgcccatcgcctcgatgactgccgcttccgcctccccgattttgcggatcttctcagcctctgcctgtgccaagaggacctgcttcaccctgggggagcccaggccagttaggatcagtgggacgtaccagggtcctctcaagccttgcctgggggccagcaaaccttcaaaccctctgctc

SEQ ID NO: 30278 - DNA, 601 bp, Human
gaagaaggtctacacacttttctgtccccaacagggctagaccctcatctcagaaaacttagcagagttgggaccaaaccgcaccgccccagcaggaacatgcccatgaagaggccttccctgagcacaagcaggggcctcctaaggcagtaggaaactgaggaagctgctgtagacaggaggccttgcctctgtgcccttggggtcagggagaaaggacagggtatgagcgctggctggggccttgggtggatgaggggaaggacagtgtctctgggccctgcaggtcatggctgcccakacctagaggggcagcagcaggtgaggctgtgggcttcctggggcagggtttagggctgggaagaccagtccaggagagaggacagtgaccgtcctacccagaacccctgcccatgctgagctctggccagggccatagggaggatggacagatgcacagagaacttcaaggcaccaggattctgaggagcagcagggccaccccccacagagagtgattgtaataaacatcttcagcttaatctacatgatgtgcatgggggaaagaaaaagacagacaaaggaaaagacacgcagggag

SEQ ID NO: 30279 - DNA, 601 bp, Human
gtcaaccattccagctccaaacaggtttctaaaacaatgagctaatgagacaagagccatcactgatctacgcaatcgaagcagaggagcagtcagtgtctcaaacatttgggcgtaaagaaaattgttggcctggcgcggtgacgcacgactgtaatctcagcactttgggaggccgaggcgggtggatcacttgaggtcaggagtttgagaccatcctaacgtggcgaaaccctgtctctactaaaaatacaaaactcagctggaggtggtgacgggcgccagtgaacccagctactcrggaggctgaggcaagagaatcgcttgaatctgggaggtggcgcttgcagtgagccgagatcacgccgctgcactccagcctgggcgacagagcgaggctccgtctcaataaaaagaaaaaaaaaaaaaaagaaaattgtttttcccctgcaataattgtgctgaagtagcacaaatggccgaaacattcatgggcaggtttcccagttatttcaagtccgtttgagttagggctcatttcagcaagcacacacatgaatgatccaatacaaactttagcagaacttctgttgagtccaga

SEQ ID NO: 30280 - DNA, 601 bp, Human
agaaacagagcgaacagactattagcaagacagcataagtaaatctttatgctacaaattttggaataaatttgtcaaccattccagctccaaacaggtttctaaaacaatgagctaatgagacaagagccatcactgatctacgcaatcgaagcagaggagcagtcagtgtctcaaacatttgggcgtaaagaaaattgttggcctggcgcggtgacgcacgactgtaatctcagcactttgggaggccgaggcgggtggatcacttgaggtcaggagtttgagaccatcctaacgtggygaaaccctgtctctactaaaaatacaaaactcagctggaggtggtgacgggcgccagtgaacccagctactcgggaggctgaggcaagagaatcgcttgaatctgggaggtggcgcttgcagtgagccgagatcacgccgctgcactccagcctgggcgacagagcgaggctccgtctcaataaaaagaaaaaaaaaaaaaaagaaaattgtttttcccctgcaataattgtgctgaagtagcacaaatggccgaaacattcatgggcaggtttcccagttatttcaagtccgtttgagt

SEQ ID NO: 30281 - DNA, 601 bp, Human
ggatccctatcagaaacagagcgaacagactattagcaagacagcataagtaaatctttatgctacaaattttggaataaatttgtcaaccattccagctccaaacaggtttctaaaacaatgagctaatgagacaagagccatcactgatctacgcaatcgaagcagaggagcagtcagtgtctcaaacatttgggcgtaaagaaaattgttggcctggcgcggtgacgcacgactgtaatctcagcactttgggaggccgaggcgggtggatcacttgaggtcaggagtttgagaccakcctaacgtggcgaaaccctgtctctactaaaaatacaaaactcagctggaggtggtgacgggcgccagtgaacccagctactcgggaggctgaggcaagagaatcgcttgaatctgggaggtggcgcttgcagtgagccgagatcacgccgctgcactccagcctgggcgacagagcgaggctccgtctcaataaaaagaaaaaaaaaaaaaaagaaaattgtttttcccctgcaataattgtgctgaagtagcacaaatggccgaaacattcatgggcaggtttcccagttatttcaag

SEQ ID NO: 30282 - DNA, 601 bp, Human
ttctcaaaaaagaagaaaaaaaaaaggaacgaaaaccacagacttgaaactaaattcttatctgagaaatgctttacctttgtattcaaattagtgatgtagggatccctatcagaaacagagcgaacagactattagcaagacagcataagtaaatctttatgctacaaattttggaataaatttgtcaaccattccagctccaaacaggtttctaaaacaatgagctaatgagacaagagccatcactgatctacgcaatcgaagcagaggagcagtcagtgtctcaaacatttgggcrtaaagaaaattgttggcctggcgcggtgacgcacgactgtaatctcagcactttgggaggccgaggcgggtggatcacttgaggtcaggagtttgagaccatcctaacgtggcgaaaccctgtctctactaaaaatacaaaactcagctggaggtggtgacgggcgccagtgaacccagctactcgggaggctgaggcaagagaatcgcttgaatctgggaggtggcgcttgcagtgagccgagatcacgccgctgcactccagcctgggcgacagagcgaggctccgtctcaataaaaa

SEQ ID NO: 30283 - DNA, 601 bp, Human
gatcctgccactggatgccagcctgggcgacagagcgagactccattctcaaaaaagaagaaaaaaaaaaggaacgaaaaccacagacttgaaactaaattcttatctgagaaatgctttacctttgtattcaaattagtgatgtagggatccctatcagaaacagagcgaacagactattagcaagacagcataagtaaatctttatgctacaaattttggaataaatttgtcaaccattccagctccaaacaggtttctaaaacaatgagctaatgagacaagagccatcactgatctmcgcaatcgaagcagaggagcagtcagtgtctcaaacatttgggcgtaaagaaaattgttggcctggcgcggtgacgcacgactgtaatctcagcactttgggaggccgaggcgggtggatcacttgaggtcaggagtttgagaccatcctaacgtggcgaaaccctgtctctactaaaaatacaaaactcagctggaggtggtgacgggcgccagtgaacccagctactcgggaggctgaggcaagagaatcgcttgaatctgggaggtggcgcttgcagtgagccgagatcacgccgct

SEQ ID NO: 30284 - DNA, 601 bp, Human
gcacttctctaaagatacggtcaaacgattcagggaatcctgaaagaaggaccggccaatgttcaagagtaaaaagagttatttaggatataaagttaaaagtacttgccttagagaataatattttttaaaaagcatatgctatattaaatacagttcatattctgacaccaagtatttttctaaaaacaatgcaacgtaagttcatagaaaaatggttaactcaaatactgttttaaagaggcctcactggctcattttaccccttacccaaaggatagtagtacttaaaacagcattyaattgctttggttacagctctgatacgcagcacaacgtaagtagagtgtataattattatttttattttttatttttgtagagatgggggggtctatgttgtccagactggtctcaaattcctgagctcatgatcctcccacctcaacctctcacagtgctgggataatagtgtgtgagccaccgtgcctagccaagtatataattcaatattgctttcttttccccttaattatgaaactttctaaagttcataccccttcagtggaagaagtcaaaaaatgtgtcactaagaaattta

SEQ ID NO: 30285 - DNA, 601 bp, Human
agaccagctaatttttgtattttgcagtgacatgatcatggttcactgcagcctcaacctcctgggctccagcgaccctcctgccttagcctcctgagtagctgggaccacaggcatgagcaaccatgccaggctaatttttttttttaacttttggtagagacggggtctcactttgttgaccaggctggtcttgaactcctggcctcaagcaatcctcctgcctcagcctcccaaagtgttgggattacaggcatgagccacctcacgcagcctaaacacttttaaaaaggtagagatraagcaaatcatgcaagagcacactgggacaaatatttcaatataatccaatacctgtgcaaaattgctgattcccactgttccaatgccattttctgttgttacccattcgtgtttctctgtgaatttacgcactaaaacagaagaccaacatttcagaaaagcagtagcattacttcttaagaagcacttttcattaccattgctttcaaaagactttcccagaatttctgtttgacctgttgacactacctttaaatagtgcatggctcaggaaagaatgaagatcatgtatagagat

SEQ ID NO: 30286 - DNA, 601 bp, Human
atacttgcattatacttaatacatgagcactcctcatccaagattctggaatccaaaacgctccaatgagcattttctttaagagtcacgttggtgctcaaaaagtttcagatttttggagtatttcagggattagagatgctcaacctatgccatatttttactgtaccttttctgtgttttgataggccaagtgtgttacgattgcctacagtattcagtacagtaacatgctgtacaggtttgtagcccaggagcaaaggctgtaccatacagccaaggtgtgtaataggctgtaccrtctaggtgtgtgtaagggcaccctaggaggctcacagaaggacgcaatccccgaggaggcagttatcagaacatagctccatcattaagtgacacgagtgcattcccatcagttaacatccccccttccccgcctcacccaatacatacatccagttgaaaatcactgaacacgctagtatttggcttctcattttctcttaaacagtatcgccatatggaattgaggggaatttacagagaaaagatgggctgaataaaagccttccctttgtgtcatctgtgcctattgaggttttct

SEQ ID NO: 30287 - DNA, 601 bp, Human
acaacatctcaaaaactatccaacactgggcctcatagtaggtatacagagatgccaaggaagatataattgtgattatcaacacacaagcatcttacatgtctgaggaattttgtacagtcacgtgccgcctaatggcattttggtcaacaacagaccacatatatgacagtggtcccatgaaattataatatagttagtatcacttgtccaaaatgcttgggagcagaagtgttttggatttcagattttggaatacttgcattatacttaatacatgagcactcctcatccaagattstggaatccaaaacgctccaatgagcattttctttaagagtcacgttggtgctcaaaaagtttcagatttttggagtatttcagggattagagatgctcaacctatgccatatttttactgtaccttttctgtgttttgataggccaagtgtgttacgattgcctacagtattcagtacagtaacatgctgtacaggtttgtagcccaggagcaaaggctgtaccatacagccaaggtgtgtaataggctgtaccgtctaggtgtgtgtaagggcaccctaggaggctcacagaaggacgc

SEQ ID NO: 30288 - DNA, 601 bp, Human
cctcacaaataaactctaggaggtaaggacgacatcttacacaacatctcaaaaactatccaacactgggcctcatagtaggtatacagagatgccaaggaagatataattgtgattatcaacacacaagcatcttacatgtctgaggaattttgtacagtcacgtgccgcctaatggcattttggtcaacaacagaccacatatatgacagtggtcccatgaaattataatatagttagtatcacttgtccaaaatgcttgggagcagaagtgttttggatttcagattttggaatactygcattatacttaatacatgagcactcctcatccaagattctggaatccaaaacgctccaatgagcattttctttaagagtcacgttggtgctcaaaaagtttcagatttttggagtatttcagggattagagatgctcaacctatgccatatttttactgtaccttttctgtgttttgataggccaagtgtgttacgattgcctacagtattcagtacagtaacatgctgtacaggtttgtagcccaggagcaaaggctgtaccatacagccaaggtgtgtaataggctgtaccgtctag

SEQ ID NO: 30289 - DNA, 601 bp, Human
agatggtgccactgcactccagcctgggtgacaaagcaagactgtctccaaaaaaaaaaaagcactctaattaatccagggtacaaacaaattactattcaatgtaaacaaaattcatggcatggatcattctaagatcctaagaacactcaccttgtttgttcaattttgtcccaacttcagggagactacaataaacaacatctcccaacgcttcctaaataaaacaagacaaaaccaaaaatctctaagaagttataactaaaccctccagtaaacagaataagccaaacactgaatyccctataatgaagatttagtatatattttatactggaggggctacattcttgagttttccttaaaatcctttaaacatgtaaaaactactctcagtcaggtgtggtagttcacgcctgtaatcccagcactttgaaaggcccaaagtgggtgttatcacatgaggtcagaagttcgagaccagcctggttgacatggtgaaacccagtctctaataaaaatacaaaaattagctgggtgtggtggcaggcacttgcaatcccagctactcaggaggctgaggcaggagaatcacttaaat

SEQ ID NO: 30290 - DNA, 601 bp, Human
aattggctgggcacggtggctcacacttgtaatctcagcattttgggaggccaaggcgggcggatcactcgaggtcaggagttcgagaacagccttgccaacatggggaaactctgtctctacaatacaaaaattagctgggcgtggtggcacgtgcctgagacacaagaatcgctttaacccaggaggcagaggttacagtgggccgagatggtgccactgcactccagcctgggtgacaaagcaagactgtctccaaaaaaaaaaaagcactctaattaatccagggtacaaacaaatyactattcaatgtaaacaaaattcatggcatggatcattctaagatcctaagaacactcaccttgtttgttcaattttgtcccaacttcagggagactacaataaacaacatctcccaacgcttcctaaataaaacaagacaaaaccaaaaatctctaagaagttataactaaaccctccagtaaacagaataagccaaacactgaatcccctataatgaagatttagtatatattttatactggaggggctacattcttgagttttccttaaaatcctttaaacatgtaaaaactactct

SEQ ID NO: 30291 - DNA, 601 bp, Human
gcagtgagccaatgtcgcaccatcgcattccagcctgggcaacagagcaagactccgtctcaaaaaaataagaagtaaaaaaaaagaacagtttaaaaaaggctgaaaagttaacagtcttagggaccctataggacaatatcaagtgatatgacgaacatgtctcaaatcagagaaggaaaaaggaatgaagtgggaagagaaagaaatcatgactaaaataagaagtctccaaatttaatcgaaaaaaaattcaatctacagattcaagaagcttggtaaatcccaaaagcagccaaaygtaacacacactgtgtgattcctttcatataaagaataggcaaaataaacctatggtgtagaaacgagagaagaggtcatctatttgactaggaaggtttatttaagtgtatacatttgttaaaactcactgaattgtacacttctggtccatgcatttcactgtatgtagattttacatcaagttaaaaaactacctttagcagaatgtcttaaaagggtattcattagtttaaggatattatctaacatatcgatattaatagactttttttctctctataaaaaaaaacggagtctt

SEQ ID NO: 30292 - DNA, 601 bp, Human
gcctgtaatcccaacactttgggaagccaaggcgggtagatcacttgaggtcacgagttcaagaccagcctggccaacatggtgaaaccccgcctctaccaaaacctcgaaataaataaattaattaatttaaaaaattagcctggtgtggttgtgcatgcctgtactcccagctacttgggtggctgaaaaaggagaactgcttgaacctaggaggcggaggttgcagtgagccaatgtcgcaccatcgcattccagcctgggcaacagagcaagactccgtctcaaaaaaataagaagwaaaaaaaaagaacagtttaaaaaaggctgaaaagttaacagtcttagggaccctataggacaatatcaagtgatatgacgaacatgtctcaaatcagagaaggaaaaaggaatgaagtgggaagagaaagaaatcatgactaaaataagaagtctccaaatttaatcgaaaaaaaattcaatctacagattcaagaagcttggtaaatcccaaaagcagccaaacgtaacacacactgtgtgattcctttcatataaagaataggcaaaataaacctatggtgtagaaacgagagaagag

SEQ ID NO: 30293 - DNA, 601 bp, Human
tcatccaaaacgtaaaataaatttctgagcgcctcaatcttgtattctttacaaaaaccatacattatttgttcatagaactttaaattttagccttaagaattaaaatacttgtatataacaaatgaaaataattatggctagaatagattccaccataataaattaagaactcttaggttgtaataagcatcagaaaatgacatttaaatctttaagggccgggcacggtggctcatgcctgtaatcccagtactttgggaagcgaaggcaagcaaatcacttgaggctaggagctctrgaccagcctggccaacatagtggaaccccatctctaccaaaaccacaaaaattagctgggcgtggtggcagttgcccttgatcccagctactgggaagctgaggcagaagaagtgcttgaacccgagaaggggaggttgcagtgcaccgagatcacgccactgcactccagcctgggcgacagagggagactctgtctcaaaaaaataataaaaataagtccttaaatatatgatccaaatacacaagaccaggtatgtctttaacaaatggaacactaactactgaggttaacgggatt

SEQ ID NO: 30294 - DNA, 601 bp, Human
aaaatcaaagttggtgatttattttttattatgttaaaggtgacagatcttggcttaagaaaaaccagatttgtgactaaagaaaacattttcttggagctttgcattgttctggcttaaatttccttttaaaaagtaactttccgtaagttaaagttagcactttcacaaatactagcagagttactaaatgaaatattaacatcaaaacaaacatgattaacgaagaagtattttattattttgctgcaaagctgttgcttcactgtataaaaatagcaccagcaaatgcagtgtatcrcaaaattaagatagtggtgttcctcatctgacactgtacaagcaacaaaacctcttcacttccagttatttccaatggaaagatcattaagtatttcatcccaaatccaggtatggatacatgcaagttacaatattatataaggcttaagaataacaatgttatctttgaattatgtaatttttataactagtttttaccatggataatttcatgaattctgaacactagagcctagtctaaaaatcataggatattgtgaaaaagacgcatattatatttatctataatcattagaaa

SEQ ID NO: 30295 - DNA, 601 bp, Human
aatacaatacaaactataggagaagtggtaaatgaaattacaaagcaaacagatattctgaaacccaaaaggtgttccagtttcctcatttgtcacttagacctttcctgtggaaaaggaatagccaaggatgagaacaaaggacttaaaacactctggcaccaaacaaggcccagggagacaaatgagaaagccctttcaaattgtatccaggacttgtttcccatcactgtggcttttaagctaaaaacttacaagagaaggatcacttataaaatttcaatatttttcttaatcctcrcttcacctagtaccagggaggcttcgcacacccttctatcttaaattattttccttagaagaacacagaacatatgtcttaccagtttaaatcagaacagaactactcacagggtctaggggagccctcatattctgatcagtgtcatcatctcctgataattcatgcaaaacaacatttgctaatcctgataatcggctcagcatttctgtaggaaaagaaggggggaaaaaacctaagaatcagcaaaatgaacataggcttctcctatattgataaccatatcatccgtgaatgaaa

SEQ ID NO: 30296 - DNA, 601 bp, Human
tcttgtcttttcagaaaactaagaagttttattaattccttatgtggacttcagaaaatataatacatactgccaatttgtatcatcttaaaaaaaaaagaaaatacaatacaaactataggagaagtggtaaatgaaattacaaagcaaacagatattctgaaacccaaaaggtgttccagtttcctcatttgtcacttagacctttcctgtggaaaaggaatagccaaggatgagaacaaaggacttaaaacactctggcaccaaacaaggcccagggagacaaatgagaaagcccttwcaaattgtatccaggacttgtttcccatcactgtggcttttaagctaaaaacttacaagagaaggatcacttataaaatttcaatatttttcttaatcctcgcttcacctagtaccagggaggcttcgcacacccttctatcttaaattattttccttagaagaacacagaacatatgtcttaccagtttaaatcagaacagaactactcacagggtctaggggagccctcatattctgatcagtgtcatcatctcctgataattcatgcaaaacaacatttgctaatcctgataatcgg

SEQ ID NO: 30297 - DNA, 601 bp, Human
aattccatgtcagattcttggtgtaattcctaatatttaggaaaaaagttgccagtgcaccaggaaaaggtattagcttcccaacaggagtttcttcattccaactttttatgttttgcccaattcatattcttgttaacttaagaatctaactctgatccaataataatcattatcatagccattacaatatattaagtattttataaatgttaagcattttacaaacattatcccatttaaggtattattatcctaattttaccaaagagaaaaataaaggaaagcaaaaatcataaaycagtaagggtaaaaggccaaaagttaaaattaagagtagttaagtaaaactctcttaaccactacgcattacttcttgtcttttcagaaaactaagaagttttattaattccttatgtggacttcagaaaatataatacatactgccaatttgtatcatcttaaaaaaaaaagaaaatacaatacaaactataggagaagtggtaaatgaaattacaaagcaaacagatattctgaaacccaaaaggtgttccagtttcctcatttgtcacttagacctttcctgtggaaaaggaatagc

SEQ ID NO: 30298 - DNA, 601 bp, Human
cctgtagagcttcatctttctgctgcagttgaacatccttctgtctaataatatcttttagctccaccaccaattgctctgcataagccaggcgctcctgaacatcttcttgtgtagtattattaaattccatgtcagattcttggtgtaattcctaatatttaggaaaaaagttgccagtgcaccaggaaaaggtattagcttcccaacaggagtttcttcattccaactttttatgttttgcccaattcatattcttgttaacttaagaatctaactctgatccaataataatcattaycatagccattacaatatattaagtattttataaatgttaagcattttacaaacattatcccatttaaggtattattatcctaattttaccaaagagaaaaataaaggaaagcaaaaatcataaaccagtaagggtaaaaggccaaaagttaaaattaagagtagttaagtaaaactctcttaaccactacgcattacttcttgtcttttcagaaaactaagaagttttattaattccttatgtggacttcagaaaatataatacatactgccaatttgtatcatcttaaaaaaaaaagaa

SEQ ID NO: 30299 - DNA, 601 bp, Human
ctgaatccccagtgtgacaagaggcctttaagaaaggactggttcaggaggtctctgaactcagcaatggattaacacattcacagattaatggattaatgggttgtcatagaaggggaactggtagctttataagaagaagagagacctgagctggcaaattagcacactcagccccctcactatgtgatgacttgcgctgccttgcgacaccactgagagccctatcagcaagaagaccctcaccagatgcagtccctcaactttagacttctcagcctccataaatgtaagaaataactttatttaaattaaattaaatttctgttattataaattaaaaacaaaactaaggagcagaatgatatgattataggtgataaaagcataccagagccacactaaaaaaaaaaaaatcaaaattgcaatctatttcaaaaagtttttaaaaattaagaaaattatacaggccaggcatggtggctcacacctgtaataccagcactttgggaggcccaggcaggtggatcacttgaggtcaggagttccagaccagcctagctaacatggtgaaaccccatttctactaaaaatacaaaaa

SEQ ID NO: 30300 - DNA, 601 bp, Human
aagaatggagaagatttcaggatgggaatccaagaaggcacagccaccacttgctaaagaaattaacacggctaaaagggagccagtttctaacagttaagacaatgggaaaaagccctaaaggcatttcagaatgcattttagaaatctttaaggctgccccaacagcccccatcacaggcccaaagccctaagaggacagaatggtttctgtgaataggccctgagataccactgctctgtgccacttcaggatactgctccttgcagcccagctgttctggttagtgcaaagcagccscaggtatggctcatgtcacagctcaaaaggtacgagttgtaaaacttggtaacatccacatggtgctaattctgcaggctcacagaaagcaagagctgtggaggcttggtagtctccacttacatgtcgaaggatgtcatcaatagccagggggctcaggcagaggcttgtcttgaggcagaaccaccacagagagccccactagagcaatgccaaggggaaatgaggggttggaattgccctgcagagtccccactagagtaatgcctagtggaatcacggtgtgggactaccactgcc

SEQ ID NO: 30301 - DNA, 601 bp, Human
aatgctgatagaaacataaatagtaaagcccattctggtgaggcttcagacagaaatgaggaacaaagtatcagaaactagagtaaagcccagccttgctataaattagcaatgaacttggctgaacttgtccagtttttgtatggccaagaactttgtagaaggctgagcttgagagtgatgaactagggtatatggcaggagaaaattttaagcagcaaactgcttgagctgctatgtggttacttctatctgcttacagtgaacagagaaaaagaaaacagagcaaaaaaaaaaaaaattggaaaatttgcaacctggccatgtggtaaagaatggagaagatttcaggatgggaatccaagaaggcacagccaccacttgctaaagaaattaacacggctaaaagggagccagtttctaacagttaagacaatgggaaaaagccctaaaggcatttcagaatgcattttagaaatctttaaggctgccccaacagcccccatcacaggcccaaagccctaagaggacagaatggtttctgtgaataggccctgagataccactgctctgtgccacttcaggatactgctccttgcag

SEQ ID NO: 30302 - DNA, 601 bp, Human
ttaacatagcattctatttaatatctggaacatcactatcacatttttagtattgtaatgataattataatattaagaaagattatagccagtcagaggcaagaaaaatgcatcaagaagttcagaagagctgtttttctcagtccttctattggttcaattggtttgagtacagatttcattaacagatccctgaaaatatgaaatacaagccactcagatggtagagatgtggacttcaaaagcaatcagctactgaccttccagttgctgaatggtctgggctgactgaactgcctgytcattcttatcttggagaagctttgaattttgatcctttagagcatcacaggcagactgcagctcttgtccagtcttttgaagactcaaaatatgagaggtcttctcttccatttctgctttgtgcttctgctccaaagcactataccgagactctagttcagcctgggcttggcctgcttgctcaaactgttctaaaagatgatgcatttcttcctgcagattatggaaggataattttctctctgccacttcaagttccatcttttccagtagaatcttggactcctctctttctgtt

SEQ ID NO: 30303 - DNA, 601 bp, Human
tatttaacatagcattctatttaatatctggaacatcactatcacatttttagtattgtaatgataattataatattaagaaagattatagccagtcagaggcaagaaaaatgcatcaagaagttcagaagagctgtttttctcagtccttctattggttcaattggtttgagtacagatttcattaacagatccctgaaaatatgaaatacaagccactcagatggtagagatgtggacttcaaaagcaatcagctactgaccttccagttgctgaatggtctgggctgactgaactgcytgttcattcttatcttggagaagctttgaattttgatcctttagagcatcacaggcagactgcagctcttgtccagtcttttgaagactcaaaatatgagaggtcttctcttccatttctgctttgtgcttctgctccaaagcactataccgagactctagttcagcctgggcttggcctgcttgctcaaactgttctaaaagatgatgcatttcttcctgcagattatggaaggataattttctctctgccacttcaagttccatcttttccagtagaatcttggactcctctctttct

SEQ ID NO: 30304 - DNA, 601 bp, Human
ataggataaaatgctaagttcagttcaatccaacaaaactttattcagtagccattatttgccaggtggtatactagttttgggtaaagcaaagatggaaaaaaaaatggcccctgcccttgaagagcttatatttaaactttgaagagcttataatatagtaaaaaagacaaacatataaacagatcattttaatacaatgttaaaagtatacaaggatgttatggaagcacaaaaaaatcatttaacccaacttttggggaccaataccaaattcctgaaaaagataatatgctagtcgaggcctgaaagatgagtaacaatcatccagactaaaggaaaggagcaggattctaagcagggtacagcacgagcataaaccactcactcacaacatagtttctacctttaaacctttatactgatctctgttacctcatcccacaaatttattaccagaatgtcctttctttcttcattttacctattttaaaaatcatcttattaaggtcctgttcaagccatacttcctataggatacgatgaccattccaaaatgattatgagttataaagaaatcctgcagcatgtatagtccata

SEQ ID NO: 30305 - DNA, 601 bp, Human
aatgaattttaatattcagaaacaagtaacaataaatgagatataataaccattatgaatctctttaatagatcttactctataggtaatgtacttctctggcaacactagaaaattatggacgtattttcatatgaagctaccttctcttaatctagctcatgttctggttatattaagaacacatcacttacctcactgacttctctgtctgcctccccagttctattctgagcctctaggagagtaatctgagaagacagtttttctgaaagtcacaaaataaatatctttagaagayatatgtggagtgtgtgaaaaaacaggattgcatgtgaagctatttgaattgtatgaaataattttttaaaaaataaacaaaatagcttgggagaggtgaaagccttattaaagaagtggcaagaggatatgattacatgagatataagatagaacagtactaggtgatgataatgaacctgaatgaagtatactaaatagtggaaggtttgaaaggagaaggatgccaggatgcaggacataaagcagctatttctgtggcataatctggaacttctaggacaatacatataatttatcc

SEQ ID NO: 30306 - DNA, 601 bp, Human
catcttgtccactttcctcagcagaagagctcctcttgttggcaatatcaacaatgctgatctatttttaaaaaagaaaaaaaaagctgtaatcaaatgttttataacattaaaaaaatagcccaactaaaaacttgtatttcatcttctaaaacttcagactttttggtcaaaaccttctttgtaccataacactgctaaatccttttaaaatcagtttgtatctcccagctggacctccaagggcactctgccaatcctgcactgaagtcaagccctattcataagacctaaggaaatygggaattcattttctagatattccttacataagaagctttttttccttcagaataaaactcctaattgattttttttaaaaagtaagcagatacttttgttaggaagccacattactcctcaagggcatgtataattctatcactgacttactgattagaaaaacacagctaactaaacaaaacgcagctaacaatactcttaaatcaacagaatgatactaagcaaccatacccttcttatagtaattttcagattattaaaaggatcattctccaaagatccctttttatttaatctt

SEQ ID NO: 30307 - DNA, 601 bp, Human
gtttatttatctgctcttgtaactgaaatacctcttctgattttttagtaagctcacttgttgtagaactaactttcaattctaactctactttctcagcctctatttccttcagctgggccttaatctgggcaacagaagttccgccctgcagagcactcgcatcttcagaatgagaaggccagtctgggcacaagttggactctaaaacaggttgagtgtgatgctgttctgtggctttgaataaaggttcttctaaacctggagtggaagaacacgattcctgctggtctgtgcttgrgagttttccgtctatggattcccttacttgaatctggagttgccttagctggtctccaatattctcattttccttgctttgctcatcaaactgttcttgcaagcgattatagtcatctttctgttgctttagctcctccctgagatgtctttctttctcctgtgcctttttaagaattgccttgcgggaggttaaggcttcctgtagcttcttttgaagttgctccttttctttttcaagggccagtatcttttcttctagttctggtttccagtgttcactactacctgtacaaggtgg

SEQ ID NO: 30308 - DNA, 601 bp, Human
gaggccgaggtgggtggatcacctgaggtcaggagttcgagaccagcctggccaacatggtgaaaccccctctctactaaaaatacaaaaaattagctgggcgtgttggtaggctcctgtaatcccagctactcgggaggctgaggcaggagaattgcttgaacccaggaggcagaggttgcagtgagccaaaatcgtgccattgcattccagcctgggtgacaagagcaagactccatcttaaacaaaacaaaacagaagtacagaaatctctcaatagaaagatgggaagagaagatgygaacttttcatgttcatgcagttgtagcaggattgttgtttgccaaaaaaaagtcagaagtgagagagaatatatcttccatggacatttatgccaaaattagtcccattgtctaaaaggaaacagaaatagtttagagactttctttgcttgaagttacctctggaggaggaaaaattcactactcatttacctggaaatgttaatctttaattcttccatatggatggacatctgtctaagttgatcctttagaacactgcaattatcttctttgagtctaatttcttcttctttgct

SEQ ID NO: 30309 - DNA, 601 bp, Human
cagaaaattgaaatttgagaaaaaataactctaagaggtatatgcagtatgaattaatgtggactaaaggaagaagaaaagacgagactagacaattaatttgagagtactgtggtaaaaatccaggcaagagtagttgaaatggaaatgaaaagaaatacagaggccaggtgcaatggctcatgcctgtaatcccagcactttgggaggccgaggtgggtggatcacctgaggtcaggagttcgagaccagcctggccaacatggtgaaaccccctctctactaaaaatacaaaaaattrgctgggcgtgttggtaggctcctgtaatcccagctactcgggaggctgaggcaggagaattgcttgaacccaggaggcagaggttgcagtgagccaaaatcgtgccattgcattccagcctgggtgacaagagcaagactccatcttaaacaaaacaaaacagaagtacagaaatctctcaatagaaagatgggaagagaagatgcgaacttttcatgttcatgcagttgtagcaggattgttgtttgccaaaaaaaagtcagaagtgagagagaatatatcttccatggacatttatgc

SEQ ID NO: 30310 - DNA, 601 bp, Human
ttatacacaaatgttcatagtagtattattagaatagctaaaaattaaaaacaatatgcatgtccttcaacaggtgaatacagtggtatattcataatatgaaacattatttatactgaaaagaatgaactattgatacatacaacaaaactgatggatctcaagggcattatggcacatgaaaaaagccaatttcaaagggttatatactgcaagattccagttagaaaacattctcaaaatgacaaaattgaacacagattagtggttgctaggggttaaggatgtgaggaaggtaggsaagggaggaatgtgactataaactagtagcacaaaggacgtatttgtggtgatggagtagctctgtattttggttttggtggtgcttaaatatacatgtcacaaaattgcatagaaccacacacacagatagtcaaatcagtgcatgtaaaactggtggaatctgaatgtggtccgcgaattgtaccaatggcagtttcctggttttgatactgtgctacagttatgtaagatgtcaccactggaagaaactgggtgaagggtacatagaagctctctgcactattttcccaaatctaca

SEQ ID NO: 30311 - DNA, 601 bp, Human
tactggagtagtgtcagaaaaggccaggtatggagcttggactcttacaatcacctagtgctaagaaggtgcctctctccgactgcccctcctcccccactcccactgtggtatcagtggaggcaacatgtggggcctggacatccccctccaccataacaaggttaataaggcactcttccttgtccctgcagaggtggtatcagaagagatcaagtggggattctggactttgagtactacccagtggtaacaagatgcccctcttaaccattccccatagtgtcagtggaggctaagyggatagcctggacttttaccaccacctggcaataatgaggtgcccctctccactccttccagcacagtatcaatggaggccatgtggggagcatggacttccacttcctcctggcagtatcagggcatcccttccttttaggggtatcaacgaaagttgaatggggtgcctggagttcaccatccacctagtgtcttccttcccctgccggtgtggtgtcagtgaagcctgctaacacagaagattcaaataagactgaaagtcttataatctccaaaatgtccagaatgtaactaaaaa

SEQ ID NO: 30312 - DNA, 601 bp, Human
cttccaatcccaagcatttcagataaggaatacttaacctgcatagataaaactcttgggccttataaataaaaacaaacataagaaaatttagaaagatggtggcaaaccagctagggatccccagacttgaggaatgacatggtggcaagttctttggtttaccatttgtattctgcatatcccaaaccggatactggagaattccatgacccggaaacaccaatgagtaccaagtttactcagtcttgccaaaggaccaggaagggacagtctagctagacagagccattaatgatamtaaccaccatactccaggcaaacaacatggaaaaaacacagtatctcaccactcccattaacaaagacctggtagataagctaggtacattcttggctggtggtaacaaggtacacctcaccctccttactggagtagtgtcagaaaaggccaggtatggagcttggactcttacaatcacctagtgctaagaaggtgcctctctccgactgcccctcctcccccactcccactgtggtatcagtggaggcaacatgtggggcctggacatccccctccaccataacaaggttaataagg

SEQ ID NO: 30313 - DNA, 601 bp, Human
ccaagtatgaatttattaaggcagcatgaaccatcttaagttaaacagtaacaacctcccaaaaatgaggctgcaacaactagacctgtttttatacactaagtgtttaatcttgggattaaatttgtcagaaaaactgaattaaaaaaaaaatcagaattatagctcctatcttaatttcttctgccatgatagcattattattgttctgttccttaaaaagaaaagagctaggatttctggttctagacaaaataaaatagacacatttctccttattcttccaactaaggctgagcawccctaatcagaaaatcagaaatacttcaaaatccaaaactttttgagcactgacatgacactcaaaggaaatgctcattagataatgcaaatattccaaaatccaaaaaaatccgcaatccaaaacacttccaatcccaagcatttcagataaggaatacttaacctgcatagataaaactcttgggccttataaataaaaacaaacataagaaaatttagaaagatggtggcaaaccagctagggatccccagacttgaggaatgacatggtggcaagttctttggtttaccatttgta

SEQ ID NO: 30314 - DNA, 601 bp, Human
tctcctcttaaaagttaagtctgggccgggcgccgtggctcaagcctgtaatcccagcactttgggaggccgaggtgggtggatcacaagatcaggagttcaagaccagcctggccaagatggtgaaaccctgtctccactaaaaatacaaaaaattagccgggtgtggtggcaggcgcctgtaatcccagcaactcgggaggctgaggcagagaattgcttgaacccaggaggtggaggttgcagtgagccgagatcgtgctactgcattccagcctgggcgacagagcgagactccgtmtcaaaaaaaaaaaaaaaaaaaaagttaagtctgctgtggatgcttatggcttttccagaagccactttgatccttcccttgcttgtccagcccctcccaacccccttttcctcctccgtatcctatacgtctccatactaattctcagtctcctccaacttcaatgctgtactcctctccctggctgtcaacagtgctgcctgttttgttctcagatccaaagtttcctacaattttcttataacttaaagcaaaatcaacactttctctgtttcagagtaccaaatgtctcagtcatca

SEQ ID NO: 30315 - DNA, 601 bp, Human
aaactcttgtcttgattagatttttctcccagattctcattcttgaatttctcctcttaaaagttaagtctgggccgggcgccgtggctcaagcctgtaatcccagcactttgggaggccgaggtgggtggatcacaagatcaggagttcaagaccagcctggccaagatggtgaaaccctgtctccactaaaaatacaaaaaattagccgggtgtggtggcaggcgcctgtaatcccagcaactcgggaggctgaggcagagaattgcttgaacccaggaggtggaggttgcagtgagcygagatcgtgctactgcattccagcctgggcgacagagcgagactccgtatcaaaaaaaaaaaaaaaaaaaaagttaagtctgctgtggatgcttatggcttttccagaagccactttgatccttcccttgcttgtccagcccctcccaacccccttttcctcctccgtatcctatacgtctccatactaattctcagtctcctccaacttcaatgctgtactcctctccctggctgtcaacagtgctgcctgttttgttctcagatccaaagtttcctacaattttcttataacttaaag

SEQ ID NO: 30316 - DNA, 601 bp, Human
caaggcctgaataggtgatgaaaattaagaagttgtgaatatgttggattggaaagaaaggtatctcaagtaagacctgctcaatggggctgtcacctctgccacataaactttacaagaaagcattaatatcagaaatgtcattctctgaggaaagtgatcatatacataggtggctttctcccaaaatataataaaagtgcctgcttttaacgatattttccgtggaaagggacttccagcagcaaaatacttgtagcaactctctatcctctcatgcatagtgattcttttgatgagcataaggaactagggatgtgtagctctgcccttccaaattacacttggagcaaactgctcataggaagcacagttcactctgttattccaatactcttgtttggcaagagcaggattttctgtgaaggaggtctaccttggcccaacattgtctgtgactgggaggggaagttcagggttaggaagtgcatttgccaacaaataaaaagctacattcttttaacatcatttataaagcagtcttttaatctctcaatcttttaatcttttaaaaaagatttccatggattcagatctcagg

SEQ ID NO: 30317 - DNA, 601 bp, Human
ggctgaaaatacggtggtgggctgaggacctcccctaggtgggttctgtgggcgccccgtgaacgacgagcctcccgccacgggacgcgaccatccccgccgcctcgccgcccttctccggtgccggccgcggggccttgccggcaacggtcggtaacgggcagatcccaggagcgaagggccctcagagactaccccaccaacgcactccgactccgggggggcggcagggagcgcggccctgcttccctccctaaccctgccctccctaacccactacctgtggggaaggcgcttccckccgcggagcggacagaagccgccacgagcccggcaggaggttcctacttctccgaccacctctccagccgccgcagaaaccgcagaactgagctgacgacccggaagtgctcgcggaacctggaagtgacaccccgcccgagggccgggaggccccgcccagccctgctctcgcccgccactcaagccttgtcagggaagggcgtggagagggaaggaggggcgtcgggctggagcttgaagccttaaagtggtggacaggcgctctgctcgagtaattcaccaggtttactaaatcgtt

SEQ ID NO: 30318 - DNA, 601 bp, Human
caggaatgagacatttaaaaaatgctctccgaaattcggcaaaactcacagggcgctagtggatgctttaagacattcacctggctgaaaatacggtggtgggctgaggacctcccctaggtgggttctgtgggcgccccgtgaacgacgagcctcccgccacgggacgcgaccatccccgccgcctcgccgcccttctccggtgccggccgcggggccttgccggcaacggtcggtaacgggcagatcccaggagcgaagggccctcagagactaccccaccaacgcactccgactccgsgggggcggcagggagcgcggccctgcttccctccctaaccctgccctccctaacccactacctgtggggaaggcgcttccctccgcggagcggacagaagccgccacgagcccggcaggaggttcctacttctccgaccacctctccagccgccgcagaaaccgcagaactgagctgacgacccggaagtgctcgcggaacctggaagtgacaccccgcccgagggccgggaggccccgcccagccctgctctcgcccgccactcaagccttgtcagggaagggcgtggagagggaagga

SEQ ID NO: 30319 - DNA, 601 bp, Human
ctcgtcctagcattttttgattaaaccaccaagtttaaaattcgttccttttgtcggagttcgcacgaagaaagttggaaggcagacttcaaacaacaagctacaaagcacaggaatgagacatttaaaaaatgctctccgaaattcggcaaaactcacagggcgctagtggatgctttaagacattcacctggctgaaaatacggtggtgggctgaggacctcccctaggtgggttctgtgggcgccccgtgaacgacgagcctcccgccacgggacgcgaccatccccgccgcctcgcygcccttctccggtgccggccgcggggccttgccggcaacggtcggtaacgggcagatcccaggagcgaagggccctcagagactaccccaccaacgcactccgactccgggggggcggcagggagcgcggccctgcttccctccctaaccctgccctccctaacccactacctgtggggaaggcgcttccctccgcggagcggacagaagccgccacgagcccggcaggaggttcctacttctccgaccacctctccagccgccgcagaaaccgcagaactgagctgacgacccggaagt

SEQ ID NO: 30320 - DNA, 601 bp, Human
caataggtagataaaaactccacagagtaggaatacagaatcgtgcatcgtgtcccatttgacaaatttttgagtttatctagaaaatagccctgcgttaaacgtttgttaaaagtgctgatttcaatgttcttacattctttaaaaattccttgttaagtgttctaatcttttagatgtggtatcagccacagaaatttattgttcccttcttgttttgcagttcagaaaattagaagtcaaattcggaagtaactcgtcctagcattttttgattaaaccaccaagtttaaaattcgtyccttttgtcggagttcgcacgaagaaagttggaaggcagacttcaaacaacaagctacaaagcacaggaatgagacatttaaaaaatgctctccgaaattcggcaaaactcacagggcgctagtggatgctttaagacattcacctggctgaaaatacggtggtgggctgaggacctcccctaggtgggttctgtgggcgccccgtgaacgacgagcctcccgccacgggacgcgaccatccccgccgcctcgccgcccttctccggtgccggccgcggggccttgccggcaacggtcgg

SEQ ID NO: 30321 - DNA, 601 bp, Human
accatgatctctttgactttatcttcttgtccctccacccccaaaactcttgctcatccctctccagatacactggcttccttgctattcctcaaacatgacaggcctaaaagcatttgtattggctttcctatctgcctgaatgctcttcctgatatttacttagcaaattttcttaattccttcaagtctttgctcaaataacacctactaaatgaggctcaaactgaccaccgtcatctttaaaataccagttcccacctccactctggaactttcccgtactcctttatatttctctttttttttttgatggcaccatcactttctaacaccattatatattttattttctgcatcctctaatagaatgtaagctccatgagggcaaagctttttattttgttcacttaagtaaaataggcgtctagaacagtacctggcacacaataggagccaaaaaaaaatctgttcagtaaacgaaggcaaatatcagtaagtataatatgcgtgtgggaggggagagggggttaaaaagggcaagaagtcccaataggtagataaaaactccacagagtaggaatacagaatcgtgcatcgt

SEQ ID NO: 30322 - DNA, 601 bp, Human
tggattactgcaaaaatctcctaaatgatttccctgcttctacactcacccctacactctaatcacaactcacagccagggtgatcttctaaaacttcagttacaacatacctctcctctattcaaaatctcccatggcttctatcagcctttacaatgatccggctaccatgatctctttgactttatcttcttgtccctccacccccaaaactcttgctcatccctctccagatacactggcttccttgctattcctcaaacatgacaggcctaaaagcatttgtattggctttcctawctgcctgaatgctcttcctgatatttacttagcaaattttcttaattccttcaagtctttgctcaaataacacctactaaatgaggctcaaactgaccaccgtcatctttaaaataccagttcccacctccactctggaactttcccgtactcctttatatttctctttttttttttgatggcaccatcactttctaacaccattatatattttattttctgcatcctctaatagaatgtaagctccatgagggcaaagctttttattttgttcacttaagtaaaataggcgtctagaac

SEQ ID NO: 30323 - DNA, 601 bp, Human
accaactagaacaacgtatgtagtatctattaagtatctgttgagtgaaatacttggtagtatgttaaagtgctaatatattagaaatgtatctgagtatgacacaaagtattccacttcactgaggaaactgcagcaataacttccagactcacagccacatccagctacctaccaatagctatacaggttgaacattccttatctgaaatgcttgggacctgaagtcttttggattttagaatatctgcatcgtatatacttagtgattgagtaccccaaattcaagctctgaaatgcyccaaagagcatttcctttcagtgtcatgttggtgctcaaagttttggattttggagcattttgaatttgggatgcccaacctgtacccatatactctccctccctgtcactatagttgaactctatacctatttttatctaaatccaatccttctacctttgtatcaggcattgtcttctaattcactcaaggatattgttctgacaattcagttgttacttctctccctcaccatcaaattttccctctctgcggatcatttccattagcaaacacataggtggctacttctcccacct

SEQ ID NO: 30324 - DNA, 601 bp, Human
ctcactctgctctggtcatactggtcccctgctgttctttgacaggggaagcatgatcctgcttgagggcctttgtggtggctcttctttttgctgacagtattctttccaaatacctgcatagttcactctctcatttggttcagatctctgggtcaaacattactccatcagaaaggccttctataatcaacctataagaaagaattaccttccttcttcctcacactgctttattttcattcataccaataactgaagctaacatatatatgcttattctgtctccatctactaaaayagatgacacactgaagacagggacttctgttcatttacatatttaccaactagaacaacgtatgtagtatctattaagtatctgttgagtgaaatacttggtagtatgttaaagtgctaatatattagaaatgtatctgagtatgacacaaagtattccacttcactgaggaaactgcagcaataacttccagactcacagccacatccagctacctaccaatagctatacaggttgaacattccttatctgaaatgcttgggacctgaagtcttttggattttagaatatctgcatcgt

SEQ ID NO: 30325 - DNA, 601 bp, Human
tatcccaaccccaccctcatagtagccacactaagactttaaaacataaggcaaatcacatcactggtctattcaaaaccaccaatggcagcatcccatctcagtgaaaaccacagagtccatggcttggaaggcctatgtgatttgggccccccagtgcctacttccctatcttcgcccactcaccctctcactctgctctggtcatactggtcccctgctgttctttgacaggggaagcatgatcctgcttgagggcctttgtggtggctcttctttttgctgacagtattctttccaratacctgcatagttcactctctcatttggttcagatctctgggtcaaacattactccatcagaaaggccttctataatcaacctataagaaagaattaccttccttcttcctcacactgctttattttcattcataccaataactgaagctaacatatatatgcttattctgtctccatctactaaaatagatgacacactgaagacagggacttctgttcatttacatatttaccaactagaacaacgtatgtagtatctattaagtatctgttgagtgaaatacttggtagtatgtta

SEQ ID NO: 30326 - DNA, 601 bp, Human
tccatcagccaacctttcagctcgtccttctaactatagccagaatctgacagcttctaccatcttcaatgctattaccctaagtcaccatcatctgtcactaaagttaatgtgataactcatggtctccttatttccagtcttgcctatcccaaccccaccctcatagtagccacactaagactttaaaacataaggcaaatcacatcactggtctattcaaaaccaccaatggcagcatcccatctcagtgaaaaccacagagtccatggcttggaaggcctatgtgatttgggccccscagtgcctacttccctatcttcgcccactcaccctctcactctgctctggtcatactggtcccctgctgttctttgacaggggaagcatgatcctgcttgagggcctttgtggtggctcttctttttgctgacagtattctttccaaatacctgcatagttcactctctcatttggttcagatctctgggtcaaacattactccatcagaaaggccttctataatcaacctataagaaagaattaccttccttcttcctcacactgctttattttcattcataccaataactgaagctaa

SEQ ID NO: 30327 - DNA, 601 bp, Human
tcaggtgtaagatcttgacctcatggccctttcagtctggagatggatgggggaaaatacatttgaggagcaatcatcagataaaactcagcaaaaataatggccagccatcagtccttacatttcacaccttgctagcactggattcaacagatcatttctgccttcttgaaacatttctttggctttgagacagcattctcagttctcatgtcactggataccattgtattttttattttcttttgctggttcctcctcagctccctgacttgtaactgttgaactgccctaagttttsttgggtcctctattttccacatactttactctcttagttacctcatccagacttacggctttaaataccatctactatctggtgatgactctcaaatttgtatctccagccctcaattctccctttgtacccatatataaaactgcctgcttgacactggataaaaatatcaagtaggtagctcaaattcaatttgtcaaaaaccatgtttctgatgctactcttgcaaatatgctctgtcctcagtcttacccacctcggtaacagtaaacatagtcttcctgtaacagctcaaaaacc

SEQ ID NO: 30328 - DNA, 601 bp, Human
caaaaagataagaactgggataaagatacaaagcataccatggaggctgcctgtagaagtgagctggctcagaaaagcttccaggttctttaagctagactttagccaagcagaggagggaagtcattccagaggctgacagaatagaataagtaaagccatggaaggatgaaatgtttgtggggaaaaacataaactgttctacattatcagggcataagtacgaatagggagtggcaggagatgaagctgaaagagacagcatagatggagttgtttggcaggataggtgcaagcagtsgggagtcactgaagaattttaggcaggaaaggtcagacagctgggcttcagtgcgtgatttagaaacagatgagggatgggggctcgaaaagggtggcagcagtacacagtcaataaatatttactgagcttccactacacgtcaggtgtaagatcttgacctcatggccctttcagtctggagatggatgggggaaaatacatttgaggagcaatcatcagataaaactcagcaaaaataatggccagccatcagtccttacatttcacaccttgctagcactggattcaacagatcat

SEQ ID NO: 30329 - DNA, 601 bp, Human
cttagtctagaattttccatgtactgtcctttctacctgctgtcaagtcactggtaaaatcttcagctcatgtttgcatgtctgcccctttattttcctgttctctctaaattcagtatttacagagtgcctaccaagagaatggcactgtgacaggttccagagagaagatgatgattaaaggcatgctcccaatcctaaaaatttatactctagagaatgtaacaaacatacaaaaagataagaactgggataaagatacaaagcataccatggaggctgcctgtagaagtgagctggmtcagaaaagcttccaggttctttaagctagactttagccaagcagaggagggaagtcattccagaggctgacagaatagaataagtaaagccatggaaggatgaaatgtttgtggggaaaaacataaactgttctacattatcagggcataagtacgaatagggagtggcaggagatgaagctgaaagagacagcatagatggagttgtttggcaggataggtgcaagcagtcgggagtcactgaagaattttaggcaggaaaggtcagacagctgggcttcagtgcgtgatttagaaac

SEQ ID NO: 30330 - DNA, 601 bp, Human
ctcagcctcctgagtaactgggactataggcatgcgcccacaccgaactaatttttttattttttgtggagatgggtggtgctatgttgcctaagctggtctcaaacttctggcctcaagcgatccttccaccttgtcctcctaaagtgctgggattagaggcatgaaacactgcatgtacccagatttagctatatttaatgatatcattcaatcatgttttgtgtcctgttgtcaggacagtgtaataaacaagaatttgaggtaatttaatcagtgttactgacttgctgggtcaaayagtccaagatattttacctcatatctctttgcctaagtgatatgacaagaattactgtaaacccatcaagataaaaatgtttgatttttaattcagtctcccacctgtatgagctcatctaggctctcctgaagactgtttcccaaagtagtatttctgtataactgatatgccatggcttaggaggaagaatttgtttttcttattcaagcttgcattgatgtcctaaaaatttaatataaaattgttaaaaaagatcatactgtaacatcataaattatgtatataatatcatctacc

SEQ ID NO: 30331 - DNA, 601 bp, Human
agaggcaggatgttgctctgtcaccaaggctggagtacagtggtaccatcatagtgcacttaagcctcaaactcctgggttcaagccatcctctcacctcagcctcctgagtaactgggactataggcatgcgcccacaccgaactaatttttttattttttgtggagatgggtggtgctatgttgcctaagctggtctcaaacttctggcctcaagcgatccttccaccttgtcctcctaaagtgctgggattagaggcatgaaacactgcatgtacccagatttagctatatttaatgrtatcattcaatcatgttttgtgtcctgttgtcaggacagtgtaataaacaagaatttgaggtaatttaatcagtgttactgacttgctgggtcaaacagtccaagatattttacctcatatctctttgcctaagtgatatgacaagaattactgtaaacccatcaagataaaaatgtttgatttttaattcagtctcccacctgtatgagctcatctaggctctcctgaagactgtttcccaaagtagtatttctgtataactgatatgccatggcttaggaggaagaatttgtttttct

SEQ ID NO: 30332 - DNA, 601 bp, Human
attctcctgcctcagcctcccaagtagctgggattacagatgtgtgccaccacacccagctaattttatatttttagtagagacagggtttctccatgttggtcaggctggtctctaactcttgaccttgggtgatccgcctgcctcggcctcccaaagtgctgggattacagtcatgagccatggtgcccagctggaaatacttaatatgtttttatttgggagaattatacagaagggttaattctcttaaaattgaaatataaattcagacttgtaaatctcagaagacttaaattgsacaaaactatcttaaagctaaaaagtatatgactttcttccctaaatttgagaagggggaaaccaacaatctcaatttttatgttgaacaaaaatttttgaagatttaactttatttatttagaggcaggatgttgctctgtcaccaaggctggagtacagtggtaccatcatagtgcacttaagcctcaaactcctgggttcaagccatcctctcacctcagcctcctgagtaactgggactataggcatgcgcccacaccgaactaatttttttattttttgtggagatgggtggtgc

SEQ ID NO: 30333 - DNA, 601 bp, Human
ggttaaccaaagcctctaaactagaattcctttatctcctttgccataactgatgatgaagcaccaagcttgaagacatcttttgtactatcttgacacaaacaatcttgaagagaaaacatgcagtgatgttacaaagccagaacaaaactttgtcaattttcccttacagtggctggaaaggagaagatagacaaagaggtgtttcttttaaatacacagggcctatattaacaaacaaaaaacctattaaattttattgaatctcataaaatataccaacaaatggaaatacttaatrtgttttttttttttttccttttttgtgagacggagtttcgctcttgttccccaggctggagtgcaatggcgcaatcttagctcaccacaacctctgcctcccgcattcaagcgattctcctgcctcagcctcccaagtagctgggattacagatgtgtgccaccacacccagctaattttatatttttagtagagacagggtttctccatgttggtcaggctggtctctaactcttgaccttgggtgatccgcctgcctcggcctcccaaagtgctgggattacagtcatgagccatggt

SEQ ID NO: 30334 - DNA, 601 bp, Human
ttctagattcaggaaaatatccttaccctgaaattgactctgttcctgaccctctgagccagtgctgcatttatagccttatcaaactgaagtagaacttgaagggcaagttggggggtgatctgttgagactgagaaaaggtaaaggtcataaatcccgttaaggaagaacattaaagacaaagtaaataaaaatatacaaattatcatctaaaatttaactgaggttaaccaaagcctctaaactagaattcctttatctcctttgccataactgatgatgaagcaccaagcttgaagmcatcttttgtactatcttgacacaaacaatcttgaagagaaaacatgcagtgatgttacaaagccagaacaaaactttgtcaattttcccttacagtggctggaaaggagaagatagacaaagaggtgtttcttttaaatacacagggcctatattaacaaacaaaaaacctattaaattttattgaatctcataaaatataccaacaaatggaaatacttaatatgttttttttttttttccttttttgtgagacggagtttcgctcttgttccccaggctggagtgcaatggcgcaat

SEQ ID NO: 30335 - DNA, 601 bp, Human
tatatacctaaatttgatctagcaaaatggctctgaaaattaggtatttctaacacattatcttttgtcttggccatatgctacactaagctaaacagaatgttatttgcaaacattctggatttaaaattgatcaagttggctgtaacccaggagtagggtgataaaaagcgtgagttagaatagtagcagcaggaaaataaaaagcaagaatggaaaagttctgatcaaggctgagagcaattatttatagcttttcgaaaatagacaaactcacaaaacactatgcaagataaatgtwaatgtcaaattactttaactctagctaaagaaatccaaactagaaacctacaataatgcacctagaagatgactagttaggccttgtgaactatcttgcctctgataagtagtccaccaaatttcttattagagcaaaatttatgtattaacatggatcatctgggcagacttctgcatatgggtatataaaaaaacacaaactaattttggcagaatcattactgttaaaaattcatggatccactggtcaaattatacagtcttgaaggcatattttactccagataattttttggca

SEQ ID NO: 30336 - DNA, 601 bp, Human
gctgggattacaggcatgagccactgtacccagcctaaaagaacatcttaaaagttatataataaatgtttgttacagaaacatcaaaaaacagggaaaaggaaactttcagttttgttagaagggctatttttcttgatcactaaatcttatttttggggggtgtggcattaaatcttttaacgcttgttaattactgttcgaggctcaacactataaagtaaccattacttttatctatgggcatatgttctcccaaaaccatacaatggctctttaaaagcctagttatggccgggtrcggtacctcacgcctgtaattccagcactttgggaggccgaggcgggcggatcatgaggtcaggagttcgagaccagcctggccaacatagtgaaatcccatctcttactaaaaatacaaaaattagctgggcgttgtggcgtgtgcctgtaatcccagctattcaggaggctgagacagaagaatcgcttgaacccaggaggcagaggttgcagtgagccgagattgcgccactgcattccagcctgggtaacagacttcgtctcaaaaaaaaaaaaaaaaaaagaataaataaataaa

SEQ ID NO: 30337 - DNA, 601 bp, Human
aagtgctgggattacaggcatgagccactgtacccagcctaaaagaacatcttaaaagttatataataaatgtttgttacagaaacatcaaaaaacagggaaaaggaaactttcagttttgttagaagggctatttttcttgatcactaaatcttatttttggggggtgtggcattaaatcttttaacgcttgttaattactgttcgaggctcaacactataaagtaaccattacttttatctatgggcatatgttctcccaaaaccatacaatggctctttaaaagcctagttatggccsggtgcggtacctcacgcctgtaattccagcactttgggaggccgaggcgggcggatcatgaggtcaggagttcgagaccagcctggccaacatagtgaaatcccatctcttactaaaaatacaaaaattagctgggcgttgtggcgtgtgcctgtaatcccagctattcaggaggctgagacagaagaatcgcttgaacccaggaggcagaggttgcagtgagccgagattgcgccactgcattccagcctgggtaacagacttcgtctcaaaaaaaaaaaaaaaaaaagaataaataaa

SEQ ID NO: 30338 - DNA, 601 bp, Human
acatttttggttttacatgtatccacaatggggcaacatgtttttgtattttttttaagatacagtctcactctgtggcccaagctagagtgcagtggcgcgatcttggctcactgcaacctccgcctcctggattcaagcgattctcccgcctcagccttccaagtagctgggactacaggcatgcaccaccatgcccagctcattttagtaaagatgaggtttcactgtgttggccagtctggtctcaaattcctgacctcaagtgatctgcccaccttgacctcccaaagtgctgggrttacaggcatgagccactgtacccagcctaaaagaacatcttaaaagttatataataaatgtttgttacagaaacatcaaaaaacagggaaaaggaaactttcagttttgttagaagggctatttttcttgatcactaaatcttatttttggggggtgtggcattaaatcttttaacgcttgttaattactgttcgaggctcaacactataaagtaaccattacttttatctatgggcatatgttctcccaaaaccatacaatggctctttaaaagcctagttatggccgggtgcggtac

SEQ ID NO: 30339 - DNA, 601 bp, Human
attttagatttattctttaaattcaaaaagtttcttctataagatatttggctttggtcaaatattacttttaacacttaatcatttggccaaattgtatcttcaatgcacttttaataaatacatttttggttttacatgtatccacaatggggcaacatgtttttgtattttttttaagatacagtctcactctgtggcccaagctagagtgcagtggcgcgatcttggctcactgcaacctccgcctcctggattcaagcgattctcccgcctcagccttccaagtagctgggactayaggcatgcaccaccatgcccagctcattttagtaaagatgaggtttcactgtgttggccagtctggtctcaaattcctgacctcaagtgatctgcccaccttgacctcccaaagtgctgggattacaggcatgagccactgtacccagcctaaaagaacatcttaaaagttatataataaatgtttgttacagaaacatcaaaaaacagggaaaaggaaactttcagttttgttagaagggctatttttcttgatcactaaatcttatttttggggggtgtggcattaaatcttttaacg

SEQ ID NO: 30340 - DNA, 601 bp, Human
gcctcccaaagtgctgggattacaggcatgaaccactgtaccttgccttactttctcttttaaaaaatgtgtagtcttttatccctcgccaccctcccaccctttccccaaagttcccaaagtcatatcattcttatgcctttgtgtcctcatagcttagcttgcagtaaattactttcattggataatgttatgtaaataatttaaacaaagcaagtccttgggatttatgagccagtatgtgagtattcactttcaaatataaagcattttagatgtagattggagtgaaaaatcttamatatcatatgctgaaattccattagttgcagtataaatgtatatgcttcatttattttaccacaaaaataaaatgctacaaaacttgactgaaagatattaaagtatattaaatgccttccaactgtaaatgaaaattgacaattaacatcatcaaagtgcacattagctacgtaacttctgagccaacaaatgtttttaaaaaggtaaacgtaagaaataatataatctttttagaataatttgaattagaatctctaacatgaaataagcttttctgtatataatttttacttattta

SEQ ID NO: 30341 - DNA, 601 bp, Human
gagaggtgaaagtggctttactacagtaatagtatagtaaagggatcaatagaaatggagagacttttaaagtaggaccggtaggaatggacaactataaatatggtggggttgggggacagagaaatccacggtaactcccaagtttctgacttgaatgtcaatgcattcacagaaaaagctggttggggagtaaagttaaatttggaacttgttgaatttcaggtatatctaagtcatgatgtccaataagtaattggagtataggagaaagcatgtgatcatgatattcagtttaacsaaagccagagggttggatgagaccaaggacagcggacgcacgctgtaaccctaagaaataccaacaattaaatgataagcagagacagaactacagaggagtctgagagcaacaggccagggaatacgagaaaagctcacacagtatggtttcaagggaaataggggttcaaaaaaacaatcatcaatagcactacaaatgatgcattagatttagcaaaagtaactcggcaacagcaatttcagtggagtgataaatatactgaaagtcacccatgacgttaagggaaaaagacacaaa

SEQ ID NO: 30342 - DNA, 601 bp, Human
tgggattacaggcgtctgccaccatgtcagacttatttttgtatttttagtagaggcggggttttgccatgttggccaggctcgtcttaaacttctgacctcaggtgatctgcccacctcggcctcccaaagtgctgggattacatgtgtgagccactgtgcccagccggaaatttttaaaaagaatgtgatgaaagtcgtgcatagacaccaacagaatacaattaaaacctgagatatacacatgcacacatatagtcacacaggaaatttagtaggcaacacttaaatgcctaaaatsttcaactcagaaaccaccaagcatgaaaatgctccttgcaatattattgtaatagcaaaaatgggattcattctaaatagtctatcaagtgagaatgactaaggaaactgatagctatgaatgaatgaatataataaatgagtaattactgtgtgctagactatgctggcctctgaggatacaatggtaagcacagctccctgccactggtgagctgagtttagcagggagatcattaaaacaggtaaatacgtagtataacagtgctatgaaagagtaagttactgggtacaatgagag

SEQ ID NO: 30343 - DNA, 601 bp, Human
gttcaagtgattctcctgcctcagcctcccaagtagctgggattacaggcgtctgccaccatgtcagacttatttttgtatttttagtagaggcggggttttgccatgttggccaggctcgtcttaaacttctgacctcaggtgatctgcccacctcggcctcccaaagtgctgggattacatgtgtgagccactgtgcccagccggaaatttttaaaaagaatgtgatgaaagtcgtgcatagacaccaacagaatacaattaaaacctgagatatacacatgcacacatatagtcacayaggaaatttagtaggcaacacttaaatgcctaaaatcttcaactcagaaaccaccaagcatgaaaatgctccttgcaatattattgtaatagcaaaaatgggattcattctaaatagtctatcaagtgagaatgactaaggaaactgatagctatgaatgaatgaatataataaatgagtaattactgtgtgctagactatgctggcctctgaggatacaatggtaagcacagctccctgccactggtgagctgagtttagcagggagatcattaaaacaggtaaatacgtagtataaca

SEQ ID NO: 30344 - DNA, 601 bp, Human
cccagcctatttttatttttttgagatagagtctcactctgttgcccaggctggagtgcagtgctgtgatcttgaccaactgcaacctctgtctcccaggttcaagtgattctcctgcctcagcctcccaagtagctgggattacaggcgtctgccaccatgtcagacttatttttgtatttttagtagaggcggggttttgccatgttggccaggctcgtcttaaacttctgacctcaggtgatctgcccacctcggcctcccaaagtgctgggattacatgtgtgagccactgtgcccrgccggaaatttttaaaaagaatgtgatgaaagtcgtgcatagacaccaacagaatacaattaaaacctgagatatacacatgcacacatatagtcacacaggaaatttagtaggcaacacttaaatgcctaaaatcttcaactcagaaaccaccaagcatgaaaatgctccttgcaatattattgtaatagcaaaaatgggattcattctaaatagtctatcaagtgagaatgactaaggaaactgatagctatgaatgaatgaatataataaatgagtaattactgtgtgctagactat

SEQ ID NO: 30345 - DNA, 601 bp, Human
tctcaaactcctgacctcagatgatctgcccgccgtggcctcccaaagtgctgggattacaggcatgaatcactgcaccagcctattttaatatttaaaaagaaatagagacagggtcttgttatgttggccgggctagtcaaacttttggcctcaagcaatcctcccgcctcagcctcccaaagtgctgagattacaggcgtgagccaccatgcccaggacacattcttataattaagaaaaaaaaattgtttaaagtaggaatatatatatacttgagcatcaaaaggaaatttttactttttttttttttttttttggagatggagtctcactctgtggcccaggctggagggcaggggtgtaatctcagctcactgcaacctccacttcctgggttctagctattctcctgtctcagcctccagagtagctgggactacagggcgtaggccaccatgcctgtctaatttttatatttttagtagagatggggtttcaccatgttgtccaggctggtctcaaactcctgacctcaggtgatctgcccaccttggcctcccaaagttttggaattacaggcgtgagccatagcacccag

SEQ ID NO: 30346 - DNA, 601 bp, Human
acctccacctcccaggttcaagagattctcctacctcagcctcccaagtagctgggactacaggtgcctgccaccacgcccagctagtttttttatttttagcagagatggtgtttcaccatgttggccaggatggtctcgaactctgacctcaggtgatccacccacctcagcctcccaaagtgctgggattaccagtgtgaaccactgcgcctggcctatataattttttttttttttttttttttttgagacagagtctcactctgttgcccaggctgcagtgcagtggtgagatctyggatcactgcaacctccgccacccaagttcaagctattctcctgcctcagcctcctgagtagctgggattgcaggtgtatgccaccacgcctagctaacttttgtatttttagtagagacagggtttcaccacgttagccaggctggtctcaaactcctgacctcagatgatctgcccgccgtggcctcccaaagtgctgggattacaggcatgaatcactgcaccagcctattttaatatttaaaaagaaatagagacagggtcttgttatgttggccgggctagtcaaacttttggcc

SEQ ID NO: 30347 - DNA, 601 bp, Human
tgctcttaacacaaatggttcagattatgaagtatatttaaaataatataattagcaaaaaggaaataaactaatcatgaaacagaaattaggtgtatagtttttgaaacatttaaggacctgaagaagttcctaggtctggtgtgaaaagttcacttgcacatgtcatatttaacagattagatgaatatttaccatcatgactccaaagttcttatggctaattaaaatcctgtttaaaataactctttaaatatatgggtctccagcaacatagaaaccataggattgtaaaaattaytccttaaagtaaaaggtgtctgaaaagcctgataaacacttaaaatttgtaatggaaatagggaacaaatgcttattaatttgcttattttacccacacaaatccaacctgtgtaagcagtctatatgttattaagtcacaaagtaagagcactgtttgagatatgtaatcagaatttagtggagataaaagcctgggcttatctgggaattgatcatagggccattttacccgttaggcttttcatatggatgcagatcttctaaaggctcataaaaacaaggtttcaagtagctttca

SEQ ID NO: 30348 - DNA, 601 bp, Human
taaaaagttaactatgcccaaagttcttagaatgattattcctaggtaaccttctgaactataacaagtccccaacaataacgctgctaggttcagagactttctgatatctggaagagactatttctttaaaaagggcttaaggtgtaattttatatagctactaaaaatcaggcttaagtgcaggggctcacgcctgtaatcccagcactctgggagaaggaggtgggaaggtcacctgagcccaggagtttgagaccagcctgggcaatacagcaagactcttttttttttttttaakgcttaagattaagagtagtaaactcaaaaatacatttactaatgtctacatatacatacatttttgcaaaaaaaagttataacaccatcaggtagtgttacagagaacgtttttcttccatgtgcttttttgtattctctacattttttcagtgattgattgattagctatttctttggaaatgcaaaatatataaaacaaatccgactcaaacagggaaatggagggggttactttctacatatctttctcttgcttttcaaaactccctgtgtcaaagagcagcagtcttttctattt

SEQ ID NO: 30349 - DNA, 601 bp, Human
ataaaaagttaactatgcccaaagttcttagaatgattattcctaggtaaccttctgaactataacaagtccccaacaataacgctgctaggttcagagactttctgatatctggaagagactatttctttaaaaagggcttaaggtgtaattttatatagctactaaaaatcaggcttaagtgcaggggctcacgcctgtaatcccagcactctgggagaaggaggtgggaaggtcacctgagcccaggagtttgagaccagcctgggcaatacagcaagactcttttttttttttttawggcttaagattaagagtagtaaactcaaaaatacatttactaatgtctacatatacatacatttttgcaaaaaaaagttataacaccatcaggtagtgttacagagaacgtttttcttccatgtgcttttttgtattctctacattttttcagtgattgattgattagctatttctttggaaatgcaaaatatataaaacaaatccgactcaaacagggaaatggagggggttactttctacatatctttctcttgcttttcaaaactccctgtgtcaaagagcagcagtcttttctatt

SEQ ID NO: 30350 - DNA, 601 bp, Human
aataaaaagttaactatgcccaaagttcttagaatgattattcctaggtaaccttctgaactataacaagtccccaacaataacgctgctaggttcagagactttctgatatctggaagagactatttctttaaaaagggcttaaggtgtaattttatatagctactaaaaatcaggcttaagtgcaggggctcacgcctgtaatcccagcactctgggagaaggaggtgggaaggtcacctgagcccaggagtttgagaccagcctgggcaatacagcaagactcttttttttttttttwaggcttaagattaagagtagtaaactcaaaaatacatttactaatgtctacatatacatacatttttgcaaaaaaaagttataacaccatcaggtagtgttacagagaacgtttttcttccatgtgcttttttgtattctctacattttttcagtgattgattgattagctatttctttggaaatgcaaaatatataaaacaaatccgactcaaacagggaaatggagggggttactttctacatatctttctcttgcttttcaaaactccctgtgtcaaagagcagcagtcttttctat

SEQ ID NO: 30351 - DNA, 601 bp, Human
gtgctaaaaaaaagttctaagcagtactggtgtatgtcattaattcattttgatagagatctaggtattataaattaatccctgaattctacagactaataaaaataaatataacaagggttacgaggatgctgttaccttaaatatgaaaaaaattgtacacaatttcaaatatagaaatgttatcttgtgattcaggaaacagcaccaccttcacaggaatttaaaaataatgacaaagatgtatctaatgactataataaaaagttaactatgcccaaagttcttagaatgattattcctaggtaaccttctgaactataacaagtccccaacaataacgctgctaggttcagagactttctgatatctggaagagactatttctttaaaaagggcttaaggtgtaattttatatagctactaaaaatcaggcttaagtgcaggggctcacgcctgtaatcccagcactctgggagaaggaggtgggaaggtcacctgagcccaggagtttgagaccagcctgggcaatacagcaagactcttttttttttttttaaggcttaagattaagagtagtaaactcaaaaatacatttact

SEQ ID NO: 30352 - DNA, 601 bp, Human
tggcgtgatcttggctcactgcaggctctgccccccgggggttcacgccattctcctgcctcagcctcccgagtagctgggactacaggtgcccgccacctcgcccagctaattttttgtactttagagacggggtttcaccatgttagccaggatggtctcgatctcctgacctcgtgatctgcccgcctcggcatcccaaagtgctggcattacaggtgtgagccaccgtgcctggcaatttttttttaaagacagagtcacactgtgttgcccaggctggagtgcagtagcgcaatcycagctcactgcaatctccacctctcgggtttaagcaattgtcctgcctcagcctccgcagcagctgggattacaggcgggtaccaccatgcctggctaatttttgtatttttagtagagatggagtttcaccatgttggccaggctgctctcaaactcctggcctcaagtgatctacccaacttggcctcccaaagtgctgggattacaggcgtgagccactgcacctggcctactgtcccaaacttctaacactgcattcttttctgcagatacaaagtaaatggaatacaatttaagc

SEQ ID NO: 30353 - DNA, 601 bp, Human
caaaagagaaagtaaagtaaagtaaattcaaggagcaatttaattttacaattaactattttaagactatcaaaaatgagaacacaggactaatagtggtggtggcttgcagggtggggaagaacaggaggaaaggtgacactgtaaatatgttgaacttcagtaagtttccttttaagcagagatacaaacatgcttagctcctcatattcatactagagtaaaactaagttgaactacatttggttcacataattgttacataacctttcttcccccaggtcctttactgtcccaaattttttttttttttttttgagatggagtctagctgttgcccaggctggagtgcagtggcgtgatcttggctcactgcaggctctgccccccgggggttcacgccattctcctgcctcagcctcccgagtagctgggactacaggtgcccgccacctcgcccagctaattttttgtactttagagacggggtttcaccatgttagccaggatggtctcgatctcctgacctcgtgatctgcccgcctcggcatcccaaagtgctggcattacaggtgtgagccaccgtgcctggcaatttttt

SEQ ID NO: 30354 - DNA, 601 bp, Human
acacacccagggctgagatccttagctgggaaggggggagaagggggagaccctaatggctattctctgcaaacaccggccttcctccgcaagacaaacggcctcgtctccagcccgtgccggcgctgctgataaatatttaaagctaaaaggccgagaggaagggtgggggcgggctgggggctcgcagcgccgtggtgccggcgaagagagatccgccgggaagcagagcgagcctgagagcaccgagcaaatatgggggcggggatggcctgctgggtcgcggcccagtgggtgcagmcttccagggccgacctccggctgggagcactctggacgcggaaaggggcgcccagccgggaaggaggcgccttcagggtaatgtgccccggcccctggggctcaggacagctcggtgcgcggcgttacctgagcttcgcatccaggggtagatccggaagttactctcggccgccaagtccgagtccctctgctccttggcgcccgccgccttggcggagtcgccgggacacaccccggagaggttctgctcaaagggcgcgcagtgcatgttgaaggaactcggctcgagcccatagcc

SEQ ID NO: 30355 - DNA, 601 bp, Human
agatacacacagaatgtaaaagggagcatggggctgggggacgggaagcaagaagcagcagccaggcgcttggggaacacgcgagtggtaggttttggggctccctaaggccccttggtgccgctgctgggaaggcggaggctcaggagggcaggcaaccacagggttagtccagacccacagtccacaaagacagcattaaagagggcttacaaaactgcaagattttacaaagaccttacaatagcaacatagaaaaggggaggtaaattccagaaagctacagaacaggtagataatrtccttttcatattgtacaaaaaaaccaaacctgacagactttcctataggtagtattttttcagtgttgaaaaaccaaaatttctcctttctccctccttaaaaaatgtttttaaactcctttcatttaaatagggttttttttttgttttttttgttttttgttttgtttttttacttccctattcgatttgagtttcctgattcagttcccagagctgggcttctcttcctctccctttctcatgtctcttcctctgccctttctccatccctcactcttcctcttcctcctctgctt

SEQ ID NO: 30356 - DNA, 601 bp, Human
tcaggctcttcgaacatgagggtcgggagggcagggtcgccgagtccccgctcttctccacgtgcacagcgctcctctggaagtcggagcgctcagacctgccagaaccgacccggaaaccaaagcgtgacagccaggggttgctagagcggccggcgcggcgcagcgaaccatcgagtttaaccaggcgcggctagaagggcagggaggcggtgggaggggagggacggaggcccgcgctgcccaagagcgccacgggcggggcggggccggcggcgggctgcgggcgcggccggacggkagttccccggagaaggatcctgcagcccgagtcccggtgagtgcgagaggacccgcgccccctgtcacccctcacttctcctgagtcccaagtaaggaacggagccaaccctggggaggacccccggtcccctctcccagagtatacggagcctgaacctccccacttcccccaactctgttcgcggatagggtctagttgcctgctctcggacatccgttcagcagacactacctcttcgtcaccccctgcccaccctgacccgcctttacctcgcgtctagaggacacagccagggat

SEQ ID NO: 30357 - DNA, 601 bp, Human
tgtttttactgagatggagaaaactggaggatgaggcattttattttggacatgttaaagttaaggtgacaatacagcaaggtggaaatgttgagtgtgttgttggttatgcagatttgcaattcaggggaggaatctgacttggagacacagatttgagagctatcagcatatagatagcatatatatatcatatatatagatgatacttgaagacgtggttgtgaaggagaacgtctcaggagagtggaaggcaagaggtcaggggacaggaagcctgcacgacagaaaaggagcaacygcaagttgaaaaagaaataggaaaatgtgtgagtaaagcttacagaagagaatgttttaatgaaggggaggtagtcaacggcagtacaggctactgagagatcaaagaacattaatattttaaagtagccattgaatttacagttgggttttttttttttaagttaaggggtacatgtgcaggtttgttggatgggtaaactcaggtcatggaggtttgttgtgcagatcatttcatcacccaggtattaagccgtggcacccattagttatttttcctgatccctccctcttcctaccc

SEQ ID NO: 30358 - DNA, 601 bp, Human
tttttactgagatggagaaaactggaggatgaggcattttattttggacatgttaaagttaaggtgacaatacagcaaggtggaaatgttgagtgtgttgttggttatgcagatttgcaattcaggggaggaatctgacttggagacacagatttgagagctatcagcatatagatagcatatatatatcatatatatagatgatacttgaagacgtggttgtgaaggagaacgtctcaggagagtggaaggcaagaggtcaggggacaggaagcctgcacgacagaaaaggagcaaccgsaagttgaaaaagaaataggaaaatgtgtgagtaaagcttacagaagagaatgttttaatgaaggggaggtagtcaacggcagtacaggctactgagagatcaaagaacattaatattttaaagtagccattgaatttacagttgggttttttttttttaagttaaggggtacatgtgcaggtttgttggatgggtaaactcaggtcatggaggtttgttgtgcagatcatttcatcacccaggtattaagccgtggcacccattagttatttttcctgatccctccctcttcctacccgc

SEQ ID NO: 30359 - DNA, 601 bp, Human
ggtggaaatgttgagtgtgttgttggttatgcagatttgcaattcaggggaggaatctgacttggagacacagatttgagagctatcagcatatagatagcatatatatatcatatatatagatgatacttgaagacgtggttgtgaaggagaacgtctcaggagagtggaaggcaagaggtcaggggacaggaagcctgcacgacagaaaaggagcaaccgcaagttgaaaaagaaataggaaaatgtgtgagtaaagcttacagaagagaatgttttaatgaaggggaggtagtcaacrgcagtacaggctactgagagatcaaagaacattaatattttaaagtagccattgaatttacagttgggttttttttttttaagttaaggggtacatgtgcaggtttgttggatgggtaaactcaggtcatggaggtttgttgtgcagatcatttcatcacccaggtattaagccgtggcacccattagttatttttcctgatccctccctcttcctacccgccccactctggtaggccccagtgtctgttgctcccctcagtgtgcagttaggatgtatttgaccatctgtgagtgttgt

SEQ ID NO: 30360 - DNA, 601 bp, Human
atacttgaagacgtggttgtgaaggagaacgtctcaggagagtggaaggcaagaggtcaggggacaggaagcctgcacgacagaaaaggagcaaccgcaagttgaaaaagaaataggaaaatgtgtgagtaaagcttacagaagagaatgttttaatgaaggggaggtagtcaacggcagtacaggctactgagagatcaaagaacattaatattttaaagtagccattgaatttacagttgggttttttttttttaagttaaggggtacatgtgcaggtttgttggatgggtaaactcakgtcatggaggtttgttgtgcagatcatttcatcacccaggtattaagccgtggcacccattagttatttttcctgatccctccctcttcctacccgccccactctggtaggccccagtgtctgttgctcccctcagtgtgcagttaggatgtatttgaccatctgtgagtgttgtttcagaataatgggtgaagaaatcagactacattgggttccttaatttaaggcactatgatgaacaccttctgtgctgggtgctagagtccagaatctgacataatctctgctctcgatacagca

SEQ ID NO: 30361 - DNA, 601 bp, Human
accgcaagttgaaaaagaaataggaaaatgtgtgagtaaagcttacagaagagaatgttttaatgaaggggaggtagtcaacggcagtacaggctactgagagatcaaagaacattaatattttaaagtagccattgaatttacagttgggttttttttttttaagttaaggggtacatgtgcaggtttgttggatgggtaaactcaggtcatggaggtttgttgtgcagatcatttcatcacccaggtattaagccgtggcacccattagttatttttcctgatccctccctcttcctayccgccccactctggtaggccccagtgtctgttgctcccctcagtgtgcagttaggatgtatttgaccatctgtgagtgttgtttcagaataatgggtgaagaaatcagactacattgggttccttaatttaaggcactatgatgaacaccttctgtgctgggtgctagagtccagaatctgacataatctctgctctcgatacagcagatttgtggcagattgaaaagtaggccgggcgcggtggctcacgcctgtaatcccagcactttgggaggccgaggctggtggatcacgaggtc

SEQ ID NO: 30362 - DNA, 601 bp, Human
ataggaaaatgtgtgagtaaagcttacagaagagaatgttttaatgaaggggaggtagtcaacggcagtacaggctactgagagatcaaagaacattaatattttaaagtagccattgaatttacagttgggttttttttttttaagttaaggggtacatgtgcaggtttgttggatgggtaaactcaggtcatggaggtttgttgtgcagatcatttcatcacccaggtattaagccgtggcacccattagttatttttcctgatccctccctcttcctacccgccccactctggtaggycccagtgtctgttgctcccctcagtgtgcagttaggatgtatttgaccatctgtgagtgttgtttcagaataatgggtgaagaaatcagactacattgggttccttaatttaaggcactatgatgaacaccttctgtgctgggtgctagagtccagaatctgacataatctctgctctcgatacagcagatttgtggcagattgaaaagtaggccgggcgcggtggctcacgcctgtaatcccagcactttgggaggccgaggctggtggatcacgaggtcaggagttcgagaccagcct

SEQ ID NO: 30363 - DNA, 601 bp, Human
taaactcaggtcatggaggtttgttgtgcagatcatttcatcacccaggtattaagccgtggcacccattagttatttttcctgatccctccctcttcctacccgccccactctggtaggccccagtgtctgttgctcccctcagtgtgcagttaggatgtatttgaccatctgtgagtgttgtttcagaataatgggtgaagaaatcagactacattgggttccttaatttaaggcactatgatgaacaccttctgtgctgggtgctagagtccagaatctgacataatctctgctctcratacagcagatttgtggcagattgaaaagtaggccgggcgcggtggctcacgcctgtaatcccagcactttgggaggccgaggctggtggatcacgaggtcaggagttcgagaccagcctgaccaacatggtgaaaccctgtctctactaaaaatacaaaaattagccaggcgtggtggcgtgcgcctgtaatcccagctactcggaggctgaggcaggagaactgcttgaacccgggaagcagaggctgcagtgagccaagatcatgccactgccctccagcctgggccacagagcaag

SEQ ID NO: 30364 - DNA, 601 bp, Human
atcacccaggtattaagccgtggcacccattagttatttttcctgatccctccctcttcctacccgccccactctggtaggccccagtgtctgttgctcccctcagtgtgcagttaggatgtatttgaccatctgtgagtgttgtttcagaataatgggtgaagaaatcagactacattgggttccttaatttaaggcactatgatgaacaccttctgtgctgggtgctagagtccagaatctgacataatctctgctctcgatacagcagatttgtggcagattgaaaagtaggccgggygcggtggctcacgcctgtaatcccagcactttgggaggccgaggctggtggatcacgaggtcaggagttcgagaccagcctgaccaacatggtgaaaccctgtctctactaaaaatacaaaaattagccaggcgtggtggcgtgcgcctgtaatcccagctactcggaggctgaggcaggagaactgcttgaacccgggaagcagaggctgcagtgagccaagatcatgccactgccctccagcctgggccacagagcaagactctgtcttaaaaaagaaaaagaaaacaaaagttgaga

SEQ ID NO: 30365 - DNA, 601 bp, Human
tataattctcaaagggtaccctgataaagacagtaagcactgttactgttttgttggtgaggaaatagaggcttaggcagttgcccagtgggcctagcatctaggaagactctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcasgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccc

SEQ ID NO: 30366 - DNA, 601 bp, Human
atagaggcttaggcagttgcccagtgggcctagcatctaggaagactctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcacgcagcctgatagtgaacagaacccttgtgcccatacttttgccccccgagtttggcctgccctrgcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccgg

SEQ ID NO: 30367 - DNA, 601 bp, Human
gcaggtcttcttgagatagaagtccaggccctgaggtggcacgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccmcaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagtttt

SEQ ID NO: 30368 - DNA, 601 bp, Human
caggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagmgccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatg

SEQ ID NO: 30369 - DNA, 601 bp, Human
gccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatgrtgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatg

SEQ ID NO: 30370 - DNA, 601 bp, Human
gccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtrctcttcccccttttcccatgccctgacaccagtatctcatttggaactgactgtactttctgcctcttctttttgtctggccatggggtccagctattgcagtacaaggcagacatcaatgcagtgaatgaacacgggaatgtgcccctgcactatgcctgtttttggggccaagatcaagtggcagaggtgagtactcagcccttaattcctgagatgggtaggaagtaaagtctgagccttggtgggagattttggaaccctcaacccattctgtcagtactactgtgtgacacttac

SEQ ID NO: 30371 - DNA, 601 bp, Human
tcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtactcttcccccttttcccatgccctgacaccagtatctcatttggaactgactgtactttctgcctcttctttttgtctggccatggggtccagctattgcagtacaaggcagacatcaatgcagtgaatgaacaygggaatgtgcccctgcactatgcctgtttttggggccaagatcaagtggcagaggtgagtactcagcccttaattcctgagatgggtaggaagtaaagtctgagccttggtgggagattttggaaccctcaacccattctgtcagtactactgtgtgacacttacaggattaagttctacatttgtgcattcatggttggttcagtgactgccagcgaggtagcagtggctctcatcataatggccttttcattccaggacctggtggcaaatggggcccttgtcagcatctgtaacaag

SEQ ID NO: 30372 - DNA, 601 bp, Human
cctagagcgggcagagaagatgggccagaatctcaaccgtattccatacaaggacacattctggaaggggaccacccgcactcggccccgtgagtcaccactgtgggaagaagggttgtaaaaggaaataatcctggcctcttggggctgggttagggtgaagctgggtacctgacctgcccacactcttaggaaatggaaccctgaacaaacactctggcattgacttcaaacagcttaacttcctgacgaagctcaacgagaatcactctggagaggtgacccctgcccttcttgcccytccctcactaaacccccataaattacttgctttgtacctgttttaagtttttcctccagttagtgggcaaggaagtggcagcaacatttcaagcctcctaacccctacctgtcctgcagctatggaagggccgctggcagggcaatgacattgtcgtgaaggtgctgaaggttcgagactggagtacaaggaagagcagggacttcaatgaagagtgtccccggctcaggtagtgcaaggcgtaacctggaagctgctagttccaaggaaccctgaatagcactgaaagagatcttttgt

SEQ ID NO: 30373 - DNA, 601 bp, Human
tggaagggccgctggcagggcaatgacattgtcgtgaaggtgctgaaggttcgagactggagtacaaggaagagcagggacttcaatgaagagtgtccccggctcaggtagtgcaaggcgtaacctggaagctgctagttccaaggaaccctgaatagcactgaaagagatcttttgtactgggtctcaaccactccctccctcttctaggattttctcgcatccaaatgtgctcccagtgctaggtgcctgccagtctccacctgctcctcatcctactctcatcacacactggatgccrtatggatccctctacaatgtactacatgaaggcaccagtgagtagggatgttgaatttccttggggaggaaatggcagagagggagcctctctgaactatttgacttttgcctcctctcagatttcgtcgtggaccagagccaggctgtgaagtttgctttggacatggcaaggggcatggccttcctacacacactagagcccctcatcccacgacatgcactcaatagccgtagtgtaatggtgaggccacaagctcactcctggcccaggccccaaaagccctttgcctatctatga

SEQ ID NO: 30374 - DNA, 601 bp, Human
gtctcaaccactccctccctcttctaggattttctcgcatccaaatgtgctcccagtgctaggtgcctgccagtctccacctgctcctcatcctactctcatcacacactggatgccgtatggatccctctacaatgtactacatgaaggcaccagtgagtagggatgttgaatttccttggggaggaaatggcagagagggagcctctctgaactatttgacttttgcctcctctcagatttcgtcgtggaccagagccaggctgtgaagtttgctttggacatggcaaggggcatggcyttcctacacacactagagcccctcatcccacgacatgcactcaatagccgtagtgtaatggtgaggccacaagctcactcctggcccaggccccaaaagccctttgcctatctatgacttacctccttctatctgttttctcttcctcagattgatgaggacatgactgcccgaattagcatggctgatgtcaagttctctttccaatgtcctggtcgcatgtatgcacctgcctgggtagcccccgaaggtgagtgaagtcatcatgtcgggaggtaaaaaaggaccacctcagaagta

SEQ ID NO: 30375 - DNA, 601 bp, Human
gtgctctgtcaactgaaatctgctatcaaatattacggttattattactattattccgtatcagagcatgggtgtgggggtgtggggtggctgaagggaaagtccaaaacaaagggccagggaagtttttctcaaagtgtgcccaggaaccagctgcatatccagatcacctggagaatgtactagaaatacagattctcaggcccactcattatggtaaaatctctctccggacctccagaatccacattttgaacaagtgccttgggggattccaacatatactcaaatttgggaatarccagaccgtaggtcccaacctagctgcatgtgagaatcacctagggggcctttgaaaaattctgaggcctgtatcccatcctaggccaattaaaatcatccctaggggtggagcccagacatcagcactattaaaatctccccaggggccgggcgcagtggctcacgcctgtaatcccagcactttgggaggccgaggcgggcggatcacctgaggtcaggagtttgagaccatcctggccaacatggtgaaaccccgcctctactaaaaaaaaaaacaaaaattagccgggcgtggtgg

SEQ ID NO: 30376 - DNA, 601 bp, Human
ccagccctctggcagagtgctctgtcaactgaaatctgctatcaaatattacggttattattactattattccgtatcagagcatgggtgtgggggtgtggggtggctgaagggaaagtccaaaacaaagggccagggaagtttttctcaaagtgtgcccaggaaccagctgcatatccagatcacctggagaatgtactagaaatacagattctcaggcccactcattatggtaaaatctctctccggacctccagaatccacattttgaacaagtgccttgggggattccaacatataytcaaatttgggaatagccagaccgtaggtcccaacctagctgcatgtgagaatcacctagggggcctttgaaaaattctgaggcctgtatcccatcctaggccaattaaaatcatccctaggggtggagcccagacatcagcactattaaaatctccccaggggccgggcgcagtggctcacgcctgtaatcccagcactttgggaggccgaggcgggcggatcacctgaggtcaggagtttgagaccatcctggccaacatggtgaaaccccgcctctactaaaaaaaaaaacaaaaat

SEQ ID NO: 30377 - DNA, 601 bp, Human
ttaggcacatttatagagcactttttggtttagatagctctggtaagcacattttctcatctgagcttgagtattacctgcaggattatgatcccattttacagatggagacccagaggtcccagggctaggaaaagtgatagaggcaggatttgaatctaagtcttctgattcaatatccagccctctggcagagtgctctgtcaactgaaatctgctatcaaatattacggttattattactattattccgtatcagagcatgggtgtgggggtgtggggtggctgaagggaaagtccaaaacaaagggccagggaagtttttctcaaagtgtgcccaggaaccagctgcatatccagatcacctggagaatgtactagaaatacagattctcaggcccactcattatggtaaaatctctctccggacctccagaatccacattttgaacaagtgccttgggggattccaacatatactcaaatttgggaatagccagaccgtaggtcccaacctagctgcatgtgagaatcacctagggggcctttgaaaaattctgaggcctgtatcccatcctaggccaattaaaatcatccctag

SEQ ID NO: 30378 - DNA, 601 bp, Human
gtcctgcccattgggggagatgggctgacctcccttcacacgcttccacttcatccttcggttctggaaccacactttgacctgggggaggaagcaaaggagcctggtcactccagggccggtgtgacctcctccccatgtcaatgcttaggctagccagggtgtaactccagggaccccagcttgaaaccatcacttaccactccctactccctcaaaggccccaggaactaggaccgaagagaggacataccaatctgcccagaggtctgtcttgtggcttcggataaagccccagacrggggaacatgttctaaaagcactctgcattggccccacccccttcacatgccctgccctgcctgtgccaggtccccctgccccctacctccattccccaagggtctgggagcagaggtcatcagccttatccttaggcacatttatagagcactttttggtttagatagctctggtaagcacattttctcatctgagcttgagtattacctgcaggattatgatcccattttacagatggagacccagaggtcccagggctaggaaaagtgatagaggcaggatttgaatctaagtcttc

SEQ ID NO: 30379 - DNA, 601 bp, Human
catcccatggaggaagagggattttcttgtccccttttgcagtcacaggacactgtcactggagaaccttccactccagggttccacatctccaggccctcacccagcagccctccttattatctcccctcccctccagaatgcaggggacactttccagcctctacgttgttttcagctcctagttgttcagcccaacaactcagcatctggacaggttttcaatccagaaatcgtggatttaaaaggagtagctgctccttttctctggagcacagcccaacagcccctgctgtatccstaaattgattttgattttgaagcagcaggtgctgtcatgggttcattcttgtccacccagtcaagcctgtgtggacgggcctatatggggacaccgaaacctacatcgggctatttttctgtcttctctagtcagttctcagaagtgtctccacttagccaacaaatttggagacagggatgtgtttctggcttgcagcagctgagttgctgtccttgactctcctcattctgatttttcttggggtttcgggacaactaaggggccccaaagcctcagatgtgcagcctacagaggaag

SEQ ID NO: 30380 - DNA, 601 bp, Human
ttttattgattttatttctccgagagttttcttacaaagtgaattgagctcgcacaattagcttgatgtaatcttaagaaaatatatgaagtatgctttagaaaaaatcatgctctaaccagccatctcatttggcaatcattttccacagctcttgccctttttggggtggggaggtggggttatttttacatgtgaatgattacatctgcgtacaagagatccaaactcacgttgacctccctctgcaacaccagctggtgttgggagacagagcgctgaggcagccagggcttcagtyccccatgctctttggccatcagtcctcaaatgtcatctccagaagacctggctgaggtctgggcagtccacacacaaaaacctagcatttcctcccacaataacagcatttgtagaacacacagcaagagcttaaatccatcccatggaggaagagggattttcttgtccccttttgcagtcacaggacactgtcactggagaaccttccactccagggttccacatctccaggccctcacccagcagccctccttattatctcccctcccctccagaatgcaggggacactttccagcc

SEQ ID NO: 30381 - DNA, 601 bp, Human
atgggtcacaggatgaacccctaaattggggttcagcctgggggccacatgggttcttggcttgcacaggaaggaattcaagagcgagccaacagagtaaagtgaaaacaaatttattaagaaggtaaaggaataaaagggtgattattccatagacagagcagggaatgggctgctggactgagtatacatatggttatttcttgattatatgctaaacaaggggtggattatttaagagttttccagaaaaagggtggggagttcctggaaccgagggtttctctcccttttagaccayatagggtaacttctcaatgttgctatggcatttataaactgtcacagcgctggtgggagtgtctaatgtatttaacatgctaatacattataattagcatataatgagcagtgaggacgactagaggtcactttcattgcagtcttggtttgggtgggctttctccagcttctttactgcatcctgttttatcataggggtctttgtgacccgacctgtatatggtgaaatcagtcctaccaacctcctgtctcattctgtgactaagaatgcatgcctgccctcctgggaatgaagcac

SEQ ID NO: 30382 - DNA, 601 bp, Human
ataaatgagtcggttgctccctgaacctctgcagggacctgctcagtttgggcctcagtttgggcagggccagttgtatgactcatgaaggacaggactactttctttttgcaaatggctgattcaggatttaaacccaggtctgtctactgccagagcccatgcacatagtccttgaatctctttagaagaaaacaggaggaaaaaagtccccaagtcaccagccgcaaggtagataaatgagttgatagaggtaaaggaaggatgctggagtataatgattccatatcacagcctctgragccagattgctttgtcccaaatccagatctaccatttgtgaactgtgtgatcgtaagcaagtttcttaacctctctgtgcttcagtttcctcctctgtataatagggttagtatatctacattacagagttttgagcattaaatgagttaacatattctgactttagtgcctggacatatagtcagcacccagcaccaacaagtggtagccatgctctctatagctgtatgtcctgtcgctcaactaatgggtgaccgtgctggtttgggaacccagtactccacccagtgctctggga

SEQ ID NO: 30383 - DNA, 601 bp, Human
tgactcatgaaggacaggactactttctttttgcaaatggctgattcaggatttaaacccaggtctgtctactgccagagcccatgcacatagtccttgaatctctttagaagaaaacaggaggaaaaaagtccccaagtcaccagccgcaaggtagataaatgagttgatagaggtaaaggaaggatgctggagtataatgattccatatcacagcctctggagccagattgctttgtcccaaatccagatctaccatttgtgaactgtgtgatcgtaagcaagtttcttaacctctctrtgcttcagtttcctcctctgtataatagggttagtatatctacattacagagttttgagcattaaatgagttaacatattctgactttagtgcctggacatatagtcagcacccagcaccaacaagtggtagccatgctctctatagctgtatgtcctgtcgctcaactaatgggtgaccgtgctggtttgggaacccagtactccacccagtgctctgggacccctggcttatatcctgtctggactatggcactgggttggggggctgattgctacagcctgctttggtcagtactgt

SEQ ID NO: 30384 - DNA, 601 bp, Human
ctctctgtgcttcagtttcctcctctgtataatagggttagtatatctacattacagagttttgagcattaaatgagttaacatattctgactttagtgcctggacatatagtcagcacccagcaccaacaagtggtagccatgctctctatagctgtatgtcctgtcgctcaactaatgggtgaccgtgctggtttgggaacccagtactccacccagtgctctgggacccctggcttatatcctgtctggactatggcactgggttggggggctgattgctacagcctgctttggtcartactgtgccatcctaatgtggctaattgccttgggggtgtgcatttctttcagcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggtgccggggcagggcttggg

SEQ ID NO: 30385 - DNA, 601 bp, Human
acggtaaggacggactcctggctcatgccttcgccccaggcactggtgttgggggagactcccattttgatgacgatgagctatggaccttgggagaaggccaaggtgagaaaggggccctctgcatgccccagaccttctctcctgtcctctctccactccatttgcttggaccagagaggtgggaggggaggaaagtcacacatctgggtgagtcagaatcttggtctccaaagaaggcctggagaagtccaacctcccccttccatgtcactctttagtggtccgtgtgaagtatggsaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaaggtgagcatccactctagtccccaagactttccaccccaagcctccagcttcccgggctccccagtgtgctcttccctccacactctccaggactggctgccactgccagttaatgagcatccctccaacgtccttcactcagttcc

SEQ ID NO: 30386 - DNA, 601 bp, Human
ttagcaatcatttaggaagtcacagatttgatttgctaattatttatttctaatatatattggagtgaacttagaactattacaatgcccagtggttctctctagaaccagtctttacacttcaatcaagattgatacttcaagggcatgaggaaaggcttgctggtagctggaaacctagcagtgtgatagggaggcaggactcagaccagggctggactcaacctggtttgcgtactccaactgaggaatttcagctattgctcctgccttggtcctgatgctgcctctgctaatgcgtgtgtgtgtgtgtgtgtgtgtgcctgtgtgtgtgtgtgtgtgtgtgtgtgtgtgtgtgtgtgtgtgtctgggcacgggggctatactatctgcctctcttgggcactgtctttttctgcctcctgtctagcttgtgtctgcatctctgtgtcttgataaagactttaggcttgactcagtatttgtgtttgtgtgcttgtcagtgcctgagatgcaacatttcagagattttgaagccacatgggggaaatcttttaaaatggggtacagatattgacatacacactcaatcctttttaaa

SEQ ID NO: 30387 - DNA, 601 bp, Human
tgtgtgtgtgtgtgtgtgtgtgtgtctgggcacgggggctatactatctgcctctcttgggcactgtctttttctgcctcctgtctagcttgtgtctgcatctctgtgtcttgataaagactttaggcttgactcagtatttgtgtttgtgtgcttgtcagtgcctgagatgcaacatttcagagattttgaagccacatgggggaaatcttttaaaatggggtacagatattgacatacacactcaatcctttttaaaaatatccttgacacacttaatagtcataaatcacaaaaagayaatgtaacttcatactctatgaagtcatcatatttgataattctgcagattgaaagcccagaaaacctggcgaaaatggaaaaaagtctaaaaatttttaacactatcttctttcccatgtcacaaagactctatagtctacatagactaaagactgtctttttgtctgtaattttatgtctgtgaatctccctaaccccactgtaactgaaaactaagcaccaaccatcttgacagaatgaaagaaacaaagagctagttaattcccttcctgtttatgcttttactaccagagctaaa

SEQ ID NO: 30388 - DNA, 601 bp, Human
ggtgggcagccagccagccctgtgcccatggaagcatgtctcattcacatccttccctctctcccccacccttagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccggtgggtgccactccctctccctccctcagggcccagcacctgctgtctgacaaaaaaaaaacccataagactccgagtgcccacctcctttccccaagacaggggtgctaagacatctgtgcgaatgacatccacaccaagatgtccgtgtagctagtcaggatacttgtcacctggtatggcctgggcactgaaatcagaacagacattgggcatcaacagttgaattggtgacacttaaatgtcaggcctgctcaggatcctctgaccgacctgcatcccttttctctcaggctctctggcagagacttctctctcctcctctctgaccctgcaatctctcttccctgcc

SEQ ID NO: 30389 - DNA, 601 bp, Human
acctcctttccccaagacaggggtgctaagacatctgtgcgaatgacatccacaccaagatgtccgtgtagctagtcaggatacttgtcacctggtatggcctgggcactgaaatcagaacagacattgggcatcaacagttgaattggtgacacttaaatgtcaggcctgctcaggatcctctgaccgacctgcatcccttttctctcaggctctctggcagagacttctctctcctcctctctgaccctgcaatctctcttccctgcctttcctggtctgtatctccaccttttagtcygttttttattaagagctccgtgctttcctccctgtctccttcctgccctcctctctatccctccctcctttccttcttcccttcctccaacaggaatttactgagcgcctgctttgtgcagcatacacagaggttggtctctgcaaagccctgcccaagggggctcacagctgaggggcatgtgctggtgccatcagcttcatccaactccctttgcccctagcccatctgcccccttccatgggaggctcattagaactctggaatctggcttcctgggtttgaattgcagctctgata

SEQ ID NO: 30390 - DNA, 601 bp, Human
tctctatccctccctcctttccttcttcccttcctccaacaggaatttactgagcgcctgctttgtgcagcatacacagaggttggtctctgcaaagccctgcccaagggggctcacagctgaggggcatgtgctggtgccatcagcttcatccaactccctttgcccctagcccatctgcccccttccatgggaggctcattagaactctggaatctggcttcctgggtttgaattgcagctctgatacttcctagcagtgttggcttagggaaatttcatcatctctctgatctattttccatccatgaaacgcggtgctattcagtccctcctgcacaaggctgttgtcaggggtgggtgagatgagtctaaagatacagtgcctgggactgagtctaacttaggtgtggttcattaaggtcagcgtcatgtcattgcttcctggtggtagcctcagactctttgctgcgccttgacccgtatccctaaccccacagccatgtccactgttggtgggaactcagaaggtgccccctgtgtcttccccttcactttcctgggcaacaaatatgagagctgcaccagcgccggccgcagt

SEQ ID NO: 30391 - DNA, 601 bp, Human
aaggtcagcgtcatgtcattgcttcctggtggtagcctcagactctttgctgcgccttgacccgtatccctaaccccacagccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaaggtacgaggccctggtcattggacagagaccctggacattgcccttscccctaaacttgctccaaaaaccttcctgagacctcacccacttcaagcatagacactgccccccagacacccacctacccagacccgcccacctgggctgagacaatgcccatctctggtggagccaaggtccctgcttagatcctgcccatccaggtggaggcacagcctccaaaatcagaccctggtagaccagatgctgctactcacctcccgggtaagaactggccttcctgaggggtcactgctcttgtcttccccttcagccaccctccaggcgggcttgtgactaccaaaat

SEQ ID NO: 30392 - DNA, 601 bp, Human
acgatgacgaccgcaagtggggcttctgccctgaccaaggtacgaggccctggtcattggacagagaccctggacattgcccttgcccctaaacttgctccaaaaaccttcctgagacctcacccacttcaagcatagacactgccccccagacacccacctacccagacccgcccacctgggctgagacaatgcccatctctggtggagccaaggtccctgcttagatcctgcccatccaggtggaggcacagcctccaaaatcagaccctggtagaccagatgctgctactcacctccygggtaagaactggccttcctgaggggtcactgctcttgtcttccccttcagccaccctccaggcgggcttgtgactaccaaaattggctgaattctgagcacagattaccagagagacaattctcctaagagacattcccactgcacaaagaggtgccttcaaggagctggtaggcagtagaagaaaggaaaaaaggaagagcctcatgcttgatctgacaccatggtccacgcagccctgggggagcccccagagccctctctcccccatcagtcagcaccatctgttaccagggtgta

SEQ ID NO: 30393 - DNA, 601 bp, Human
gtagaagaaaggaaaaaaggaagagcctcatgcttgatctgacaccatggtccacgcagccctgggggagcccccagagccctctctcccccatcagtcagcaccatctgttaccagggtgtaaatggtgggtcctcgtcagtcctgggtgctgaggatggagctgactgggacagctctctgccccctaggactcacaagctcaggggagagagtgaccaggagacagcttgtgaccttactatgtgctcagtgcagtgagcagggtgcttggggccctgtgcccaatctaggctacagrgcccagggttgcagggttgcttaaagctccctgatggcccataatggccaggtcagtgggcaggtccagggcctgtcagaattaggcaagcctgtctttatgttgctttcattctttttaatcatcatgagatggaacttggcagatgtcagtggacagaggctggccaaaggaggttttcttatcccctgctaaattccttgctaggacacagtctgattttaccagcttaaaggtgggattctccaccttcctgagtggttcaagtatccagagctcagtggctcacccagggtgaat

SEQ ID NO: 30394 - DNA, 601 bp, Human
ttcattctttttaatcatcatgagatggaacttggcagatgtcagtggacagaggctggccaaaggaggttttcttatcccctgctaaattccttgctaggacacagtctgattttaccagcttaaaggtgggattctccaccttcctgagtggttcaagtatccagagctcagtggctcacccagggtgaatattatagtctcctggggctgccatgacaaagtgccacaaactgatggcttgaaacaaaccccatgtattctttcatgcttctggaggctggaagtctaaaatcacggygtcagtaaggccatgttccctctgaaggatgcgtcactccagtctatgcctctgtcatgacatggatggccttcttccccctctgcttgcctctcctccttttttttttttttgagacggagtcttgctcttgcccagctggagtgcagtggcatgatctcggctcactgcaacctctgcctcctgggttcaagtgattctcctgcctatttccaaataagttcacattcacaggtccctagggttaagacttgggcaaatcttttctggggggacgcatttaaccacaacagggtgtga

SEQ ID NO: 30395 - DNA, 601 bp, Human
ccagcttaaaggtgggattctccaccttcctgagtggttcaagtatccagagctcagtggctcacccagggtgaatattatagtctcctggggctgccatgacaaagtgccacaaactgatggcttgaaacaaaccccatgtattctttcatgcttctggaggctggaagtctaaaatcacggcgtcagtaaggccatgttccctctgaaggatgcgtcactccagtctatgcctctgtcatgacatggatggccttcttccccctctgcttgcctctcctccttttttttttttttgagrcggagtcttgctcttgcccagctggagtgcagtggcatgatctcggctcactgcaacctctgcctcctgggttcaagtgattctcctgcctatttccaaataagttcacattcacaggtccctagggttaagacttgggcaaatcttttctggggggacgcatttaaccacaacagggtgtgacacaggttttgctcgctggctgtggctcagcctgtgcaaccacgctaagtgtgaaaggtttttactgctttcacctgggcagaaatggtggcaacatggggccagcctatccccact

SEQ ID NO: 30396 - DNA, 601 bp, Human
cagcttaaaggtgggattctccaccttcctgagtggttcaagtatccagagctcagtggctcacccagggtgaatattatagtctcctggggctgccatgacaaagtgccacaaactgatggcttgaaacaaaccccatgtattctttcatgcttctggaggctggaagtctaaaatcacggcgtcagtaaggccatgttccctctgaaggatgcgtcactccagtctatgcctctgtcatgacatggatggccttcttccccctctgcttgcctctcctccttttttttttttttgagayggagtcttgctcttgcccagctggagtgcagtggcatgatctcggctcactgcaacctctgcctcctgggttcaagtgattctcctgcctatttccaaataagttcacattcacaggtccctagggttaagacttgggcaaatcttttctggggggacgcatttaaccacaacagggtgtgacacaggttttgctcgctggctgtggctcagcctgtgcaaccacgctaagtgtgaaaggtttttactgctttcacctgggcagaaatggtggcaacatggggccagcctatccccactc

SEQ ID NO: 30397 - DNA, 601 bp, Human
gaggctggaagtctaaaatcacggcgtcagtaaggccatgttccctctgaaggatgcgtcactccagtctatgcctctgtcatgacatggatggccttcttccccctctgcttgcctctcctccttttttttttttttgagacggagtcttgctcttgcccagctggagtgcagtggcatgatctcggctcactgcaacctctgcctcctgggttcaagtgattctcctgcctatttccaaataagttcacattcacaggtccctagggttaagacttgggcaaatcttttctggggggaygcatttaaccacaacagggtgtgacacaggttttgctcgctggctgtggctcagcctgtgcaaccacgctaagtgtgaaaggtttttactgctttcacctgggcagaaatggtggcaacatggggccagcctatccccactcttcttacctcttcagagaggctgaggagctgggtttgtagagctcatcttttatagagagacataaaaagccaggaagcaggattttaaaatgaatggggttttaagtagaaaattcgcagatactacttgttctgttcctttatagcacacctgtcc

SEQ ID NO: 30398 - DNA, 601 bp, Human
tggagtttagaatccaggagaatagccaagtacaggacagaattttccatcatgtggaatgaccttaacaatacgggggtggaagtttctagttttcataataagctttgatttttagtatgtagtagaaacagaacaaccagtgccttaagccaattatttatttatttatttatttatttatttatttatttatttattgttggttcttacagtgaggctagagtttaaaaagtcagttcatttttaaaaaatatttaatggtccaggtgatatctgagccaggccaaaatagtgaaartggtgcttgagtgatgaagtttggggactgctagactcaggaaaaagcccaaggtctgccgtgaggggtgctgggttcaaatgtggcctctgcccttcactagctgcaagatattgtgtaagtctttatacctctttggactcagtttcctcatctctaaaataattgcttatcatgaaaagtgccatactgtcagttctggacacaccagcggccccctgaccgccctgactcttgtgggcataagaatctgagctttgggtttgaatccttgggcaagtcactcaacttttctgggcc

SEQ ID NO: 30399 - DNA, 601 bp, Human
gtttaaaaagtcagttcatttttaaaaaatatttaatggtccaggtgatatctgagccaggccaaaatagtgaaaatggtgcttgagtgatgaagtttggggactgctagactcaggaaaaagcccaaggtctgccgtgaggggtgctgggttcaaatgtggcctctgcccttcactagctgcaagatattgtgtaagtctttatacctctttggactcagtttcctcatctctaaaataattgcttatcatgaaaagtgccatactgtcagttctggacacaccagcggccccctgacckccctgactcttgtgggcataagaatctgagctttgggtttgaatccttgggcaagtcactcaacttttctgggcctcagtttcctcacctgtgaaatggtgcaatcatgataccccactcccagggctatagagaggactgatttgggtgatgtcagtaaaaaacatatataaagtacaaagggccccaggactccccaagtccaggcatcttcttgttaccttacggagcttacactaaggccagaaggcgatttcttctgactcttagatggttgggtgggcacccctgggggctcac

SEQ ID NO: 30400 - DNA, 601 bp, Human
tctgcccttcactagctgcaagatattgtgtaagtctttatacctctttggactcagtttcctcatctctaaaataattgcttatcatgaaaagtgccatactgtcagttctggacacaccagcggccccctgaccgccctgactcttgtgggcataagaatctgagctttgggtttgaatccttgggcaagtcactcaacttttctgggcctcagtttcctcacctgtgaaatggtgcaatcatgataccccactcccagggctatagagaggactgatttgggtgatgtcagtaaaaarcatatataaagtacaaagggccccaggactccccaagtccaggcatcttcttgttaccttacggagcttacactaaggccagaaggcgatttcttctgactcttagatggttgggtgggcacccctgggggctcaccctagtggggagaacctctggagctgcagagagtctaaggtcaggtgttctccccaggggcctctcctgacattgaccttggcaccggccccacccccacgctgggccctgtcactcctgagatctgcaaacaggacattgtatttgatggcatcgctcagatc

SEQ ID NO: 30401 - DNA, 601 bp, Human
gggcataagaatctgagctttgggtttgaatccttgggcaagtcactcaacttttctgggcctcagtttcctcacctgtgaaatggtgcaatcatgataccccactcccagggctatagagaggactgatttgggtgatgtcagtaaaaaacatatataaagtacaaagggccccaggactccccaagtccaggcatcttcttgttaccttacggagcttacactaaggccagaaggcgatttcttctgactcttagatggttgggtgggcacccctgggggctcaccctagtggggagawcctctggagctgcagagagtctaaggtcaggtgttctccccaggggcctctcctgacattgaccttggcaccggccccacccccacgctgggccctgtcactcctgagatctgcaaacaggacattgtatttgatggcatcgctcagatccgtggtgagatcttcttcttcaaggaccggtgagtgcaggagcttgcttcttgtcctccttgtctcctgtcctctgctcttataccattattcttttccctcactcttcgctgaagactccaccaaatgcttcccagaatgacctgaatt

SEQ ID NO: 30402 - DNA, 601 bp, Human
gcaatcatgataccccactcccagggctatagagaggactgatttgggtgatgtcagtaaaaaacatatataaagtacaaagggccccaggactccccaagtccaggcatcttcttgttaccttacggagcttacactaaggccagaaggcgatttcttctgactcttagatggttgggtgggcacccctgggggctcaccctagtggggagaacctctggagctgcagagagtctaaggtcaggtgttctccccaggggcctctcctgacattgaccttggcaccggccccacccccacrctgggccctgtcactcctgagatctgcaaacaggacattgtatttgatggcatcgctcagatccgtggtgagatcttcttcttcaaggaccggtgagtgcaggagcttgcttcttgtcctccttgtctcctgtcctctgctcttataccattattcttttccctcactcttcgctgaagactccaccaaatgcttcccagaatgacctgaattaggcagtttctgctgtgtatcaaacaacctccaggtttcagtggatttgcacccaagcattttgtttgctctctcatagtctgtggg

SEQ ID NO: 30403 - DNA, 601 bp, Human
cccctgggggctcaccctagtggggagaacctctggagctgcagagagtctaaggtcaggtgttctccccaggggcctctcctgacattgaccttggcaccggccccacccccacgctgggccctgtcactcctgagatctgcaaacaggacattgtatttgatggcatcgctcagatccgtggtgagatcttcttcttcaaggaccggtgagtgcaggagcttgcttcttgtcctccttgtctcctgtcctctgctcttataccattattcttttccctcactcttcgctgaagactccrccaaatgcttcccagaatgacctgaattaggcagtttctgctgtgtatcaaacaacctccaggtttcagtggatttgcacccaagcattttgtttgctctctcatagtctgtgggtctactagttatcttgactttcagctacagtttgggttcaggtgtgctctgcctgttgttctcatgggattagcagctactcatggcagatgacagggtgcaagaggccaaactgaactacacaagctcatttaaagcctccactcacatcttgtctgagaatattccactgcctgaaataagtc

SEQ ID NO: 30404 - DNA, 601 bp, Human
tgtcactcctgagatctgcaaacaggacattgtatttgatggcatcgctcagatccgtggtgagatcttcttcttcaaggaccggtgagtgcaggagcttgcttcttgtcctccttgtctcctgtcctctgctcttataccattattcttttccctcactcttcgctgaagactccaccaaatgcttcccagaatgacctgaattaggcagtttctgctgtgtatcaaacaacctccaggtttcagtggatttgcacccaagcattttgtttgctctctcatagtctgtgggtctactagytatcttgactttcagctacagtttgggttcaggtgtgctctgcctgttgttctcatgggattagcagctactcatggcagatgacagggtgcaagaggccaaactgaactacacaagctcatttaaagcctccactcacatcttgtctgagaatattccactgcctgaaataagtcacatggccaatcccaagacctaccctagagggtagtactgcaaagtcacatggaaatgcatatgaatgcataatcctaaaatcgaaatggagggaagaattgggaaccataattcagtctacca

SEQ ID NO: 30405 - DNA, 601 bp, Human
tggagggaagaattgggaaccataattcagtctaccacaggccttctagaatggcgttgccctcaaatggccaaattactctgtgtatgggtggtgagtgactgcagagtagaaagaggtggtattcttcatgctatagataaagatcaccactcagttgactaaagactgaggtttaccctaatgccctagttccctggagaatggcaggcagtatctaggacctcattaaagggtctgtccttccattcttctatcatccatccatctacccatccatccatccatacctatatctttycatccatcatccatccatccagccagccatctattatccattatttatgatccagccatccattattcattattcatccatttattcattcatagagtatagtagttgagaaaatggactctgaagccagattctctgggttagaattctgtaactgctacttactggttatataatcatagacaagttaattaagtatcttctttgtaccttggtttcctcatttataaaatggggctaatattccaacctatctcctagggctgttgtaaggattagatgaacttagtgctgagaaca

SEQ ID NO: 30406 - DNA, 601 bp, Human
accataattcagtctaccacaggccttctagaatggcgttgccctcaaatggccaaattactctgtgtatgggtggtgagtgactgcagagtagaaagaggtggtattcttcatgctatagataaagatcaccactcagttgactaaagactgaggtttaccctaatgccctagttccctggagaatggcaggcagtatctaggacctcattaaagggtctgtccttccattcttctatcatccatccatctacccatccatccatccatacctatatctttccatccatcatccatccakccagccagccatctattatccattatttatgatccagccatccattattcattattcatccatttattcattcatagagtatagtagttgagaaaatggactctgaagccagattctctgggttagaattctgtaactgctacttactggttatataatcatagacaagttaattaagtatcttctttgtaccttggtttcctcatttataaaatggggctaatattccaacctatctcctagggctgttgtaaggattagatgaacttagtgctgagaacaaaaacaatgcctgacaca

SEQ ID NO: 30407 - DNA, 601 bp, Human
aaatactttgctaggctttagtagctggaggaggaagaatgatgttctcgggacagtggggtggggggctgctagatcagtgttctcaaagacaggcgcatgggcctcctataacagaaccatctagagtgtgggtattaaaaggtgggttttctgccccagcttcagaccctcctgactggaactctggggctaggccccaggaatctgcgttttagcaaattctcccagtgattctgatgcacattaaagtttgtgcatcacaagtccagtttgagaaataggcatggagaactgacayggcaagatgaaagaaaagtgatcgcagaggtgttaggtgcttttgtgagcacgtcccagtcaaggaaggcttcacagatgcagcagcatttgagcagagccttcaaaggagaagcaagaatctgatgggggtgacaagttaggaggttctttgagacagagggacctgcagagccaagccatagtgatgtgaaagtttctggattagccagtgagaatctggtgaggctagaagatgttccataaactttcaggaagagtttcctctactctaggcactgggccaaattctggggtgcag

SEQ ID NO: 30408 - DNA, 601 bp, Human
ctgctctgcagttcccattgtaaggatctggcaatgtgcttcatctggagctcctcccactaagaaagccctgaccacacatgcagatctcagatgtgtggggcctaggaaaggatgcagagcccagacccaggctggagccatccctggcctaccacatcacagttttctttcaaaaggaacgtgatgagtgtttaatgggtttatttgattaaccagtaaatattaaacttcaaccatgagcaaaaattgctgctaggcactggtgagggtgggggtcatgaaggacagtattgcaggrtgattaaactcagactttggagtcagatctggatatgaatcttggtaataactaatttatttagtcattgatgtagtgataactaagtaatttgaatcctaacctctctgagcttcatttgctaaataaaaattgtgacaccttcctacgctaggatgtttttctgcaaataacagagaccatccctctgcaaactcaatccagcctaaacagtagagagaaattgctttcatttggtacaaagtccaggggtagagctgcctgcaggggcagagagagggtcagtgacttgatgtcttt

SEQ ID NO: 30409 - DNA, 601 bp, Human
agcgagagagaaagagacacgcacagatacacacacacagacccccagatgtgaaatacaagtctgtgtgttccgtctttacaccactgtaagtcatatggcaactgctgaatcagtaacagtgctagggaatgctaaactctgattggcttagaccagtagttctcaaaccttggcatgcgttagaatcatctggaaggcttgttaaaacacagattctgggccccaagcccagagattcttatctgtagatctctgtaaggacccaatcatttgcatttctaatgagttctcaggtgaygcagatgctgctggtcaggagactgcactttgagaaccagtggcttataccaatcagtatctacccctagaatgggggtaggggacacagggtcagaggaggtgaaggctggatcataaatgtggagttttgtgaagaaggatggtggggaaatagataattaatgctaggtagaccatccagagtgcatgctgtcttaaaagattgtggggattaaattacaaggcacataaataaagcacatggcatttagtaggaccctcaataaatgataactcttactcttgacaaagtacacaa

SEQ ID NO: 30410 - DNA, 601 bp, Human
cgttagaatcatctggaaggcttgttaaaacacagattctgggccccaagcccagagattcttatctgtagatctctgtaaggacccaatcatttgcatttctaatgagttctcaggtgacgcagatgctgctggtcaggagactgcactttgagaaccagtggcttataccaatcagtatctacccctagaatgggggtaggggacacagggtcagaggaggtgaaggctggatcataaatgtggagttttgtgaagaaggatggtggggaaatagataattaatgctaggtagaccatycagagtgcatgctgtcttaaaagattgtggggattaaattacaaggcacataaataaagcacatggcatttagtaggaccctcaataaatgataactcttactcttgacaaagtacacaaattcatttcattttaattcaggaaatacttgagtgtcatcagctcctgccccaattggcctctaatcaaataggagagttaagacaaacagacactactgttccaggcactcagagttgatgattttgagaggcttagagagggaaaacacaatatggatggaggtagtcagggaaggct

SEQ ID NO: 30411 - DNA, 601 bp, Human
gaggcagttagttataatagtgtggagtttcaaatcaggacagaaacggattattcagtaactgatattttgacagtcaaaaaacattttttaataaatttatttttaaagatttcaaaatgaattcactgaaagcagaatgttaagtaaataatagtacagggagcccctagaagtggtagaaatcatcaaggtgaggtctgtatggctaaggtttactcatttaacatttattggagcatttccatgcgctgggctttgccataccctggggatacaagctctgccttcgcgatgctcrcaaaccactcagggagacagacagctgggctcttatgaggggtaaagaaggatttaggaggtccctgtcctggtctgaggtgggatcctagagaagataaaggctcagccaagactgttgtctccaccacctggctcccacctcccccaatccaccgtaatcatgggtcccggagaggacaactgctggctcctagggcacctttttgcaaattagcaaaaggtgcctctttatgacagcaaggcccttagagtgcacgacttggtgagcagagtgtgagctggatttatcccccaactc

SEQ ID NO: 30412 - DNA, 601 bp, Human
ttcagtaactgatattttgacagtcaaaaaacattttttaataaatttatttttaaagatttcaaaatgaattcactgaaagcagaatgttaagtaaataatagtacagggagcccctagaagtggtagaaatcatcaaggtgaggtctgtatggctaaggtttactcatttaacatttattggagcatttccatgcgctgggctttgccataccctggggatacaagctctgccttcgcgatgctcacaaaccactcagggagacagacagctgggctcttatgaggggtaaagaaggayttaggaggtccctgtcctggtctgaggtgggatcctagagaagataaaggctcagccaagactgttgtctccaccacctggctcccacctcccccaatccaccgtaatcatgggtcccggagaggacaactgctggctcctagggcacctttttgcaaattagcaaaaggtgcctctttatgacagcaaggcccttagagtgcacgacttggtgagcagagtgtgagctggatttatcccccaactcatgtccttgaccaggcaccttctgtaattgacttctaaagccctctgtgtgag

SEQ ID NO: 30413 - DNA, 601 bp, Human
aaatgaattcactgaaagcagaatgttaagtaaataatagtacagggagcccctagaagtggtagaaatcatcaaggtgaggtctgtatggctaaggtttactcatttaacatttattggagcatttccatgcgctgggctttgccataccctggggatacaagctctgccttcgcgatgctcacaaaccactcagggagacagacagctgggctcttatgaggggtaaagaaggatttaggaggtccctgtcctggtctgaggtgggatcctagagaagataaaggctcagccaagactrttgtctccaccacctggctcccacctcccccaatccaccgtaatcatgggtcccggagaggacaactgctggctcctagggcacctttttgcaaattagcaaaaggtgcctctttatgacagcaaggcccttagagtgcacgacttggtgagcagagtgtgagctggatttatcccccaactcatgtccttgaccaggcaccttctgtaattgacttctaaagccctctgtgtgagccctgattctgggcactgcaaccaggagtgagcaggaagttgcactctgttgggaatggctgca

SEQ ID NO: 30414 - DNA, 601 bp, Human
ccacctggctcccacctcccccaatccaccgtaatcatgggtcccggagaggacaactgctggctcctagggcacctttttgcaaattagcaaaaggtgcctctttatgacagcaaggcccttagagtgcacgacttggtgagcagagtgtgagctggatttatcccccaactcatgtccttgaccaggcaccttctgtaattgacttctaaagccctctgtgtgagccctgattctgggcactgcaaccaggagtgagcaggaagttgcactctgttgggaatggctgcagtggggcccrtggacagacagatgatgggaggaacaggctggcctagggcatgtcagcaccagccaacacaccctttgcttccaccccagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggaggtaagggagggcggtgggtaggacagcagcacagttggctgcgagagacagagaagccgc

SEQ ID NO: 30415 - DNA, 601 bp, Human
ggcatgtcagcaccagccaacacaccctttgcttccaccccagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggaggtaagggagggcggtgggtaggacagcagcacagttggctgcgagagacagagaagccgccctgaggcttcaagcctcctgggctgagttcagaggtyggtgggctctggatgccctctctctggtatctaacctctttggtctctggcacctctgagatgttgccaaaggtgaaccattcttgtacacattgctgatataattctggtggaatatcctttctctttgcagaattcttttgattggcccatgtctggtctggaccctcacattttgaaatgactcactgaagaagggggtaataaaaataaagataataactgctcctattgacactatgtgtcagagactgtcccaagggttctatgggataggaattattattcctcccattttac

SEQ ID NO: 30416 - DNA, 601 bp, Human
tagggagactgaggcaggggaatcacttaaacctggaagacagaagttgcagtgagctgagatcatgccactgcactccagcctgggcaacagagtgagactccaactcaaaaaaaaaaaaaaaagaaaaaagaaaggttaagtaaccagcttggagtcacatagccaggtagggacaggttgggatttgaaccctggcattctgtctcctgggaaaacatgttagtcttcactcttcactactattctatacccgagatggtggaatgggggttccaagagatgggggaacatgaaggcrgtggacaaaatatgaagaagacttagagatgggtgcaccagtcatccatagaagccagcatccaaatcagaccccatggaaggagcaggtgccctgtgtcatgctcacagcaggcccgtggctgtgggtgcaggttggcaggggaacaatttggaagcagatggttctgtgctccaggttatctacaggaaagggtccagttctgaggggctatagtcatgaccagggaacctaatatccaggagtggctggtgagaggtagcccaaacctcaggagtttgactgtaattcttcacactt

SEQ ID NO: 30417 - DNA, 601 bp, Human
aagaagacttagagatgggtgcaccagtcatccatagaagccagcatccaaatcagaccccatggaaggagcaggtgccctgtgtcatgctcacagcaggcccgtggctgtgggtgcaggttggcaggggaacaatttggaagcagatggttctgtgctccaggttatctacaggaaagggtccagttctgaggggctatagtcatgaccagggaacctaatatccaggagtggctggtgagaggtagcccaaacctcaggagtttgactgtaattcttcacactttctagaaaaggaaamggaggtccaaagaaattaaataacttgttcaagctatagagatatgtgtatttgcacaaagccaggattatagctacttctcttgtattctaactgagtaccccctccactatacctgccagtccatttgattagtgaggaaagagtggtcggggcacaaagacttgtggtgtgtctttccatcccctccctcctggtatccccacattccttccatggctgccactgcatctgggccctacccaagaattttagagggcacttcctgaggcctttgtctgccatccccaaaacaatccc

SEQ ID NO: 30418 - DNA, 601 bp, Human
cctgaggcctttgtctgccatccccaaaacaatcccgcttacttcctaaggcctctgtcttctcccccttccctcctccccactactctgccccccagctgccctgcattcagaaactctttatatcccaggcctgcccatgtcagggtggaattccagacatattgctaagacacttagcaacctaagctgattgatatctcaagcctcaagaaagaaaacagtcaggcaggaaaccacagagcaggctttccacccaccagctccagacactagccccagacagtgtgcacgcacacgaacacacacacacgcgtactgcgaatggcatctcagcattgtaggagccctgaatctccaagtcttagaattgtggctggtgagccacacagactcacagaaacgtgaatcttagaatcctaaagccctgaagttttcaaattatggtgttggaagaactttttaaatcacttttccatgcactgtatctatgtaaacatgcaaaaacagacctgttcctagcatataggaacatgattgtgtgcgcatgtgcgcatacacacacacacacacacacacacacacacacacacacaggcat

SEQ ID NO: 30419 - DNA, 601 bp, Human
tctgccccccagctgccctgcattcagaaactctttatatcccaggcctgcccatgtcagggtggaattccagacatattgctaagacacttagcaacctaagctgattgatatctcaagcctcaagaaagaaaacagtcaggcaggaaaccacagagcaggctttccacccaccagctccagacactagccccagacagtgtgcacgcacacgcacacacacacacgcgtactgcgaatggcatctcagcattgtaggagccctgaatctccaagtcttagaattgtggctggtgagccrcacagactcacagaaacgtgaatcttagaatcctaaagccctgaagttttcaaattatggtgttggaagaactttttaaatcacttttccatgcactgtatctatgtaaacatgcaaaaacagacctgttcctagcatataggaacatgattgtgtgcgcatgtgcgcatacacacacacacacacacacacacacacacacacacacaggcatggaggttgtggcagtgccttgctggatttccaggcagagttatttgcctcccagtccttttccacacaagcccacctcccaaagcc

SEQ ID NO: 30420 - DNA, 601 bp, Human
gtgctttataaatgttagcagtaatcatgagattgtttttatggggtcatccaaagtcatataattaaaagtggtagatctgaggctcagactcaggtctgattccatgcccttccttccactgcagctggctgcttccctgaagggctaggtccagtttccgaggcctatccaggagccatcagctgggtgctcccatccaggccaggggggaagtgtcctttagagaggccctgctggttcactgtgtctgtttctttacagatacaatgaggtgaagaagaaaatggatcctggcttycccaagctcatcgcagatgcctggaatgccatccccgataacctggatgccgtcgtggacctgcagggcggcggtgagccacccaggactgtctccgctttctaggactccccgcccctagccagggcccagctccttgcaaatacacacttctttattgtgcagggcaggcaggcaggcggcgcccaggaaaacaaatcaactccttcatcctagtgctgggaaggtttccagatccctgacctctgctccttggcctggctccaggcagtaagacccagaaagacttctcacagctgc

SEQ ID NO: 30421 - DNA, 601 bp, Human
tttgttgtgttttggttttgtttttgttttcttttcttcaatcagctcagattgaaacaattgaatttttttttttttttttttgagacagagtctccctctgtcgcccaggctggagtgcagtggcgcgatcttggctcactgcaagctccgcctactgggttcacaccattctcctgcctcagcctcccgagtagctgggactacaggcgcctaccaccacgcccggctaattttttgtatttttagtagagacgaggtttcaccatgttagccaggatggtcttgatctcctgacttsgtgatctgcccgtctcggcctcccaaagtgctgggattacaggcgtgagccaccgcgccccgccacagttgagtttttttttggcggggggacaaggtcttgctctatcacccaggctagaggcacaatcatagctcactgcagcctcgaactcctgggcttaagcgaccctcccacgtcagcctcctaagtagcttggactacaggaatgtaccactatacccagctaatttaaatatgtttttcgtagaaatgggggtctctctatgctgcccaagctggtctcgaactcctgggctc

SEQ ID NO: 30422 - DNA, 601 bp, Human
ttttttttttgagacagagtctccctctgtcgcccaggctggagtgcagtggcgcgatcttggctcactgcaagctccgcctactgggttcacaccattctcctgcctcagcctcccgagtagctgggactacaggcgcctaccaccacgcccggctaattttttgtatttttagtagagacgaggtttcaccatgttagccaggatggtcttgatctcctgacttcgtgatctgcccgtctcggcctcccaaagtgctgggattacaggcgtgagccaccgcgccccgccacagttgagtttttttttggcggggggacaaggtcttgctctatcacccaggctagaggcacaatcatagctcactgcagcctcgaactcctgggcttaagcgaccctcccacgtcagcctcctaagtagcttggactacaggaatgtaccactatacccagctaatttaaatatgtttttcgtagaaatgggggtctctctatgctgcccaagctggtctcgaactcctgggctcaagcaatcctcctgcctcagcctttcaaagctctcttctcgtttaaaagcttcttccctatgccaggcagaaat

SEQ ID NO: 30423 - DNA, 601 bp, Human
tgcctcagcctcccgagtagctgggactacaggcgcctaccaccacgcccggctaattttttgtatttttagtagagacgaggtttcaccatgttagccaggatggtcttgatctcctgacttcgtgatctgcccgtctcggcctcccaaagtgctgggattacaggcgtgagccaccgcgccccgccacagttgagtttttttttggcggggggacaaggtcttgctctatcacccaggctagaggcacaatcatagctcactgcagcctcgaactcctgggcttaagcgaccctcccaygtcagcctcctaagtagcttggactacaggaatgtaccactatacccagctaatttaaatatgtttttcgtagaaatgggggtctctctatgctgcccaagctggtctcgaactcctgggctcaagcaatcctcctgcctcagcctttcaaagctctcttctcgtttaaaagcttcttccctatgccaggcagaaattcaaagttcccaggaagcttctgtgtgccagaatgtcaggataagggggtcacggtctcttctttctctatcccaggtcacagctacttcttcaagggtgcct

SEQ ID NO: 30424 - DNA, 601 bp, Human
gacaaggtcttgctctatcacccaggctagaggcacaatcatagctcactgcagcctcgaactcctgggcttaagcgaccctcccacgtcagcctcctaagtagcttggactacaggaatgtaccactatacccagctaatttaaatatgtttttcgtagaaatgggggtctctctatgctgcccaagctggtctcgaactcctgggctcaagcaatcctcctgcctcagcctttcaaagctctcttctcgtttaaaagcttcttccctatgccaggcagaaattcaaagttcccaggaascttctgtgtgccagaatgtcaggataagggggtcacggtctcttctttctctatcccaggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctg

SEQ ID NO: 30425 - DNA, 601 bp, Human
tgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatmctttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttaga

SEQ ID NO: 30426 - DNA, 601 bp, Human
ttgatgtcatcatgagtgtgttggtgacactggagggaaatgatgtggtcatttcatctggaggagctgtctcctgcgtaacagtctccatcacattgtgtacacttggggaagaaaaaagagttgatgtcatcatctgcgtgagggtgtcggtttgagctttgctggtggtctccgtgctcttagtctggtggttctgagatgaagctgatatgtcctgattagaggtccttgaagaagctgcagttgattgtccctctagtgtcgctgttgttgagcctgttgaggtgactggggcagsagttttacttccagttattaatgtgtcctctgtggttcctggagtgaaccaaaataggcaagcagagagctaaatcatgaatgaactcctattcacaattgctacaaatagaataaaatacctaggaatacagctaacaaaggatgtgaaaactaccattcttcacagaatgagaacaaactactttaaaattcatatggaatcaaaaaagaacccaaatagccaagacaatcctaagcaaaaagaacaaagtgggaggctacctgacttcaaactatactacaaggctacagtaaccaa

SEQ ID NO: 30427 - DNA, 601 bp, Human
ttatcatctgagtcacactgtagcttgggctgctgagaagagcctctccagtggtccccgtttcttgtgtccattgtgtctgggcgcctgcccctgttgtttttgggagagttgtgctgtgggaggagtatgtggtgggctctcctggttcccctattgctgagaccttagaggggacccttggaatagtgccagctgcccctgtagatggatttcctgtgacaagcctagtggcagcacctgttgatgttgagggcagttctgtttgtgaccaagttgtgtggcctttgctggagaatgrggaaggccatgttgttgtttcatgtagagtaaatatttcttgagacacacctggagagaatgagctcctctcatgaggccgtcctgtggtctctgcaccttcactctgctgggtgtggaaagctgtggatatttttggaggtagagaactgggggagagtgctgttgacagagtgtctgaccaccatatggttgaaactttggaagtgattgcagaaatggttccacttacagatagtgatgtctcctctgtgtttccaagagtagagtctctggagattggcattctgaacacctttga

SEQ ID NO: 30428 - DNA, 601 bp, Human
ctgggttgtgtgaccatccccggtgggagctggggcaaaggttgttgctgcacttatggtgggtgcgtcctgaggaacaatttctgagggcgagtgcccactggctgtgaaggaagaacctggggtggtgactgtcttggtgtcagtcatgggggagacggacctcgtggtttgtgattcttgtgtggtctgcggggcttgagtgtgacccctttgggaaacagctggtgattcctgaggagaggtgcttgtggaatgtattgttgaatgatttgttgatggtgccgttgtaatttgttgkgatgtgtgtctatccagcataggtgaagaagatggggatgtggccgtttttatcatctgagtcacactgtagcttgggctgctgagaagagcctctccagtggtccccgtttcttgtgtccattgtgtctgggcgcctgcccctgttgtttttgggagagttgtgctgtgggaggagtatgtggtgggctctcctggttcccctattgctgagaccttagaggggacccttggaatagtgccagctgcccctgtagatggatttcctgtgacaagcctagtggcagcacctgttgatgtt

SEQ ID NO: 30429 - DNA, 601 bp, Human
tcgctcagcaggtgtggacaccctctctctatcgctcagcaggtgtggacaccctctcgccatcgctcagcaggtgtggacaccctctctctatcgctcagcaggtgtggacaccctctcgccatcgctcagcaggtgtggacaccctctctctatcgctcagcaggtgtggacaccctctccatcgctcagtcgccctctcatgctgtgttcggactcagcctcctccctcagggccacaggagccaggactgtccctccaactctgctccaggaggcagggaccagggggccagagacraatcccagaaggtggaaacggcaggaacagtccagtttcccaagtgtagctttttactcctgagaaggccccgcagaagcagcggtgggcccagcaggtgggcagccctcgcctggcaccctgtgttcctcaggcagaggcctgacattaaggaggctgtggggatggacgaggggcccagccaaggctgcttccattcccgcttcctctgggttccgtctcgaagcaggagagagaagtgggccctgggagttcaggctgcgcgggccgcagcccggactcacgtagagggaatcacgg

SEQ ID NO: 30430 - DNA, 601 bp, Human
tccatcgctcaggggtgcagacaccccatctccatcacttagggggtggaaacctctctctatcactcagcaggtgtagacaccctctctccatcgctcaggggtgcagacaccccatctccatcacttagggggtggaaacctctctctatcgctcagcaggtgtaggcacccccctccatcgctcaggggtgtagacaccctctctccatcactcaggggtgcagacaccccatctccatcacttagggggtggaaacctctctctcactcagcaggtgtggacaccctctctccatcrctcagcaggtgtggacactctctctctatcactcagcaggtgtggacaccctctctccatcgctcagcaggtgtggacaccctctctctatcgctcagcaggtgtggacaccctctcgccatcgctcagcaggtgtggacaccctctctctatcgctcagcaggtgtggacaccctctcgccatcgctcagcaggtgtggacaccctctctctatcgctcagcaggtgtggacaccctctccatcgctcagtcgccctctcatgctgtgttcggactcagcctcctccctcagggccaca

SEQ ID NO: 30431 - DNA, 601 bp, Human
cctccatcgctcagtgggtggagccctccctccgtcgctcaggggtgtagacaccctctctccatcgctcaggggtgcagacaccccatctccatcacttagggggtggaaccctctatctattgctcagcaggtgtagacaccctctctccatcgctcaggggtgtagacaccctcccttcatcgctcaggggtgtagacaccctcccttcatcgctcaggggtgtagacaccctccctccatcgctcaggggtgtagacaccctctctccatcgctcaggggtgtagacaccctccctycatcgctcaggggtgtagacaccctcccttcatcgctcaggggtgtagacaccctctctccaccgctcaggggtgtagacaccctctctccatcgctcaggggtgcagacaccccatctccatcacttagggggtggaaacctctctctatcactcagcaggtgtggacaccctctctccatccctcaggggtgtagacaccctcccttcatcgctcaggggtgtagacatcctctctccatcgctcaggggtgtagacaccccctctccatcgctcaggggtgtagacaccccctctcc

SEQ ID NO: 30432 - DNA, 601 bp, Human
acattaggtggggctcagggagtggaaccctctatccatcgctcagggggtggagccctccctccatcgctcagtgggtggagccctccctccgtcgctcaggggtgtagacaccctctctccatcgctcaggggtgcagacaccccatctccatcacttagggggtggaaccctctatctattgctcagcaggtgtagacaccctctctccatcgctcaggggtgtagacaccctcccttcatcgctcaggggtgtagacaccctcccttcatcgctcaggggtgtagacaccctccctycatcgctcaggggtgtagacaccctctctccatcgctcaggggtgtagacaccctcccttcatcgctcaggggtgtagacaccctcccttcatcgctcaggggtgtagacaccctctctccaccgctcaggggtgtagacaccctctctccatcgctcaggggtgcagacaccccatctccatcacttagggggtggaaacctctctctatcactcagcaggtgtggacaccctctctccatccctcaggggtgtagacaccctcccttcatcgctcaggggtgtagacatcctctctcc

SEQ ID NO: 30433 - DNA, 601 bp, Human
cagccttggtccagctcctcaaaagcgtgacccccaagggtagagctttagagatgctaacaacccctggaagtcacctcctgtgtcctgttttggggagagccctttccatataatctcacagaatgctccgccctcaggccatcccttgcgtcctcgggtggtaggcttggtcctgtttcactgcagatccctggccgtggaccagcccctcacaggcacacccctcttggccagtcccctgggccccatcctgaagtttgcgacacattaggtggggctcagggagtggaaccctctmtccatcgctcagggggtggagccctccctccatcgctcagtgggtggagccctccctccgtcgctcaggggtgtagacaccctctctccatcgctcaggggtgcagacaccccatctccatcacttagggggtggaaccctctatctattgctcagcaggtgtagacaccctctctccatcgctcaggggtgtagacaccctcccttcatcgctcaggggtgtagacaccctcccttcatcgctcaggggtgtagacaccctccctccatcgctcaggggtgtagacaccctctctccat

SEQ ID NO: 30434 - DNA, 601 bp, Human
catggatgacactggggttcactgaaggcgcacacgttgtccacagtaggtgaccagtgaacttttgtcgagtgaatgaagaaatgagtgactttagaccaggcataaggaagaacttggtgactacaagagcggggtcctcggagggaggacagaggagatggtgtggcgcaccctgtgcccgttggatgagcctgtgcttcagagccagaggctggagtcagaagaagctccactcaggcctggctttgccatttgccagcggcgtgactctgaacgagttacttaacctctctaaccrttgtcttcctcatctgtaaaatggggagcataataccagactgagccacgtgaaattgcgaatagccagacatttttgacttacaaaaatgccacttgctatgtttcagcctaataatacccggtttgctgggctgctgtgaggtcaagtaggcaaagggccgagacaggccgggcccacggtgagtgctcagccaacagtggtggcagtgggggggtggcggtgggggggcttgctataattagcaatctttcctagagccagagaggattttggaagagtggcccctgcctaggattc

SEQ ID NO: 30435 - DNA, 601 bp, Human
gcgaaagccgactctacacccctccctgccaactgctcagtgctgacagcccctcccatcctacctagagaagcccatgagcaccggcttgcctgagcgctgggccacgtcccactgcatcccaccgctctggtagagaaacagggcataggacctgctcccgtccgtggagaggatggcttggtaggtgttgctctgggggtgggtggaagaaaacacagggatgcccgtgagagatccggggtctcctctcttatgtccccccgcccgtcccacagccctgctctgacacgcacagcayctgttcctggtctgcccacagcaaagacatgggcccaaaatgctggcaagttttgggtcagtgagggcagctttcaccctgggtgcgaacgcacttaccacggtggatttgccttttggtgactttcttccaggaggggagataaagggttctgggttacaattcagttagatgagtgtttgttagagaaagctaccagaacctgagatcagccaagataccagagagctagagaggaggcttcattagctcccgcgcggatatttaaggacattgcccaaattgtctcctccatctaaa

SEQ ID NO: 30436 - DNA, 601 bp, Human
cagggtggtgttggttgagagcttggcagggcagggcggtgttggtggagagcttggcagggcagggcggtgttggtggagagcttggtagggcagggcggtgttggtggcaagagcatggctttggaatccagcatggcccttctcatgaccttgggcagtgaatagggtgctgtctcttttgcaggcattggggccactgtgcagcagggcgcatggtaggagctaagcaaatttcctgtcttgagggtggagagccaagtactgctgctctcaacgtgctgggagtggggagggcacrgctgacggtctgggaactgtggaaactgccatgggacgggggagagaacgggaggacacagaccacgtgaccccacacccctgcgctctccagctcccttggagcgtctctgtgggagctgactctcagtcttcccccaaacatcctgctcatctgggtctacagggacggggtcagcctaggcgctctcttcttgcctggagaaatggccccactctggcctggggatgtggagccaggtatagagatgaggaaagaggctctcagctcatacatccccgaatgtccgctggtggggat

SEQ ID NO: 30437 - DNA, 601 bp, Human
gtcgactggggcacttgtccgggcggactcagctggggagatgttcacagagcacagaatcctcccctcaagcctccttgcattttcgtgccccgctattctcactccttccccaactcaggtacaaagcccctccactgaccatccacccatcactggcgtcatctccatcttcccttgtggccacagctctgcccctactccttaaccacctcccggaagcccagaagctccccctccccagaggctcttcctgggcctgggccctgtcgctcaccgggctgtgggggcctgtatgtarcacagcccacgtggggccgcctctgctggtacagggcacagaggtagggcttgtcattccagcggcagcaccagctctgtggctccagttcctgggctgcggagaacagcagtgagtcggggaggttgaggacctggagaagcttggcagggcagggtggtgttggttgagagcttggcagggcagggcggtgttggtggagagcttggcagggcagggcggtgttggtggagagcttggtagggcagggcggtgttggtggcaagagcatggctttggaatccagcatggcccttctca

SEQ ID NO: 30438 - DNA, 601 bp, Human
agggccaggcatggttttcggattatgccctttagctcttacaacagcccgtgaggcaggtaatgtcatccccattcttactaggagaaaaccaaattaagtagtttcttcgaagccaagcagctgggaaaccgtggggccagagccctaatccaccatccccaggatttactccgggacagctgcgtggatgggctgtgtcctccctccctcctgcccggcttcccctccttcgctctcttccttctcctcggcctcagtatgtggctgaaggtccctgtgggtggaatgcagggaggtycccggcacccctcactcaccgtgacggggcccaggctgctggagcggtactgagccgcaaaggcgatgaagttggtggcctgggctgagccagtctgggcggtgcggccctgaagcaggaaggaggagttcccgtcttgggccccgaccagcaggaagtcccccagcccattgaaggtgtaactgacaccatccaaggtggtgatgtgggggtccccgaacatccaggctggaaggaaaaaagagatgctgcctcagcatgacaaatcatgtgtagggctgaggttcctcactgcagtca

SEQ ID NO: 30439 - DNA, 601 bp, Human
attataaaatatgttgagtaattataaatgctaaggagaaaaaaataaagcagggaaggcaaacatgaagtgtgggcgaatgtgacattttagacagggcggccaagagaggcctcaccaaggaggggacattggaatgaagacgtaaaggaggtgaggggcaagcgtgtggctgtccagggaaggaagggtattccaggcaagagaacagcacgtgtgaagcctgggagctgagcgcacctagcgtgtttgaagaacacagaggagcctgcggggctggagtgcagggagctgggaaggsgtccagcgctaggatggagtggagggggctgggaaggcatccagcgctaggatggatggagggggctgggaaggggtccagcgctaggatggagtggagggggctgggaaggcgtccagcgctagtatggagtgaagggggctgggaaggcatccagcgctaggatggacggagggggctgggaaggcgtccagcactaggagaagagctctgagaagctgaactgggccgaaggccactgcaaggatggagagagccagggaagtctctgaagggtttgagcagaggaatgccaggagt

SEQ ID NO: 30440 - DNA, 601 bp, Human
tctcggagccctgccatttccatttcatagttgcttcacacattcattcagtcagtcatttaacaaacatttattgagctaagtggctggcactgttctgggtggtgaggatacagtcatgaatgaataattaaaaagatacctgtgaaaattataaaatatgttgagtaattataaatgctaaggagaaaaaaataaagcagggaaggcaaacatgaagtgtgggcgaatgtgacattttagacagggcggccaagagaggcctcaccaaggaggggacattggaatgaagacgtaaagraggtgaggggcaagcgtgtggctgtccagggaaggaagggtattccaggcaagagaacagcacgtgtgaagcctgggagctgagcgcacctagcgtgtttgaagaacacagaggagcctgcggggctggagtgcagggagctgggaaggggtccagcgctaggatggagtggagggggctgggaaggcatccagcgctaggatggatggagggggctgggaaggggtccagcgctaggatggagtggagggggctgggaaggcgtccagcgctagtatggagtgaagggggctgggaagg

SEQ ID NO: 30441 - DNA, 601 bp, Human
ggagggtcacatctaaagggacattgcatttgtccagaaatagagagggagtaaaacctcttcacgggtctgtttctcggagccctgccatttccatttcatagttgcttcacacattcattcagtcagtcatttaacaaacatttattgagctaagtggctggcactgttctgggtggtgaggatacagtcatgaatgaataattaaaaagatacctgtgaaaattataaaatatgttgagtaattataaatgctaaggagaaaaaaataaagcagggaaggcaaacatgaagtgtgggygaatgtgacattttagacagggcggccaagagaggcctcaccaaggaggggacattggaatgaagacgtaaaggaggtgaggggcaagcgtgtggctgtccagggaaggaagggtattccaggcaagagaacagcacgtgtgaagcctgggagctgagcgcacctagcgtgtttgaagaacacagaggagcctgcggggctggagtgcagggagctgggaaggggtccagcgctaggatggagtggagggggctgggaaggcatccagcgctaggatggatggagggggctgggaagggg

SEQ ID NO: 30442 - DNA, 601 bp, Human
acccaccccccacttcctggacctttcccagacacccccttcagacaccagactgtagtgaaacactactacatatcttcagatcaaactgatatttttcaagaaaataggaaagtctccttaaaacagcagattgaaaggaagtgacagagaatagacgaacgtaatttccagaccatcgtccttcaggggtggggcccgtggagaagaaaacctctcagtgccattgtctcgcacctgggaggacgcacgtggggcaaaagggatgcaggcaaagcagtcccttctgagacacggagaraaagaacatcaggcagagaggcaaagagaacgcaaaatatgccccccggggctttggtttagccaagaacagtcaccctcagaattagtgctggcaacagacagaaagtggcatccctttgatgcccttggaccctttgaattagtgctggcaacagacgaaagcagcgtcccttgtgcttggagcctttggccctgatcatggatgtagggctcggggtctctaacacctttacggagagggagcgatggcactctactgggtcctagcccaggaaaccagacaaggagagacacggct

SEQ ID NO: 30443 - DNA, 601 bp, Human
ttctcacccaccccccacttcctggacctttcccagacacccccttcagacaccagactgtagtgaaacactactacatatcttcagatcaaactgatatttttcaagaaaataggaaagtctccttaaaacagcagattgaaaggaagtgacagagaatagacgaacgtaatttccagaccatcgtccttcaggggtggggcccgtggagaagaaaacctctcagtgccattgtctcgcacctgggaggacgcacgtggggcaaaagggatgcaggcaaagcagtcccttctgagacacrgagaaaaagaacatcaggcagagaggcaaagagaacgcaaaatatgccccccggggctttggtttagccaagaacagtcaccctcagaattagtgctggcaacagacagaaagtggcatccctttgatgcccttggaccctttgaattagtgctggcaacagacgaaagcagcgtcccttgtgcttggagcctttggccctgatcatggatgtagggctcggggtctctaacacctttacggagagggagcgatggcactctactgggtcctagcccaggaaaccagacaaggagagaca

SEQ ID NO: 30444 - DNA, 601 bp, Human
caaactggcttcactctcacggcagccccatcctttgccctgatttctcacccaccccccacttcctggacctttcccagacacccccttcagacaccagactgtagtgaaacactactacatatcttcagatcaaactgatatttttcaagaaaataggaaagtctccttaaaacagcagattgaaaggaagtgacagagaatagacgaacgtaatttccagaccatcgtccttcaggggtggggcccgtggagaagaaaacctctcagtgccattgtctcgcacctgggaggacgcacrtggggcaaaagggatgcaggcaaagcagtcccttctgagacacggagaaaaagaacatcaggcagagaggcaaagagaacgcaaaatatgccccccggggctttggtttagccaagaacagtcaccctcagaattagtgctggcaacagacagaaagtggcatccctttgatgcccttggaccctttgaattagtgctggcaacagacgaaagcagcgtcccttgtgcttggagcctttggccctgatcatggatgtagggctcggggtctctaacacctttacggagagggagcgatgg

SEQ ID NO: 30445 - DNA, 601 bp, Human
cgcagctctcttcccagcaccgtgatgatgacatcctagggagaaatgactgtggggtgcttctaggcagacgggactgtaagcggcctcagaaaaggtgtcctgtgtctgagcaaggcacagaagcagcagagcctctccctgggtctgaaggggaagtggggcggagctgtgatggaaacctgtgtggactcacgcccagggacccacaaccaccttccaccccacaccgcagggccctctgctgggcttcgccgcagagctgtggggcgctgtgagaaagacggaggtggaagtttcytgccaacctggcagaaggggaggtgggagataaaaatccagttgaactataagcaataaagtaaggttctttcctctttccttccttccttcctttttctttctttcgtccttctttttctccaatatagtttctttctttctttctttttctcctttccctttctttcctttcctttctttcctttcctttctttccctccttctttctttcttttcttttcttttcttttctttctttttgacatagagtctcactctgttgcccaggctggagtacaatggcgcaatcttggctcac

SEQ ID NO: 30446 - DNA, 601 bp, Human
aggtagttttgtgttgccagataaacactttcctttctggctcttcctttacaaccaaaaataaaaataaaaaagcagataggacaagagtcgtggaattaggccaagtatcttggctagaaacatggagaagtagtttctccaaactggaaaagatgtttcttttagctggaaggagatagtaaaagagaaagcaaaggggcttggaggtgtcaagatagagggacccgcagctctcttcccagcaccgtgatgatgacatcctagggagaaatgactgtggggtgcttctaggcagacrggactgtaagcggcctcagaaaaggtgtcctgtgtctgagcaaggcacagaagcagcagagcctctccctgggtctgaaggggaagtggggcggagctgtgatggaaacctgtgtggactcacgcccagggacccacaaccaccttccaccccacaccgcagggccctctgctgggcttcgccgcagagctgtggggcgctgtgagaaagacggaggtggaagtttcttgccaacctggcagaaggggaggtgggagataaaaatccagttgaactataagcaataaagtaaggttcttt

SEQ ID NO: 30447 - DNA, 601 bp, Human
tagggaggtcagcagcagcgcgcagggcagcagagggacggcccagcccgtggaaacccgctccgggacaggcttgctttcccccagtgttccacttcgggccactcggaaccccaaaccatccttccccccttttccaggcgtttctctgcagggcaacccctttccccggccagacaggtattcttccacttttgtggagggactggagtgtttctcagaccctctgcttcagaaaggaccccgaaggctggcagaggaggggcccccagctggctttcctcacgccctcccctctcaygtccatctccttttctgcctttataaaagctgcggttctacccactctggcctcggctctgaaggcacagtgatctgtagattttatttgggtgccttagggggcttggtaaaggcctcgctgtgatctccctcatcagactctggtgactcagagcgggaggaacagatggctgggaggactcaaagggaaaatcaggcacctttgctgccggatccccacgccagcccctccaaacgtcctgactcgtgagatgcagagatcctgagcctcgtgtctctgaagatccccagggatccc

SEQ ID NO: 30448 - DNA, 601 bp, Human
ctgacagcccagagtctgggagatgtagcagtggccttgattgtagcagtaattcacagggcaggactggttctgacacaggaaagagctccccagagctgcagagtgagtagggaggtcagcagcagcgcgcagggcagcagagggacggcccagcccgtggaaacccgctccgggacaggcttgctttcccccagtgttccacttcgggccactcggaaccccaaaccatccttccccccttttccaggcgtttctctgcagggcaacccctttccccggccagacaggtattcttccrcttttgtggagggactggagtgtttctcagaccctctgcttcagaaaggaccccgaaggctggcagaggaggggcccccagctggctttcctcacgccctcccctctcacgtccatctccttttctgcctttataaaagctgcggttctacccactctggcctcggctctgaaggcacagtgatctgtagattttatttgggtgccttagggggcttggtaaaggcctcgctgtgatctccctcatcagactctggtgactcagagcgggaggaacagatggctgggaggactcaaaggg

SEQ ID NO: 30449 - DNA, 601 bp, Human
agtgtttgaaattaagttcttggcaagtcacacgaaaattgacataactcattaataaatgcagtctcattttcctaatgagaagagactctacctttagacctgttttaaatggtttctccttggttccatctcccgtggcatcgcttccctctcggtcagagacgtacagctctgctgtttgacaaaatgagggtaagttatggtctggccattaactattagtcaccttactactttattcattccttatctttgtaaacagaacaagcatcgattaataaaaattgaggtccataartaattaatatcctagttatttccccactccatttcaataacatccatctcataaaaacattagttaataatccaggttttcaaaatgaactctgatcattttaatttgtgatatttattctatctaattgggcacccaaaaataaaacatgggctttgaagttgatcagacatacgctggaatgttggattttgtaccttaaaaggcagggtgactctggagaatttacttaacctttctgagcttatttctttacctataaaataggaaaaacaatccccatcttgaaaggctgtgctg

SEQ ID NO: 30450 - DNA, 601 bp, Human
tcaccaaaagccctctcaggagccccctggtcatgagctcactgtaactgaggaaaggtaacttttatctttacaagaattgaaaacccagcaatctgactcaatggagagaaaaattccaagaagcaatgccatgtggtaagaaagaagagaccttttttcaaaatgttaaaaagtaagtttagactttgatcatctaacaatcttaaagtcacatatctgtatgcattccttactttcccttttctgaaaattctctttggaacctagtgtttgaaattaagttcttggcaagtcacaygaaaattgacataactcattaataaatgcagtctcattttcctaatgagaagagactctacctttagacctgttttaaatggtttctccttggttccatctcccgtggcatcgcttccctctcggtcagagacgtacagctctgctgtttgacaaaatgagggtaagttatggtctggccattaactattagtcaccttactactttattcattccttatctttgtaaacagaacaagcatcgattaataaaaattgaggtccataagtaattaatatcctagttatttccccactccat

SEQ ID NO: 30451 - DNA, 601 bp, Human
aagctcttgacaaacccctttgagaatgagctaaactcattcaaggattctagatcctgagaaataacagcactgttaattcattaacagaatgttaataaattggcattctagcttgaagctccagactcatgagtcagctctgacaaatgaatccattcttggtggtcttggagtcaaatctcaggatcacactctggattgtggtaaattcaccaaaagccctctcaggagccccctggtcatgagctcactgtaactgaggaaaggtaacttttatctttacaagaattgaaaaccyagcaatctgactcaatggagagaaaaattccaagaagcaatgccatgtggtaagaaagaagagaccttttttcaaaatgttaaaaagtaagtttagactttgatcatctaacaatcttaaagtcacatatctgtatgcattccttactttcccttttctgaaaattctctttggaacctagtgtttgaaattaagttcttggcaagtcacacgaaaattgacataactcattaataaatgcagtctcattttcctaatgagaagagactctacctttagacctgttttaaatggtttctc

SEQ ID NO: 30452 - DNA, 601 bp, Human
cttgaacccagaaggcagaggttgcagtgagccgagatcatgccactgcactccagcctgggcaacaagaacaaaactctgtctcaaaaaaaaaaaaaaaaaagatagccattgatgaaaatgcaaaaccaagagagaaggtcccatgaatacatgtaggtcgttcggaattcacttattacccgacaatctgtactgatccctccttttgtatcattgaaattgaaagagccaaactatcagttcccaaatcagaatgctacacttttgttaacagtgacattctgttgttaacagtgayattctgcaaacgttcatctaaacggtgttgtcagttttcaggagctgcaaaacgaggcacccgataatccagaaatgaaagatttccccttaagagtggttaaaaagtaaaacccagccaggagtggcggctcacacctgtagccccagcactttgggaggccaaggcagcaggattgcttaagcccaggagtttaagaccagcctgggaaacataatgagatctcgtatctacaaataagaaacaaattaaccgcgtgtggtgacatgcccctgtggtccgagctacttggaaggctga

SEQ ID NO: 30453 - DNA, 601 bp, Human
aaaatagagaaggaaggaatctggatcttttgaaaacattcaagggctgggcgtggtggctcacgcctataatcctagcactttgggaggccgaggtgggcggatcatgaggtcaggagttcgagaccagcctggccaatatgatgaaaccctgtctctactaaaaatacaaaaattggccaggtgtggtggcacacgcctgtggtcccagctactcgggaggctgaggcagaagaatctcttgaatccgggaggcagaggttgcagtgagctgagattgcaccactgcactccagcctgrgtgacagtgtgagactccttttcaaaaaaaaaaaaaagaaaaaaaagaaaacattcaatagttcatccttttaacaactagacattgtaagaatacatgtaggggccaggcgcagtggcacacgcctgtaatcccagcactttaggaggccgaggtgagtggatcacctgagctcaagagttcgagaccagcctggccaacacggtgaaacaccatctctactagaaataaaaaaaaaaaaaagaaattagccaggcatggtggcgagtgcctataatcccagctactcaggacgctgag

SEQ ID NO: 30454 - DNA, 601 bp, Human
cctgtagtcccagctactcaggaggctgaggcaggagaatggcgtgaacctgggaggcggagcttgcagtgagccgagatcgcaccactgcactccagcctgggtgacaagagcaagactccgtctcaaaaaaaaaaaaaaaaaaaaatagagaaggaaggaatctggatcttttgaaaacattcaagggctgggcgtggtggctcacgcctataatcctagcactttgggaggccgaggtgggcggatcatgaggtcaggagttcgagaccagcctggccaatatgatgaaaccctgtctctactaaaaatacaaaaattggccaggtgtggtggcacacgcctgtggtcccagctactcgggaggctgaggcagaagaatctcttgaatccgggaggcagaggttgcagtgagctgagattgcaccactgcactccagcctgggtgacagtgtgagactccttttcaaaaaaaaaaaaaagaaaaaaaagaaaacattcaatagttcatccttttaacaactagacattgtaagaatacatgtaggggccaggcgcagtggcacacgcctgtaatcccagcactttaggaggccgaggt

SEQ ID NO: 30455 - DNA, 601 bp, Human
aagatgaatattttaaagcctcaaataatctttcaaaatctcttccaagttattgaatcaaacaagaaatgcagtgaattattctctgttgcaagatctgcagcctgcaaaaacggactttttctcagttctacgactgctgcagagaaggagggaatctgaggccgggcatggtggctcacacctgtaatcccagcactttgtgaggccgaggtgggcggatcacgaggtcaggagatcgagaccatcctggctaacatggtgaaaccccgtctccgctaaaaatacaaaaaattagccrggtgtggtggcgggcacctgtagtcccagctactcaggaggctgaggcaggagaatggcgtgaacctgggaggcggagcttgcagtgagccgagatcgcaccactgcactccagcctgggtgacaagagcaagactccgtctcaaaaaaaaaaaaaaaaaaaaatagagaaggaaggaatctggatcttttgaaaacattcaagggctgggcgtggtggctcacgcctataatcctagcactttgggaggccgaggtgggcggatcatgaggtcaggagttcgagaccagcctggccaat

SEQ ID NO: 30456 - DNA, 601 bp, Human
cttttctcttcgtaaactatcttctgcctaattttaatgatgaagcagtttgttaacatggttgccagagttctaactttaacaacgttcacgatggcaaggtcaggactcacctctttcttttcccgggattcactcttcatttgttccctatgccacatctttttaatgttcttcaactgtgatttagaaataacattccacctctcattttctttttgtgaatctacgtaaatggtaggaaatggttctttccctactgtcatcaaagccttgggtagggaggagagaaaagacagtycttgaacattgtacaatacttaaaatcaaaataacatctcaagtataaggcaactggaacaatctaagcataaagaccccaacagccaaaagctgatattggcacagtgactggttgaacatttaagaagcacactggttggctgggcgcggtggctcacgcctgtaatcccagcactttggaaggccgaggtgggtgaggtcaggagatcgagaccatcctggctaacatggtgaaaccccgtctctactaaaaatacaaaaaaattagccaggtgtggtggcaggcacctgtagtccc

SEQ ID NO: 30457 - DNA, 601 bp, Human
cagcactttgggaggctgaggtgggaggatcccttgagcccaggagtttgaaaccagcccgggcaatatgggagactgtttctacaaaaattaaaaataaataaaagttagccaggtgtggtggtgcatgcctgtggtcccccctacttgggaggatcgttagagcccaggaggcagaggttacagtgagcagaaactgcaccactgcactccagcctgagcaacagagcaagaccctgtctcaaaataaataaattaaaatttaaaattaagaaataaaaaataaaaggaaagtaggccrggcgcagtggctcacgcctgtaatcccagcactttgggaggtcgaggtgggcagatcacgagatcgggagatcaagaccatcctggctaacacggtgaaaccccgtctctaccaaaaatacaaaacattagccgggcgtggtggcgggcgcctgtagtcccagctactcgggaggctgaggcaggagaatggcgtgaacccgggaggcggagcttgcagtgagctgagattgaaccactgcactccagcctgggcgacagagcaagactccgtctcaaaaataaataaataaataaataa

SEQ ID NO: 30458 - DNA, 601 bp, Human
tcaactgtgtaataaaatgaacccctaaagaactagcctcataactctaaaacattatttctctatgtcccttctgaaaggaaagtaggccaggcatggtggctcacgcctgtattcccagcactttgggaggctgaggtgggaggatcccttgagcccaggagtttgaaaccagcccgggcaatatgggagactgtttctacaaaaattaaaaataaataaaagttagccaggtgtggtggtgcatgcctgtggtcccccctacttgggaggatcgttagagcccaggaggcagaggttrcagtgagcagaaactgcaccactgcactccagcctgagcaacagagcaagaccctgtctcaaaataaataaattaaaatttaaaattaagaaataaaaaataaaaggaaagtaggccgggcgcagtggctcacgcctgtaatcccagcactttgggaggtcgaggtgggcagatcacgagatcgggagatcaagaccatcctggctaacacggtgaaaccccgtctctaccaaaaatacaaaacattagccgggcgtggtggcgggcgcctgtagtcccagctactcgggaggctgaggc

SEQ ID NO: 30459 - DNA, 601 bp, Human
aatgaattcctttgtcataagtggagcacttgcttcccacaacagcaacaatcccagtccacatgaagccttttccatgaccccacagttcttcaataccttccagaacatggtacttaaaaggctagcttttgtttgggggatgaaggagagaggagatgagtagaggaaggggctgttgcatgtggccaaaaaaccccagctccatcactaaggaaataatacaaaaattcatcagcaataagaactactggaaatctggctgggcgtggtggctcaagcctgtaatcccagcactttrggaggctaaggagggcagatcacctgaggtcaggagtttgagactagtctggccaacacggtgaaaccccatctctactaaaaatacaaaaattagccaggcgtggtggcaggcacctgtaatcccagctacttgggagtctgaggcaggaggatcacttgaacccgggaggcggaggttgcaatgagctgagatctccccactgcactccagcctgggtgacaagagtgaaactctgtctcataaataaataaataataaaataaaataagaactactggaaatcaaaccattttcatt

SEQ ID NO: 30460 - DNA, 601 bp, Human
accaaacgcatttcactgtattggcatggtttaaaacaaaacaaaaaaaaatccaagtcttctttcttagtgtaaaactgataatgagaaacacccagaagaatttcagatattgctagataaaattaattaataaatgaattcctttgtcataagtggagcacttgcttcccacaacagcaacaatcccagtccacatgaagccttttccatgaccccacagttcttcaataccttccagaacatggtacttaaaaggctagcttttgtttgggggatgaaggagagaggagatgagtasaggaaggggctgttgcatgtggccaaaaaaccccagctccatcactaaggaaataatacaaaaattcatcagcaataagaactactggaaatctggctgggcgtggtggctcaagcctgtaatcccagcactttaggaggctaaggagggcagatcacctgaggtcaggagtttgagactagtctggccaacacggtgaaaccccatctctactaaaaatacaaaaattagccaggcgtggtggcaggcacctgtaatcccagctacttgggagtctgaggcaggaggatcacttgaacc

SEQ ID NO: 30461 - DNA, 601 bp, Human
aaagagcatttaaaaatttttatactttcaatagtcattttaaacaagaacaaatttaagatataaatcactctatcctttaaagccaggtgaggtgctatgtgcctgtaatcccagctgctcaggaggctgaggcaggaggatggctggggggagttcaagtctagccagcataccaaaaaaaaaaagagggccgggcgcagcggctcatacctgtaatcccagcactttgggaggccaagacagtggatcacctgaggccaggagttccagagcagacgggccaacatggtgaaacacygtctctactaaaattacaaaaatcagccaggtgtggtggcaggtacctgtgataacagctactcaggaggctgaggcaggagaattgcttgaacctgagaggcggaggttgcagtgagccgagatagcaccactgcactccagcctgggcaacaaagtgagactgtgtctaagaaaaaaagggggagagaaaaaaacccctgcaaatctttgtatgtttttcttcatctaagagcagggatatttaaacattaaaaagaaggaaaagctttgccatttaccttgcctgcgcagcctgtgg

SEQ ID NO: 30462 - DNA, 601 bp, Human
ccacccgccttggcctcccgaagtactgggattataggcgtgagccaccgcacctggcctgtcccacttttcaatgaaagatttgctaatcccttacaataaatagtaaaagtgacatgtttatatattataaaatatataataaaaggggaaagaggaaacaaaatgtcagaaccaagggagaatgcaaatatactgtttataagagtcaaaactatggccaagtttcagactcagatgtcaacctcctatagtaacatcccttgattttcactaaataattaaaactcaacttgacaartatttactggacgcatcttcatcactataattgctaaccattaaaagagcatttaaaaatttttatactttcaatagtcattttaaacaagaacaaatttaagatataaatcactctatcctttaaagccaggtgaggtgctatgtgcctgtaatcccagctgctcaggaggctgaggcaggaggatggctggggggagttcaagtctagccagcataccaaaaaaaaaaagagggccgggcgcagcggctcatacctgtaatcccagcactttgggaggccaagacagtggatcacctg

SEQ ID NO: 30463 - DNA, 601 bp, Human
gggtctcacttcgtcacccaggctagagtgcagtggcacaatcacagctcgctgcagcctctacctcctgggctcaagcaaacctctcaccttaccctcccagatagctgggactacaggcacatgccaccacacctggctaattattttgtagtgacaagggtctcactgagttgcccagactggtctcaagctcctgggctcaagcaatcctcctacctcagcctcccaaagcgctgatattacaggtgtgagccactgcacccagccatgacttaatcttatctaaaggaaactccamggttaaacattcaagttcagacctcccacatggctccctgcccctgaagtacccactggtaataccactactcagtatttgtaaaatattttattttcaatgtattggactttcaaatcctacatgatccccaagatccacacaaccaggggaaagcaggacagaaggcaacatgagttaagggattatgccttatctacccttgagtcccctgcaatgcctggggtagtactgtgcactcggtgatacataaatgttcttgaacaaaatcactttttcttatttatgtcctaaaggtcc

SEQ ID NO: 30464 - DNA, 601 bp, Human
attaaattttatatatatatataattttaaagatagggtctcacttcgtcacccaggctagagtgcagtggcacaatcacagctcgctgcagcctctacctcctgggctcaagcaaacctctcaccttaccctcccagatagctgggactacaggcacatgccaccacacctggctaattattttgtagtgacaagggtctcactgagttgcccagactggtctcaagctcctgggctcaagcaatcctcctacctcagcctcccaaagcgctgatattacaggtgtgagccactgcacccagccatgacttaatcttatctaaaggaaactccaaggttaaacattcaagttcagacctcccacatggctccctgcccctgaagtacccactggtaataccactactcagtatttgtaaaatattttattttcaatgtattggactttcaaatcctacatgatccccaagatccacacaaccaggggaaagcaggacagaaggcaacatgagttaagggattatgccttatctacccttgagtcccctgcaatgcctggggtagtactgtgcactcggtgatacataaatgttcttgaac

SEQ ID NO: 30465 - DNA, 601 bp, Human
ctgagatcacgccactgcactccagcatgggtgacagagcgagactctgtctcaaataaaaaaaagaaaaagacaaccacaccttacatgcctcttgacgtgatgcaactaaaagaacacagctttgcccatgaagtagttgtgccaaaaaactgaacctaatcagacctaacctccaatttataaaaaatgcagacactagaagaacatgctaaaggacaccacaaggatgcaaacaaccaaatccataatgtgagaagttccacaggacaatccaccagggttttcccaagaaatacayagtaatgggtggggagagggggcgggttgcaaaagaagagagaatgcaaagagagcagcagagttataaagaaaatttcaaagtcatatcactaaacgcagcatgttagtcttgtcagaatcctcgttcaaatcaatcaactataaaaaggcagtacgaactgataacaagaatctggatattagatgatatttagtagttgtattaatttggtggagggtgtgataatagtaggtgactattatctttttttttttttttttttgagacaaggtttcactctgttgcccaggctggaag

SEQ ID NO: 30466 - DNA, 601 bp, Human
catgcactatgctccctgcaggtgacttcaatattcgatctaccacatcacaaaccaagtcctccaaccggttcaggaggtcgtcaaaagtcaggaaaggacactcagcttccacgtgagtgtacctgaagaacgagacaatagctcagcactgcttttctcctgcactggttttttatccagcaaggcttttaacattgggaagctgtccataaaatgccaacaatgctaccaattcccaactttgcaaattagctgtggactcccctcttctccactgagtagcaatttcttgtttgckcctttatatataaaagatcaagtcaaagtgaaaaaagagaacttagctacgatctaaggtggcaaaactttgttatatgttcttccattaaccacttaatatatcagttggttttttttaaaacataaacataatttacctacactaagatttcttctctaaagatattacctagaaagaaataaaacaaaaagacaacttcatactcagccaggtgccttcgtgttctggactgctctgcccggtatgactgagcaatacaaaaaacatctcccagggctgggaggcaggtctccaagt

SEQ ID NO: 30467 - DNA, 601 bp, Human
accaatgcattccagcctggacgacagatggagatgctgtcccaaataaagaaaatttgcaacccaagtgcatgctgggagagtggttctcaggcaaaaccgaaatgctaagtttacctggggcactaggctaccttctccaagaccttctctcttggttttgcatttttaaccaatggctatcttctttctcgccttccacattaagaagttttaaatcactgttttgggggaggggatgaacctctttttaaaagcacaagatacattctccagaaaaaaaaaaaaaaaaaaatatatmtatatatatctatataccaacattttgcatgtgatttcaaaggcttcacaaccttctaaagcactcctaccagcctagagaatgataaagagagcttataagctgtggccaaggaagaacaatgaaggaagagggaagaggcaaagcatgagacatgaaggcagcttagaaactcacacttggccagaagcggtggctcacgcctataatcccagcactttgggaggctgaggtgggcagatcacgaggtcaagagatcgagaccatcctggccaacatggtgaaaccctgtctctacta

SEQ ID NO: 30468 - DNA, 601 bp, Human
tgatcgcaccaatgcattccagcctggacgacagatggagatgctgtcccaaataaagaaaatttgcaacccaagtgcatgctgggagagtggttctcaggcaaaaccgaaatgctaagtttacctggggcactaggctaccttctccaagaccttctctcttggttttgcatttttaaccaatggctatcttctttctcgccttccacattaagaagttttaaatcactgttttgggggaggggatgaacctctttttaaaagcacaagatacattctccagaaaaaaaaaaaaaaaaawatatatatatatatatctatataccaacattttgcatgtgatttcaaaggcttcacaaccttctaaagcactcctaccagcctagagaatgataaagagagcttataagctgtggccaaggaagaacaatgaaggaagagggaagaggcaaagcatgagacatgaaggcagcttagaaactcacacttggccagaagcggtggctcacgcctataatcccagcactttgggaggctgaggtgggcagatcacgaggtcaagagatcgagaccatcctggccaacatggtgaaaccctgtc

SEQ ID NO: 30469 - DNA, 601 bp, Human
tatgatcgcaccaatgcattccagcctggacgacagatggagatgctgtcccaaataaagaaaatttgcaacccaagtgcatgctgggagagtggttctcaggcaaaaccgaaatgctaagtttacctggggcactaggctaccttctccaagaccttctctcttggttttgcatttttaaccaatggctatcttctttctcgccttccacattaagaagttttaaatcactgttttgggggaggggatgaacctctttttaaaagcacaagatacattctccagaaaaaaaaaaaaaaawaaatatatatatatatatctatataccaacattttgcatgtgatttcaaaggcttcacaaccttctaaagcactcctaccagcctagagaatgataaagagagcttataagctgtggccaaggaagaacaatgaaggaagagggaagaggcaaagcatgagacatgaaggcagcttagaaactcacacttggccagaagcggtggctcacgcctataatcccagcactttgggaggctgaggtgggcagatcacgaggtcaagagatcgagaccatcctggccaacatggtgaaaccctg

SEQ ID NO: 30470 - DNA, 601 bp, Human
gctatgatcgcaccaatgcattccagcctggacgacagatggagatgctgtcccaaataaagaaaatttgcaacccaagtgcatgctgggagagtggttctcaggcaaaaccgaaatgctaagtttacctggggcactaggctaccttctccaagaccttctctcttggttttgcatttttaaccaatggctatcttctttctcgccttccacattaagaagttttaaatcactgttttgggggaggggatgaacctctttttaaaagcacaagatacattctccagaaaaaaaaaaaaawaaaaatatatatatatatatctatataccaacattttgcatgtgatttcaaaggcttcacaaccttctaaagcactcctaccagcctagagaatgataaagagagcttataagctgtggccaaggaagaacaatgaaggaagagggaagaggcaaagcatgagacatgaaggcagcttagaaactcacacttggccagaagcggtggctcacgcctataatcccagcactttgggaggctgaggtgggcagatcacgaggtcaagagatcgagaccatcctggccaacatggtgaaaccc

SEQ ID NO: 30471 - DNA, 601 bp, Human
cagctatgatcgcaccaatgcattccagcctggacgacagatggagatgctgtcccaaataaagaaaatttgcaacccaagtgcatgctgggagagtggttctcaggcaaaaccgaaatgctaagtttacctggggcactaggctaccttctccaagaccttctctcttggttttgcatttttaaccaatggctatcttctttctcgccttccacattaagaagttttaaatcactgttttgggggaggggatgaacctctttttaaaagcacaagatacattctccagaaaaaaaaaaataaaaaaatatatatatatatatctatataccaacattttgcatgtgatttcaaaggcttcacaaccttctaaagcactcctaccagcctagagaatgataaagagagcttataagctgtggccaaggaagaacaatgaaggaagagggaagaggcaaagcatgagacatgaaggcagcttagaaactcacacttggccagaagcggtggctcacgcctataatcccagcactttgggaggctgaggtgggcagatcacgaggtcaagagatcgagaccatcctggccaacatggtgaaac

SEQ ID NO: 30472 - DNA, 601 bp, Human
agaccagcccagtcaacacagcaatacctccatctctttaaaaaaaaaaaaccaaaaaaccaaactgaattcacagaaacaagagtgctttacatagacccagtatattgtttcacctattaattccttctaaaacccaaaactagttagcagcatctacacacatttcaactgtaaaacaattagatgtgcaaatattatgtaagtaatggttaaatgcacaggaaagagggcctagcatagtcttggaaacttgagccagatgcagtggctcacgcctgtaatcccaatactttggaargctggggtgggaggactgcttgagccaaggagtttgagaccagcccgggcaacatagggagacgccatctctacaaataataaaaaattagctgggcatggtggctcacacctgtaatcccagcacttttggaggctgatgtaggaggaacacttgaactctggagttcaaggttgtagccagctatgatcgcaccaatgcattccagcctggacgacagatggagatgctgtcccaaataaagaaaatttgcaacccaagtgcatgctgggagagtggttctcaggcaaaaccgaaatg

SEQ ID NO: 30473 - DNA, 601 bp, Human
gtccccacaatcttgcaaaacagatgttacttccaaggtagagataaggaacctgagagggggtcactggtcttcagttacacagcacaaaagaaaagaggtgggagctaagcccacctggggggccttctgactccacagcttgtgttctttccactcaactacactattttactaagtattaggaacactaaaagtatgcaagttctcaatacaaaattttgtcattatacatcataaactgaattcataggctgggcacagtgtggctcatgcctataatctcaacactcgggaggcygaggtgagaggactgctcgaggccaggagtttgagaccagcccagtcaacacagcaatacctccatctctttaaaaaaaaaaaaccaaaaaaccaaactgaattcacagaaacaagagtgctttacatagacccagtatattgtttcacctattaattccttctaaaacccaaaactagttagcagcatctacacacatttcaactgtaaaacaattagatgtgcaaatattatgtaagtaatggttaaatgcacaggaaagagggcctagcatagtcttggaaacttgagccagatgca

SEQ ID NO: 30474 - DNA, 601 bp, Human
ctttaaactctcctgttatctacccttctttcctgttgtaatcaatcagttatgccttcgatgacagacacaatcataagacaaataaccaatgtcaaactggtaagtgtaagcacacctggaatagttacccaaacaatgttagatgatgacttaagcgcatcagtttctctctcaaaacatccttctataccacacataaattaaagttaacacagaagttaaaactgacaactctcgtcccagtaaaaatggattgagagaactggagaagactcatagatttgtttaatgaagaagkgaaatggaggtagcaatcacctagcacacctgttttcaagctccaggctctggagcccttgcgtcctcggagacgccgagaggtaacaggagatgagtgggagagctctagtctctcagcttgcatctgctttacacagcggggttctgcataagatttagttaggggaaaacaggtcttatttcataccccccaaagcctgagggtcatgtatccactctagtgtcctcatgtgtgtggaacagtagcaatgtatagtaaatgctgacaggctccccctgccattgtcctgcctaggca

SEQ ID NO: 30475 - DNA, 601 bp, Human
catcagtctctcaggagcttctgggatatcctgaggtcaaacaagacttcattaacatttacaacttggatcgcaacaagacagaagcagctccttcaccctgtaccagtccttcctcctatcaattcaacagagtagaggatacacacctacccttaacccatacacatttgtgtaaagaataatttctttcaaaaagaaataaacatattcttaaaactcagttatttaatgaagcataaaagatctgtctccctttacagcatatctcaagcaccatgctgtttgatgaaggaaaatmaaaaaaaaaacaaaaacaaaagccagccccaagctgtgactagacacagctcagtatttttctcagtggcccgttttgtctagctctgaagcaaatgaggtccacttagtcccgtaaggcatacggtaatcatgaatgctccagaacatcattgatctacacacagagtatattactaatgacacttatctttaaactctcctgttatctacccttctttcctgttgtaatcaatcagttatgccttcgatgacagacacaatcataagacaaataaccaatgtcaaactggtaagtgta

SEQ ID NO: 30476 - DNA, 601 bp, Human
attggttcattaatggtgtctgtcatcagtctctcaggagcttctgggatatcctgaggtcaaacaagacttcattaacatttacaacttggatcgcaacaagacagaagcagctccttcaccctgtaccagtccttcctcctatcaattcaacagagtagaggatacacacctacccttaacccatacacatttgtgtaaagaataatttctttcaaaaagaaataaacatattcttaaaactcagttatttaatgaagcataaaagatctgtctccctttacagcatatctcaagcacyatgctgtttgatgaaggaaaatcaaaaaaaaaacaaaaacaaaagccagccccaagctgtgactagacacagctcagtatttttctcagtggcccgttttgtctagctctgaagcaaatgaggtccacttagtcccgtaaggcatacggtaatcatgaatgctccagaacatcattgatctacacacagagtatattactaatgacacttatctttaaactctcctgttatctacccttctttcctgttgtaatcaatcagttatgccttcgatgacagacacaatcataagacaaataa

SEQ ID NO: 30477 - DNA, 601 bp, Human
ctaagagggatactgtgaatcactaaaaaactctccccaaaattatgttcttacttcaaatcctttaaggcaattctatttttacaaattcttcaatttctatgcctcaggattattagcagctaagcagagttagaaaagattaataactgatacaaaaggctattcatttgattctagtgtttactgctgaattatactgtgttctaatatgagcagatttttatacgatattgccaatttcttcccccaagatttttgttttaattcattgatgcaataaaataaatcaaagaattcmaggtacacttaaaaggacagaaagataagttactggagtatcttacaccataatctaaaattgttgaattatacatacatataacttgaataaaatgaataacttggataaagtgagtaaaatgctgaaatgtatccctaactacagtttcatgccaggtattttccccgaactttgtttcccgaacttaagaaaaaaatggatattttttcttaagatgacaaccttaatatcacttgatgttcaggtgatttgagatagtttttatggtagtagaaagaaaaacagaaagagaaaccc

SEQ ID NO: 30478 - DNA, 601 bp, Human
gactacaggtgctcaccaccatgcctggctaatttttgtctttttgtgtttttgtagtagagacggggtttcaccatgttggccaggctggtctcaaacttctgacctcaagtgatccgcccgccttggcctcctgaagtgctgggattacaggtgtgagccatcatacctggccattgttgggcttataatgattggaaaagtgttaatagccataacttgcatataaaatgatattaattttatttttgttaatttgttaatttagactgctaatctagatcatttattttgaaaatamcttatgcttgcattatatctgataataacttaaatcaatttaaatatttctgtctaaacagtaatattaggatgaatataaagattataactgaaccatttttgtaaatatgcaatgaataaatttggtatggcacactgcactatagttatacttgaatgaaaatattaggccaaaaatttattctaatattcattgaagaaatagttatttagtcaggaaagctttgactagatttttatgacaatggaaagaatcatatgtcatcatgcctatggcatattttatgggcctcattca

SEQ ID NO: 30479 - DNA, 601 bp, Human
atgaaaatattaggccaaaaatttattctaatattcattgaagaaatagttatttagtcaggaaagctttgactagatttttatgacaatggaaagaatcatatgtcatcatgcctatggcatattttatgggcctcattcagaataataatatacatatggttttctttccaaagaaatttaaatatttcagcatcaaagtttaatcaaacatattatagaactgacaaatgaatgcattatttatttaggtacaatatattcatttttacaaatacaagtcttcatatccaaactatgrtatacctaaataattttttaaaccttagtgctaaaattagttgagactattttagaattgtttctaatcttgattacactaaatcaacttaaaactggattaaaatagacactagaaacataaaatgcattataaaaattgtcttgagaatgacatgatttatttaaaccaagattcaaatttataaatatagagatataatattttataaataaaagatatagttataacattttataaatcatattcagagcatatatgtataacatgtcacattttataggaatattaatagagccc

SEQ ID NO: 30480 - DNA, 601 bp, Human
aagatgtatcacctagagcttttctatagtactggaagtagtcttatttatattaaatatagtagtaaaacaagattctaaaaataaagatattggaaaaccatgcaagccactctgcttgtatgtatttttctactacaatgctgacaatctagatactcctccaacatttccagacgccttaaaaatacaaaatctaaaactcaataaaataaatatcttaaatttaaactagaaggatgttacaccctcaaagagctaaagaagtgtcatacagaaaattgttataactacatttaaraaaataaagtttaatgctatttataaataatctgtacgtacaaatagtccagccttatcaaaatggaaaattttgatagaaattatttgttagagatgcctgaaagaaaacaattataacagctttatgaaaatctgcaataaactgttaatgaaaatgaaatgttctattatattaagaatgaaaagactcaaaatatttatcagaatatcctatttaacttactatataaaatattattttgtattattcaaatgtaaagagatgaatgtttaaattattttttgtgacttctccata

SEQ ID NO: 30481 - DNA, 601 bp, Human
ccaaagttggttttgtgaaagatttacatttttgtaagctcgacattttcagagatttaagtgctatctcctgaccctagcaaagaccactgagcagatgaaatcatattagtaattgtggttctgttcagatattatctataagtgggttgtatgtctggctcagcagtcaaggaagtttcagaacttaaatgtaataatccattgattaccaagggaaaatttcaacaatcatagcttaaatactgtacaagaagtttgctgtgaaacttttaggtattgcttactcaagcgtgaatcytccatgttggataaacaaaggtgaacatttgcactaacatttgtgtttactttaagttttgtaagattctcagatttccagtctgttacataatttttttctaaatggttaatattattacataatagtaaatgccaatgttcaaacaaatatttttaacaattttcaaacctttattttccatggctctttgcagcgattggtgaacctgaaagtatagattggtataatcctcaaggagagaagataatttcaacacagagggtagtagtgcaaaaggaaggtgttaggtcacggtta

SEQ ID NO: 30482 - DNA, 601 bp, Human
acctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccgtaagtaatgtatttatatgttttagtttattcaatttcagttgcttataaataaccgaaaaaataaaatgtttgataacacttattaagaactatgtgctttsaaaataaatatcagtttatttatgctttaccagagtgtatcttagaatagaatagctaacagataataagtggttataaacatatatagggcatcaattatattaaataatattaataaaaatgttttcattttctcaagccattaagaattcactgggtatatagagaatagtggtttatttagtggtatgatatttattcagcattttttttttcactgtaaaatagaaggtcatgattagaataaatgaaaatgtgtgacagcactgaccattgtagaatgagaatctggggaaggg

SEQ ID NO: 30483 - DNA, 601 bp, Human
tgaccttgagcaaatcatgtaacctctctgtctttagtttcctcatatataaactgaggataataatggtacctatgtgatatatggagtttgagtactaccttaaattatattgcataaagtacttacaacaatgccttacgattaataggtagttagcatttctaccaatggtaaattatatatatattaggaatgcaagcccttaaatcatctcatatctgtagctttgtgttttgtttgttattctagaaataggatatgaaaaacaaagtcggaacattcctacagtaggacttcytgtttgatgaccaatgcaatttgtgggcacattgttgctcttgtgtttcctgatttggaatttttccctcccatttgattctgagcttccgaagaaatgatattttcctaatttatgtaaccccctagagtatctatttcacaatagcaaataattaaattgaaatggtcattttatagatataatgtttggaaatacttttttattttaaatgatgcaaaagaagaattgtgacatttgcaaaggtaaaaaaaatttttgcaagaacaattcattacttctgtgagaatttctcatcaa

SEQ ID NO: 30484 - DNA, 601 bp, Human
gcccttaaatcatctcatatctgtagctttgtgttttgtttgttattctagaaataggatatgaaaaacaaagtcggaacattcctacagtaggacttcctgtttgatgaccaatgcaatttgtgggcacattgttgctcttgtgtttcctgatttggaatttttccctcccatttgattctgagcttccgaagaaatgatattttcctaatttatgtaaccccctagagtatctatttcacaatagcaaataattaaattgaaatggtcattttatagatataatgtttggaaatacttytttattttaaatgatgcaaaagaagaattgtgacatttgcaaaggtaaaaaaaatttttgcaagaacaattcattacttctgtgagaatttctcatcaagcataaatatccatgttcactcattcattcattcattcattaaagacacttattaggtgtgtatccactataattctgagtcctagccagagacagacagacaataaataaactgaaacagatacatagatgctagctaaacatgctatggaatcctatggaaaataaattacctggggtagagagatagagaaccttgaa

SEQ ID NO: 30485 - DNA, 601 bp, Human
gctttggaggcatagttgagaagctgtggctaaaaaaaatatacaatcattagcctaaaaaaatgtacaatcgttagcctaaaaaaaatacaatcattagtacctggagatttacagaaaaggtttgcagacctttgctctagtgtcaagaaaagatgaatacattataagcagtactaagtaaatgaaggagtacatcctgctgtattcaaattctgtataatttatacatgattctatggtatcactatatgtaaacttagtattgatgtgaattatgtttattattctggggcagtaygttcaaggttatctacaagttctaaatattatggaaagatccatatagataatagaaaagtactttcattcaaattgtcttcatgattttgatttagactgtgctaaaatttcagaataatatgacatctgaaatcgaatgtataatttgcttacattatgttcctttaccatgttcatagggagcattttcaatttagaattttttcaatgcacctgcacagcagagaggtacaaaataattgaatcttttaaagtagtttccatcttcgatgattctgatttgtgtccaagggatgaa

SEQ ID NO: 30486 - DNA, 601 bp, Human
caatcgttagcctaaaaaaaatacaatcattagtacctggagatttacagaaaaggtttgcagacctttgctctagtgtcaagaaaagatgaatacattataagcagtactaagtaaatgaaggagtacatcctgctgtattcaaattctgtataatttatacatgattctatggtatcactatatgtaaacttagtattgatgtgaattatgtttattattctggggcagtacgttcaaggttatctacaagttctaaatattatggaaagatccatatagataatagaaaagtactttyattcaaattgtcttcatgattttgatttagactgtgctaaaatttcagaataatatgacatctgaaatcgaatgtataatttgcttacattatgttcctttaccatgttcatagggagcattttcaatttagaattttttcaatgcacctgcacagcagagaggtacaaaataattgaatcttttaaagtagtttccatcttcgatgattctgatttgtgtccaagggatgaagattctacagcataaagaagagacagaaaataatatctatttttgaatatgtggggagaatgtatga

SEQ ID NO: 30487 - DNA, 601 bp, Human
ttgatgtgaattatgtttattattctggggcagtacgttcaaggttatctacaagttctaaatattatggaaagatccatatagataatagaaaagtactttcattcaaattgtcttcatgattttgatttagactgtgctaaaatttcagaataatatgacatctgaaatcgaatgtataatttgcttacattatgttcctttaccatgttcatagggagcattttcaatttagaattttttcaatgcacctgcacagcagagaggtacaaaataattgaatcttttaaagtagtttccrtcttcgatgattctgatttgtgtccaagggatgaagattctacagcataaagaagagacagaaaataatatctatttttgaatatgtggggagaatgtatgataatcatgttcaatagtcacttttttaattttgaaagaatttttctgagcttagcatgttcaatgcttgtcagtttccattataatacattaatgagaaataacactttatttcctcttgttctgtttcagcataactctgtacagtgtattaacaagtcacatgagtaaatgggttgatgtatttttagctcttttc

SEQ ID NO: 30488 - DNA, 601 bp, Human
atcttacacctcaagtgtaggtttattgtaaaactttattagtagaatattttgaagtaaattttatttttaaaagtcaaatagagcaaagcctcaaagcaaagactgatgacaacgggtagtggtgatggagaagtgatatttccatgctagagctcatacgtatttccccagcatcccaggactaaatgacgtacagccagatttccattttggctttcctcctttccttggccctgaagctttgaacatcttttctaaatgttctgtgcctaaatcagactctttatctgtaaaacayagatgattgccttcatttaaaataatggctttgtgtcataaatgagactttagacataaagtcctttcttgacatctatgggtgatttgttccaggacctcccacagataccaaaataagccgatgccaaagtctcttatataaaaagcatagtatttggtataacctatgtacatcctcccatatattctaaattacatctggattatccataatatcaaatacaacataaagactatgtacatggttgctatacagtattatttgggaaataaggaatagcctgtacatgttcaataa

SEQ ID NO: 30489 - DNA, 601 bp, Human
gtttaacgtgaaacataacactaagttgtgtggcaggtgaaaaataaaaataaaataaaatcatatttttaactatagaatttaaagtattcaagtaaattatcaggaaggacacacttttctaaccttgaaatagtgtagaaacttatcacataaatcattattgaacaatttgtacatttataatagacttatatgaaataatattattcactgcttatacctcatatagtcctttattaaagctgatgaaataagatcaagattacaattatgtatgaggatttagaataatgccacrgacccagatatatttattttgccataatctgattcaaaagtaaaatatagatattccagaggaaataatgaaagcttggaaatgctcatcttattagctatgcttttgattgtagctgcgtggcagatattcagaattaaacttcctgcagaaaagcagtggagattttccatgttgctcatagaaaggagatccgtatgctaaaggatccaagcattgtgggagtaaaggtgacattttattatacaagttgaatatctgtcatcgtgatggagggatatgctatttgctgatatccat

SEQ ID NO: 30490 - DNA, 601 bp, Human
taaaagattaattcaacaattatggaatacacaggatctatgctgtagtgtaccagatgattatgattcatggtaagcaagataagttcactgccttcaaaatactaagaatctagagggaaagataaataggtaaatcagtgtgagaacaagacacattgagtctatgataacgaaattgtggtaataaaggatgataaaataaatgtaaactacgtaggataagagagagtgtcaaagatgcctgccaggaggaaaaagttacctttaaatatacacacgtattagccaggcaaacgtyggtgcggaattttcaggaagagggaagaccatgtgcaatggcccagaggtgaaaagcagcatgaaagcatatttctgaaactggaataagtttattattactagaacttattaataagtgcaacttagatacttttacaaatgagtaaatctaactaggatttttaaacaaaggactaataagaaaggaagctgaagaaggaggtcaaaccaagtcagcacagccttgatatctgctactacggagtttgtaatttattcaaagggggcatcattaaagggatttaatcaatgcagtgac

SEQ ID NO: 30491 - DNA, 601 bp, Human
gagatataatcttttttatatcctttatatgacttgaatattattatatcatttagttgcctccacagagacgcaaaattttttgtttaattattgtatgaagaaggatgttcaataaattttctagcccttttccacccatgttgccgcatatttgcagtcaaaagtttgcacatctgtgatacctaatctctctgcattgttcttttgtgtatcatttctgcatccaaagtaccaaggggaaataatagcctaaccattttatgtggatataaagtcttgaatgtattttattttattyttttaggaaaaaaaaaaaggtgtaacaaagcagtgtagagtggaaaaattgaagtcatgaaattacattttactttcaaatttgaatttgtttgctgatgaaaagcttgatagtgtcagacagtgccatattttaactcttaacaatttagagcactctggacttagccttcaattactgataccattttctcccctttgctttctttccagatcggttcgctatgttagcaaacaataacctgcagattctcaacatcaataaaagtgatgaaggtatatacagatgtgaaggaagagt

SEQ ID NO: 30492 - DNA, 601 bp, Human
atcttttttatatcctttatatgacttgaatattattatatcatttagttgcctccacagagacgcaaaattttttgtttaattattgtatgaagaaggatgttcaataaattttctagcccttttccacccatgttgccgcatatttgcagtcaaaagtttgcacatctgtgatacctaatctctctgcattgttcttttgtgtatcatttctgcatccaaagtaccaaggggaaataatagcctaaccattttatgtggatataaagtcttgaatgtattttattttattcttttaggaaaaaaaaaaaggtgtaacaaagcagtgtagagtggaaaaattgaagtcatgaaattacattttactttcaaatttgaatttgtttgctgatgaaaagcttgatagtgtcagacagtgccatattttaactcttaacaatttagagcactctggacttagccttcaattactgataccattttctcccctttgctttctttccagatcggttcgctatgttagcaaacaataacctgcagattctcaacatcaataaaagtgatgaaggtatatacagatgtgaaggaagagtggaggcca

SEQ ID NO: 30493 - DNA, 601 bp, Human
ggagcaatacagaactcactgtcaggaacataatcaatagtgatggtggtccttatgtctgcagggccacaaataaggcaggagaagatgaaaagcaagctttcctccaagtctttggtaagtattatagcatagtggctaaaactgttatgtctattggaagatcagagtgaaattctactctaatcatttgaactatttaaactttccatattaaatctgtttcctcttctctgtaatatgttttttaaatttcagctaccagatagaattttttgaagaataacgtaaaattacataygcaaatttttgtaagtcattgatatgcttacagaagctggaaaaaaataatttaaattacacctagtggggtttgtcatctgtgtctgtaagggtggatctctgtaagtctctaaatgacacatgttaggatcagttttacttacaatatagttcaaaagggcacatttttaaggctacaatttaaaaacattgacatgtaactatacttaaatatttgctttcatttaactaaatgaaaatataagataaatatcttccatatttaccaagagccatattatcttatttgggtaactta

SEQ ID NO: 30494 - DNA, 601 bp, Human
atagtgatggtggtccttatgtctgcagggccacaaataaggcaggagaagatgaaaagcaagctttcctccaagtctttggtaagtattatagcatagtggctaaaactgttatgtctattggaagatcagagtgaaattctactctaatcatttgaactatttaaactttccatattaaatctgtttcctcttctctgtaatatgttttttaaatttcagctaccagatagaattttttgaagaataacgtaaaattacatatgcaaatttttgtaagtcattgatatgcttacagaarctggaaaaaaataatttaaattacacctagtggggtttgtcatctgtgtctgtaagggtggatctctgtaagtctctaaatgacacatgttaggatcagttttacttacaatatagttcaaaagggcacatttttaaggctacaatttaaaaacattgacatgtaactatacttaaatatttgctttcatttaactaaatgaaaatataagataaatatcttccatatttaccaagagccatattatcttatttgggtaacttatagagcatataaaactagtactttacagaaatataa

SEQ ID NO: 30495 - DNA, 601 bp, Human
ggtccttatgtctgcagggccacaaataaggcaggagaagatgaaaagcaagctttcctccaagtctttggtaagtattatagcatagtggctaaaactgttatgtctattggaagatcagagtgaaattctactctaatcatttgaactatttaaactttccatattaaatctgtttcctcttctctgtaatatgttttttaaatttcagctaccagatagaattttttgaagaataacgtaaaattacatatgcaaatttttgtaagtcattgatatgcttacagaagctggaaaaaawtaatttaaattacacctagtggggtttgtcatctgtgtctgtaagggtggatctctgtaagtctctaaatgacacatgttaggatcagttttacttacaatatagttcaaaagggcacatttttaaggctacaatttaaaaacattgacatgtaactatacttaaatatttgctttcatttaactaaatgaaaatataagataaatatcttccatatttaccaagagccatattatcttatttgggtaacttatagagcatataaaactagtactttacagaaatataatgacgtagctt

SEQ ID NO: 30496 - DNA, 601 bp, Human
aaaagagggaaaaggaaggaaggagaaatctgttagaataagaaggactggggcctgttgtggggtggggggagtggggagggatagcatttggagatatacctaatgttaaatgatgagtaactgggtgcagcacaccaacatggcacatgtatacatatgtaactaacctgcacgttgtgcacatgtaccctaaaaaagtataataaaaaaaaaaagaaggaccagtgtttgcagttgacaggtgcagagtgccccttacactgaccatgagatgaatggtaatccctgcgtggacacrccctctgcagactggccctgtagtcactgctggaagcattttctgagctagagagatatttataaagcttattttcaagtggagtgacaaggagaataaacagctataccaaaatgtattaaaataaaaaatacaattttaaaagtagagatgttttgagaaagaaattggataaatcaggaagcattgaataaagagaagtattgttttggatagcatagtgtttggaaagttattcagcaggataatgtttaggtgatgttcagaatgatgatcttctaatgatcagaagtaggccaa

SEQ ID NO: 30497 - DNA, 601 bp, Human
aacctacaaaattaaataagtatgattcagtataaaaataatcatattagaaatagtattgtgtgagattattccaaaggatagatggtcttaatctgcctcagtgtactcatctgaaatagtatttacatcgtttttatcaggattgcagtgaaaaagaaaaaagattttttacatttctgatattttcatcctttcaagtagaacataatacatgaaaattttacatgttatgttattgttataatcccttttgtgtagtaacattcaacaaacttttgttgctcctgacacaaaattrtatgcatattgtgggaatataactaaatctattaaagttaatgaaataaagagtgaattgttaaaaattctgtatgctgtttttctgataccaagaatgttattttctgagcttaagaacaacttatttgtgtttctttgttaaatgtattaaaatatataaaaagtaactcacactgaaataatgagtacttgattgtatccattttatatctaaacaagcaaacatttaggaaatacaaataacacagatttcaaaaaataaagctctctggaactatgtaagtttatggagggacat

SEQ ID NO: 30498 - DNA, 601 bp, Human
tcctcattgatgccatttagactttaaaaaaattcgtttgataggaggatttagccatcatgtctgcaaatacttgcatagctggctggttggtaattaaaccgctatgtctaaatcaatttcaatataaataagtttctttggaaatattttagaagaattagctatttgtgacttgacagggatgtcaatttcataaaaacatctggacagttttaatctaaattttatgtgttttaccttagtgaaaagctcaggttagatttaacttgttttgtgtagtgtgtagtctccttgaatmctttaataaaatactatagacaggatggttgaaatcacagaaatttgttctgagttctggaggatagaggttcaatatcatggtgcctgccaggttgctttctatagaggactcttccctggacttgtacttggccgccttcttgctgtgtcctcacatgccctttcctctgtgcgcacacagagttctggtgtcttccttttcttgtaaggataccagtcctgttggattaggtcccactcttattacctcgtttaaccttaattaccttcttaaagatcctatctccaaattcattca

SEQ ID NO: 30499 - DNA, 601 bp, Human
agttctggaggatagaggttcaatatcatggtgcctgccaggttgctttctatagaggactcttccctggacttgtacttggccgccttcttgctgtgtcctcacatgccctttcctctgtgcgcacacagagttctggtgtcttccttttcttgtaaggataccagtcctgttggattaggtcccactcttattacctcgtttaaccttaattaccttcttaaagatcctatctccaaattcattcacaccggaatttagggtttcagtatatgaatgggcagagtgaggaggcgggcakttcagtccatagaaagtagattgaatttcgtgagtaaatgacagactaatgtgtaatttctgctttacttcatcttgacattttttagttcctcagccaactcataattctctatatttaatgtgaagggacattttatacatacaacatagtatatagtgtatgctatttaaacttctgcctaaagacatccctctgcactccaaaataaaattttaaaaaacccacaatttttgcctacttgacacacagccaggtgatctgttggctaaaccactgactttaaacagacatgtttat

SEQ ID NO: 30500 - DNA, 601 bp, Human
ggtttaagaaaaagactagcaagcttcttgattaatattatacacttagcttatatttagatattcaaaactatatttgttagttcactatactctgtccaaacctaatatcattaattaatatcagcatttttagctggatacagatataccttggagatattgcaggtttagttccaagagcacctcaataaagtaaatatctctataaagccagtcacacaaatttttgcttttttcagtgcatataaaagttatgttggcactatagtctattaagtgtgcaaaagcatgatgtataaaaaggtctacataacataactgaaaaataattactaaaattttctgggaataatttgagatttaagcaagttgtaacttttttcattggtgaagcgttttgtcgcaaggttgatggctgcttactgatcagaatgttgattgctgaaggttggagtggctgtggcagtttattaaaataaggcaacagtgaagcactttgttaattaacacttcctttcatgaaagatctctgtgtagcaggtgatgctataaggctaacagcatataatactgtttgttaggaattacctatagcaga

SEQ ID NO: 30501 - DNA, 601 bp, Human
ttagctggatacagatataccttggagatattgcaggtttagttccaagagcacctcaataaagtaaatatctctataaagccagtcacacaaatttttgcttttttcagtgcatataaaagttatgttggcactatagtctattaagtgtgcaaaagcatgatgtataaaaaggtctacataacataactgaaaaataattactaaaattttctgggaataatttgagatttaagcaagttgtaacttttttcattggtgaagcgttttgtcgcaaggttgatggctgcttactgatcakaatgttgattgctgaaggttggagtggctgtggcagtttattaaaataaggcaacagtgaagcactttgttaattaacacttcctttcatgaaagatctctgtgtagcaggtgatgctataaggctaacagcatataatactgtttgttaggaattacctatagcagaacatctttcaaaaatgaagtaaatcctctcaaaccctgtcaccgctttatcaactaagtttatgtaatattctaaatctttggttatcatttcaacatttttcaggcatcttcagcaggagtaaattctacc

SEQ ID NO: 30502 - DNA, 601 bp, Human
tttggttatcatttcaacatttttcaggcatcttcagcaggagtaaattctaccaccagaaaccactttatttgctcctccatgaagagcaattttcccatctgttagagttttatcatcagattgcagcaattcattcacttcttcaggctccatttctaattctagctctctatttccaccgcatctgcagttacttccttcactgaagtcttgaacccctcaaagtcatccatgagggttggaatcaacttcttccaaattcttattaatgttgatattttcactttctcccatgagycacaaatattcttaatggcgtcagcatggtgaatccttttcagaagattttcagttgacttttcccagatccgtcagaggaatcactgttttatggcagctgaagccttaaatattgtatttctgttttttgttgtgtgttttttttttttttttgagagggagtctcgctctgtcgcccaggctggagtgcaatggcacgatctccactcactgcacctccgcttcccgggttcacaccattctcctgcctcaccctcccgagtagctgggattacaggtgcctgccaccacgcccggc

SEQ ID NO: 30503 - DNA, 601 bp, Human
tttctagatggacagctgactagaaaacgaatgacacagcttttctgtactctttcagaattatcatcttcaatgggcctcaaaattgcactcttagttaatagcctcccattactacaaaatcatttttccctcttttgggatagagttgaaattaacagcaactcttgtaggcatattctctcttaataatagttacagagattgaaaattatatctattactatcatcaaatctcttatctaaattgatacttcagaatttctgtacattagaattacagggtttgtctcagtgttcrccaatagaatccccgaaggttaacttaattatggatttcaaatgtttaaggatagaggtcagctattttctacctagagtgaaaaagaatggtaggaattgaacagaaatggaagcaagatactgttattagatagcgagaaaaagtgcctgtctatgagtattgttgcaaagagtaacattttattgcacagtatgttcctggaaagatttcattaagaatgatccttcctccttcgttagtattatatgttcaataaactcaaaacagggagagaaatatcacatatctggagacttt

SEQ ID NO: 30504 - DNA, 601 bp, Human
gtactctttcagaattatcatcttcaatgggcctcaaaattgcactcttagttaatagcctcccattactacaaaatcatttttccctcttttgggatagagttgaaattaacagcaactcttgtaggcatattctctcttaataatagttacagagattgaaaattatatctattactatcatcaaatctcttatctaaattgatacttcagaatttctgtacattagaattacagggtttgtctcagtgttcaccaatagaatccccgaaggttaacttaattatggatttcaaatgtwtaaggatagaggtcagctattttctacctagagtgaaaaagaatggtaggaattgaacagaaatggaagcaagatactgttattagatagcgagaaaaagtgcctgtctatgagtattgttgcaaagagtaacattttattgcacagtatgttcctggaaagatttcattaagaatgatccttcctccttcgttagtattatatgttcaataaactcaaaacagggagagaaatatcacatatctggagactttgttgaacattaaagcaaactgatctgaggccaaaacataaaaaaca

SEQ ID NO: 30505 - DNA, 601 bp, Human
gagtatctctctcttggtaatcataaaatctgtcaggtaagtttcttttctccattcccaatgctggtggttaagataaccagccagatatggtggcttacacctgtaatcccagcattttggaaggctgaggcaggcagatcacttgaaccaagaagctcaagaccagcctgggtgatatagtaaaaccctatctctccaaaaaacaataaaaaaagaatcagctgggtgtggtggtatgcacttgtactcccagctacttgggaggctgaggtgagaggtgagatcacctgagtctgckgaagtcaaggctgaaatgagccatgatcacactatggaactccatcctgggtgacagagtgaaaccctgcctcaaaaaaagaatgaagaaaagaaagaaagaaaaaagaaatgacaataacctgctgagaagaaataacaggtcattccggtttagagatatgaaatccttttcagtgcatggtctgtttttcttggcccttcacatagaaaattcttgcactttggtagatccctgttctattcaaaacaatataagcatcattgttatatggctatctctatgttgaagtataatatc

SEQ ID NO: 30506 - DNA, 601 bp, Human
gaaccaagaagctcaagaccagcctgggtgatatagtaaaaccctatctctccaaaaaacaataaaaaaagaatcagctgggtgtggtggtatgcacttgtactcccagctacttgggaggctgaggtgagaggtgagatcacctgagtctgctgaagtcaaggctgaaatgagccatgatcacactatggaactccatcctgggtgacagagtgaaaccctgcctcaaaaaaagaatgaagaaaagaaagaaagaaaaaagaaatgacaataacctgctgagaagaaataacaggtcatkccggtttagagatatgaaatccttttcagtgcatggtctgtttttcttggcccttcacatagaaaattcttgcactttggtagatccctgttctattcaaaacaatataagcatcattgttatatggctatctctatgttgaagtataatatcaaaggcaagtatatgaatgaacctagaagaaaatgaaatattgaaacacaggtctataaaattggatactgcaaactttattcaaatttgcacccaggaaagaaaatgcttattaaagcacatttactaattgcaagtcattatctt

SEQ ID NO: 30507 - DNA, 601 bp, Human
gaaaatgatcagaaattatatcacaaaagggcaatgtcaaatggtaaatccaggataacaccatatattttgattacattactgttctttttattaaaatatagtttctctaggtatctgaaatgtgtgcaaatgaagaaatgttgtattgtatatctaggtgaaccaagtcctccatccatacatggacagccaagcagtggaaagagctttaaactcagcatcaccaaacaggacgatggaggggcccctattttggaatacattgtgaaatatagaagtgtaagtaccttgtttattrtcatatcatgctaggttttttcaaattaaattgagttgcactgaatttataaacatatcaggagagaatgtgtatttagtaattgtggtaataaatgctaatcttccttccattcctgacagtcatcattgtgatttatttttattttttttgtaaaatgtaagcatggatcatcaaagtattctcatggttttcatcttatgatttttaggtgtgaaatgggactagtaaacatttcagaaatgagatattatttcccctgttttgctgacaagcttctcattttatttgatattagta

SEQ ID NO: 30508 - DNA, 601 bp, Human
aaatgttgtattgtatatctaggtgaaccaagtcctccatccatacatggacagccaagcagtggaaagagctttaaactcagcatcaccaaacaggacgatggaggggcccctattttggaatacattgtgaaatatagaagtgtaagtaccttgtttattatcatatcatgctaggttttttcaaattaaattgagttgcactgaatttataaacatatcaggagagaatgtgtatttagtaattgtggtaataaatgctaatcttccttccattcctgacagtcatcattgtgatttwtttttattttttttgtaaaatgtaagcatggatcatcaaagtattctcatggttttcatcttatgatttttaggtgtgaaatgggactagtaaacatttcagaaatgagatattatttcccctgttttgctgacaagcttctcattttatttgatattagtaacttcaggctaagtccctggcaatcatatgttaggtaatattattagaaaaatcacacctcaaaacaaattaatcaaataatttgacttacttatccatcatgtttaacaaagaatggccacggtgaacttgatgaag

SEQ ID NO: 30509 - DNA, 601 bp, Human
gtgaaccaagtcctccatccatacatggacagccaagcagtggaaagagctttaaactcagcatcaccaaacaggacgatggaggggcccctattttggaatacattgtgaaatatagaagtgtaagtaccttgtttattatcatatcatgctaggttttttcaaattaaattgagttgcactgaatttataaacatatcaggagagaatgtgtatttagtaattgtggtaataaatgctaatcttccttccattcctgacagtcatcattgtgatttatttttattttttttgtaaaatstaagcatggatcatcaaagtattctcatggttttcatcttatgatttttaggtgtgaaatgggactagtaaacatttcagaaatgagatattatttcccctgttttgctgacaagcttctcattttatttgatattagtaacttcaggctaagtccctggcaatcatatgttaggtaatattattagaaaaatcacacctcaaaacaaattaatcaaataatttgacttacttatccatcatgtttaacaaagaatggccacggtgaacttgatgaagagggaatccttttcttcaactt

SEQ ID NO: 30510 - DNA, 601 bp, Human
gactagtaaacatttcagaaatgagatattatttcccctgttttgctgacaagcttctcattttatttgatattagtaacttcaggctaagtccctggcaatcatatgttaggtaatattattagaaaaatcacacctcaaaacaaattaatcaaataatttgacttacttatccatcatgtttaacaaagaatggccacggtgaacttgatgaagagggaatccttttcttcaactttaattagcactatccagtaaggatgtttggagagctaaaagctgcacacagatttttgatagmggttagaggtaaacaatgttcactagttgcagagtcatagagtgacactatggacaactgcgttttgccttcagaaaagatgatttcaaaagccactgaaaataatttcttcaacatttttttccataagtaccttggagtattggtgtctactgtaaaataagttaaaaatgaaacacaattttaagttaaattttctaagattcatacaacatgcgttttatgcttatgttgactgaatccatattagtgctatccaaattaattatattttagcagatcatgtttaaaataattact

SEQ ID NO: 30511 - DNA, 601 bp, Human
gacaagcttctcattttatttgatattagtaacttcaggctaagtccctggcaatcatatgttaggtaatattattagaaaaatcacacctcaaaacaaattaatcaaataatttgacttacttatccatcatgtttaacaaagaatggccacggtgaacttgatgaagagggaatccttttcttcaactttaattagcactatccagtaaggatgtttggagagctaaaagctgcacacagatttttgatagcggttagaggtaaacaatgttcactagttgcagagtcatagagtgaccctatggacaactgcgttttgccttcagaaaagatgatttcaaaagccactgaaaataatttcttcaacatttttttccataagtaccttggagtattggtgtctactgtaaaataagttaaaaatgaaacacaattttaagttaaattttctaagattcatacaacatgcgttttatgcttatgttgactgaatccatattagtgctatccaaattaattatattttagcagatcatgtttaaaataattactccatagtagtgtgtgggttaattttcagtattttctcatcaattttc

SEQ ID NO: 30512 - DNA, 601 bp, Human
acaagcttctcattttatttgatattagtaacttcaggctaagtccctggcaatcatatgttaggtaatattattagaaaaatcacacctcaaaacaaattaatcaaataatttgacttacttatccatcatgtttaacaaagaatggccacggtgaacttgatgaagagggaatccttttcttcaactttaattagcactatccagtaaggatgtttggagagctaaaagctgcacacagatttttgatagcggttagaggtaaacaatgttcactagttgcagagtcatagagtgacattatggacaactgcgttttgccttcagaaaagatgatttcaaaagccactgaaaataatttcttcaacatttttttccataagtaccttggagtattggtgtctactgtaaaataagttaaaaatgaaacacaattttaagttaaattttctaagattcatacaacatgcgttttatgcttatgttgactgaatccatattagtgctatccaaattaattatattttagcagatcatgtttaaaataattactccatagtagtgtgtgggttaattttcagtattttctcatcaattttct

SEQ ID NO: 30513 - DNA, 601 bp, Human
ctgcacacagatttttgatagcggttagaggtaaacaatgttcactagttgcagagtcatagagtgacactatggacaactgcgttttgccttcagaaaagatgatttcaaaagccactgaaaataatttcttcaacatttttttccataagtaccttggagtattggtgtctactgtaaaataagttaaaaatgaaacacaattttaagttaaattttctaagattcatacaacatgcgttttatgcttatgttgactgaatccatattagtgctatccaaattaattatattttagcakatcatgtttaaaataattactccatagtagtgtgtgggttaattttcagtattttctcatcaattttctaaattataatactgctgcttctaaatggaaagatctacattctgaggggtaataaaaaagaaaaatttgattttgaatggcatattttaataattaattttagatatcaaatcaatttttaaaatttaagattaatactcctttcagaggacaagtttttgtcccagctttcatactcaagtgaggtctcctggccattctcatttgcacatttgtaaacacggtagaaga

SEQ ID NO: 30514 - DNA, 601 bp, Human
agagtgacactatggacaactgcgttttgccttcagaaaagatgatttcaaaagccactgaaaataatttcttcaacatttttttccataagtaccttggagtattggtgtctactgtaaaataagttaaaaatgaaacacaattttaagttaaattttctaagattcatacaacatgcgttttatgcttatgttgactgaatccatattagtgctatccaaattaattatattttagcagatcatgtttaaaataattactccatagtagtgtgtgggttaattttcagtattttctcaycaattttctaaattataatactgctgcttctaaatggaaagatctacattctgaggggtaataaaaaagaaaaatttgattttgaatggcatattttaataattaattttagatatcaaatcaatttttaaaatttaagattaatactcctttcagaggacaagtttttgtcccagctttcatactcaagtgaggtctcctggccattctcatttgcacatttgtaaacacggtagaagagagataatcttttctagggaggtaggcttggccagaattcatgaattggactgttagaac

SEQ ID NO: 30515 - DNA, 601 bp, Human
aatttaagattaatactcctttcagaggacaagtttttgtcccagctttcatactcaagtgaggtctcctggccattctcatttgcacatttgtaaacacggtagaagagagataatcttttctagggaggtaggcttggccagaattcatgaattggactgttagaacaggctttccatgcagattgttgctcacaattctaggatgaaaaaatttattgtacaaaatactgggggatagtaacagtttgtaaggaattctaatacaatcccacagtggactctaaaatgcaatgactasttgtgagacaacgtgttgtatatttttatttgtactgtattgtcagtagtggccccagtcattgatgtaatcaaaaatatttcttgagtagcactgcatctatttagagcaaagcagagtcacaaatggaaataatgacattttagacagccatatatttatgtatacatatacacagtttaaaacataaattactattttaaaaatctgacttcaaattcatattgatttctttaaatgtggattagaattaatcttttttgagaagttatgtgtgaaacacagatggatagaaataag

SEQ ID NO: 30516 - DNA, 601 bp, Human
cttaagaaaacattttccagttaataatgtttatgtatgtacatggaaatttatttaaagccattatagtttaagttttgaagtatttttaaacaatgaatacttatggacattaaagagtagcaagcattttagtaatttttctttgctgtaagttaagaggatgagttttattcttctttgtatagatagactatgtgttgtctgaatgaacaaatacagcaagaaatcaataaagaaattagctcactatgcaattataaatagtattataaatagaataattaatatgagaaataaraaacacaagaaaaaatgcactgccaatgtttatagatatgagaacacagaaggtaatgaataggaaaattagatttattttgccttaagtactatgtgggtggtggagactagcaacagattatgtagggcctaattttaaaaaagtttaccaagcatcagcacatggaacaaaggcaagtagaatctgttatgatcatggaaaaagagatttaaatttagaactcggctaaaatcttcaaacctttaaatcttccaaatgtatatatatacatatatgtacacacacacacacacacac

SEQ ID NO: 30517 - DNA, 601 bp, Human
atgcactgccaatgtttatagatatgagaacacagaaggtaatgaataggaaaattagatttattttgccttaagtactatgtgggtggtggagactagcaacagattatgtagggcctaattttaaaaaagtttaccaagcatcagcacatggaacaaaggcaagtagaatctgttatgatcatggaaaaagagatttaaatttagaactcggctaaaatcttcaaacctttaaatcttccaaatgtatatatatacatatatgtacacacacacacacacacacacacacgcacacatccacacacacacacgtatatataattttatatacaattcggtgttttaaatttaagattaatatctttctcagaggacaactttttgtcccaggtttcatgctaacaatgatgagtacctgtttgtttcttttggatattctgatatggagacttttgtgcctctacccaggacagctctgaaggactcactggtctctcgatgaatctgacagtgccatggtattcaagccaggtcccttgatgcttctcgtttgcccatttgtaaactcttcttgaattctgtatatggtctatctgta

SEQ ID NO: 30518 - DNA, 601 bp, Human
actctaatcagaactctttctctacagtttgatgcttgaggtgacacattgcttttatgaccttgtattgtcaatattttcagtacttgtgaatgctaaaaaggaataactgagactgcactatttataacatatataaaatagcctgctctcgttggtacaatgttttttaatgtttttttcattcccagcaatggatattactagtttttgcctattacttcttttgattagttctgattgctttgatctgcagaatgttttacccttctcattcaaaaatataaaataaattacaaayaaatcccagatgaactagcattgtaactttcactccattataacatggtaaggttaaagtcacagagatggattggaatactatttctttcttttttttttttttccgagactagtttcgctcttgttgcccaggctggagtgcaatggcgcaatctcagctcacctcaacctccgcctcccaggttcaagcaattctcctgtctcagcctcccgaatagctgggattacaggcgcacgctgccacaccaggttaatttggtattttagtaaagacaggctttctccatgttggtcaggc

SEQ ID NO: 30519 - DNA, 601 bp, Human
taactgagactgcactatttataacatatataaaatagcctgctctcgttggtacaatgttttttaatgtttttttcattcccagcaatggatattactagtttttgcctattacttcttttgattagttctgattgctttgatctgcagaatgttttacccttctcattcaaaaatataaaataaattacaaataaatcccagatgaactagcattgtaactttcactccattataacatggtaaggttaaagtcacagagatggattggaatactatttctttcttttttttttttttycgagactagtttcgctcttgttgcccaggctggagtgcaatggcgcaatctcagctcacctcaacctccgcctcccaggttcaagcaattctcctgtctcagcctcccgaatagctgggattacaggcgcacgctgccacaccaggttaatttggtattttagtaaagacaggctttctccatgttggtcaggccggtctccaactcctgacctcatgtgatccgcccgccttggcctcccaaagtgctaggattagaggcgtgagccactgcgcctggcctggaatactatttctaact

SEQ ID NO: 30520 - DNA, 601 bp, Human
caatctcagctcacctcaacctccgcctcccaggttcaagcaattctcctgtctcagcctcccgaatagctgggattacaggcgcacgctgccacaccaggttaatttggtattttagtaaagacaggctttctccatgttggtcaggccggtctccaactcctgacctcatgtgatccgcccgccttggcctcccaaagtgctaggattagaggcgtgagccactgcgcctggcctggaatactatttctaacttaattttcttggtgtggaaaaagtatgttgttaagggagaaaaacycatctccaaatgtcatgtacacaatagtaaacaattgaatttgcaagttttaggaaaatcttgaaagcacaattcattggcatcgaagtagggtttatgacgctgtcttgatattaagaaataaagttggtattgcttcataagttacaattgcaaacaactcaaaatccgtgttgcaaagtgacataaaagtgacaagaaaaacaatgtgaaaagagacaaaagaaaacatatacaataaatattaaaaagtgagcaagtcctaaaatatgttcatttgcattaagttctaaggaatat

SEQ ID NO: 30521 - DNA, 601 bp, Human
aatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgtgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcmaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaa

SEQ ID NO: 30522 - DNA, 601 bp, Human
tgagatggagtctcactctgtcgcccaggctggagtgcagtggtgcaatctcggctcactgcaagctctgcctcccgggttcacaccattctcctgcctcagcctccagagtagctgggactacaggcgcccgccaccacacccggctaattttttgtatttttagtagagacggggtttcactgtgttagccaggatggtctcgacctcctgaccttgtgatccacccgcctccgcctcccaaagtgctgggattacaggcgtgagccaccgcgcccggccgccttctgctctttatagrtgcatgccaatcccttcattttctaggagcactgctgcatgcaatggagtaataaggacacgctgggtaaattatttattttctctgcaggaagccactgatacagcactaaggacttgtactgagctaagccagcacctgcggctctgggatgtgttcaagcaccgtcttgtttgtattaatgaaaacttcctgaaggacataactgaaaagagagaggcttgagtgcccatcctgggatggccgggcttccctcccgcaagtcagctctgggcaacctgccagccagggcgtagctga

SEQ ID NO: 30523 - DNA, 601 bp, Human
ctagagaagctctttccttccatcccatcagtgccttctgctcttttttttttttttttttttttttgagatggagtctcactctgtcgcccaggctggagtgcagtggtgcaatctcggctcactgcaagctctgcctcccgggttcacaccattctcctgcctcagcctccagagtagctgggactacaggcgcccgccaccacacccggctaattttttgtatttttagtagagacggggtttcactgtgttagccaggatggtctcgacctcctgaccttgtgatccacccgcctcmgcctcccaaagtgctgggattacaggcgtgagccaccgcgcccggccgccttctgctctttataggtgcatgccaatcccttcattttctaggagcactgctgcatgcaatggagtaataaggacacgctgggtaaattatttattttctctgcaggaagccactgatacagcactaaggacttgtactgagctaagccagcacctgcggctctgggatgtgttcaagcaccgtcttgtttgtattaatgaaaacttcctgaaggacataactgaaaagagagaggcttgagtgcccatc

SEQ ID NO: 30524 - DNA, 601 bp, Human
agctgaggcaggagaatctcttgaactcgggaggtggaggttgcagtgaaccgagattacgccattgcaccccagcctgggctacagatcaagactgtctaatctctgtgctttacacccttgtcagcgaaataccaggcctgtttatcccaaaccatcacatatcttctcctgggaagggcccttccgtgttctttccctcccacttcccagtgcacccagtggtggtggagactagagaagctctttccttccatcccatcagtgccttctgctcttttttttttttttttttttttttgagatggagtctcactctgtcgcccaggctggagtgcagtggtgcaatctcggctcactgcaagctctgcctcccgggttcacaccattctcctgcctcagcctccagagtagctgggactacaggcgcccgccaccacacccggctaattttttgtatttttagtagagacggggtttcactgtgttagccaggatggtctcgacctcctgaccttgtgatccacccgcctccgcctcccaaagtgctgggattacaggcgtgagccaccgcgcccggccgccttctgctctttatagg

SEQ ID NO: 30525 - DNA, 601 bp, Human
ttcatccacacgaatcagagcacgtctcacggagcgtgtttgatgcaccgtctctgttactcctcctgcccatgctgtgaggaagtcccattgaaacccatcttatgaacgagcaaactggtgctcacacagccacagtccatggcagagtcctaactcctgcaacactgcagtgccgggctgtgtgaagctttaccaccgatttatcacaaaataaaccaatctttctcatactgaggcctttagacacttcgatgattttcagtttacgctaatataaataatgctgcagttggcaccytttttcctaaaatgtgtgtgggggtgtgggtgtgtttgcctattatatatttcaggttagtcctttaggatagattttcaaaggtagaattattgggtcaaataatataaagtctttatataggtattgccaaagtggtttccagaaaagttacgctaacttatgatgtcctcaccaaccttgagaattattattaaaaaacaaaacaaacaaaaattaaggccgggcacagtggctcacacccgtaatcccagcttggctttgggaggccaaggcgggtagatcacctgaggtcaggag

SEQ ID NO: 30526 - DNA, 601 bp, Human
tgctttgtgaaatttgagctgtccattgaacaatcagtggagacactaaggaagcagctggctattggagtcggaccgaggggcgagatgagggtggggtgtagatttgggagccatcagtatgtggatagtatttaaggccacaagactgggctgtatgttatgtgtcacaaaggtgaagtgtctcaggtgtccccacaagccgacagtaagtgctgaaccaaacaaccacggaggagagaaacagaaagcaacaggtccaggttcgctgaccacttcctttttttttttttttttttttgagacagagtcttgctctgtcactcaggctggagtgcaatggcatgatctcagctcactgcaaattccgcctcccaggttcaagtaattctcctgcctcaggttcccaagcagttgggactacaggcatgtaccaccatgcccagctaacttttctatttttagtggagacggggtttcgccatgttggccaggctggtctcgaactcctgacctcaggtgatccgcctgccttggcctcccaaagtgctgggattaccggtgtgagccaccactcccagcctcgctgaccacttcttat

SEQ ID NO: 30527 - DNA, 601 bp, Human
agctaagttttaattcagcaaatattttttgtccgggctctcttctgggattggagcctagacggtcaaggtccctgatctcaccggcttatgttctaaagagcgacagatggggaacatgtaaatgaacaaattaagcaatgatctgggaaggaagtggtgctatgaaattattattaaactggtgggtgggactcgttgggtaaagggggaagcagacactgagatggaaagggaggagggcagactgggcagaggagaagcccagctcgggcacagcctaagaggcctgagctgacgyccaggagctctggggatggggcagctctcagggtggtcctgaatttcgttagtgggttgggtattatgaccaaccagtagtcatgggacatgagctctccggggaaggggagggagccagaactaattgtcttggcagaggtgatttcccagagggctcaaggccatccacaggcaggccccctgcagagggaatggcagtgcctccccctcgagagatgggatggtgttgacagtgccccccaacaggagggcaggggtctttggcagggtggtaaggggcggtctgactgagaagagg

SEQ ID NO: 30528 - DNA, 601 bp, Human
atttccaagaaatagcccgacagggagaaactttcctacagtcacgaaccatttgactcctacaactccatctttggaggctgccagcatgttctgagtccagggcagatccgatgaataattttcctgcttctcatcctagaatatctgcctgcctcacaggatcaagtccaagccccaaacctgccattcagggacctcaattctgcatcctacctactgcttcagctgaggctcctgcgtgcggtgcctggaacacgagcagcaggggctgcctccgcacaccggcgcgcgcacaccyggtgtctttgctcatgcagtcctggggcctaggacgcctcctcctgctcttccttgccttgctcatatctgctcattcttcaattcttggctggtatcatctcttccaggaagcctcctcctccgggtctgtgtgccctgatagcttgcttcctctatgttattttattaaaaagatcggtttatgtgtatatctctaaactttacaagctaagtttttgtgtgtttgtgttttatttattctttttgagacggagtctcactgtgtcacccaggccgaagtgcaatggtgcaatcttgg

SEQ ID NO: 30529 - DNA, 601 bp, Human
gctctttctatagtgccacttacttggcttggccaaattcataaaacaggaactgggatagcatattgtaattattattatttctatttttttttttgagatggagttttgctcttgtcgtccaggctggagtgcagtggcgagatcttggctcactgcaacccccacctcccaggttcaagtgattctctggcctcagcctcccgagtagctgggattacaggcgcccaccaacatgcccagctaatttttgaatttttcgtagagacagggttttgccatgttggccaggctggtctcraactcctgacctcaagtcatcctcccgcctcggcctcccaaagtgctgggattacaggcgtgagctaccgcacccagccagcatattatttttaatagggaatatgttccttaatgctatccaaaattttaattaagatgagagggatagaaaggaagtaattaataatgctaggtgttctatgtatattatctcatttgcttcccaaagcactttgagataagagcatcactctgctatagaatttccccaaggtgaagcacttttaaatggtgaagacaatgatctcaccaaggtctg

SEQ ID NO: 30530 - DNA, 601 bp, Human
ttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatataaatatattttatatatttatatttaaaatatatataaatatattttatatatttatatttaaaatatatataaatatattttatatatttatatttaaaatatatataaatatattttatatatttatatttaaaatatatataaatatattttatatatttatatttaaaatatatataaatatatttttatatatttatatttaaaatatatataaatatatttttatatatttatatttaaaatatatataaatatatttatatttaaatatattgataaaatttgatgatataacctaatataatgtataataatttaaatatattttgatttatttttgctctttctatagtgccacttacttggcttggccaaattcataaaacaggaactgggatagcatattgtaattat

SEQ ID NO: 30531 - DNA, 601 bp, Human
tatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatataaatatattttatatatttatatttaaaatatatataaatatattttatatatttatatttaaaatatatataaatatattttatatatttatatttaaaatatatataaatatattttatatatttatatttaaaatatatataaatatattttatatatttatatttaaaatatatataaatatatttttatatatttatatttaaaatatatataaatatatttttatatatttatatttaaaatatatataaatatatttatatttaaatatattgataaaatttgatgatataacctaatataatgtataataatttaaatata

SEQ ID NO: 30532 - DNA, 601 bp, Human
aagcacaatagggcagctctaaagtgatgatattcattaagaaatgaatgaaattgaagcatgtcacttttgtcgggaacaaattttatttgtaaatctgactttattctcctgaaaggggatttagagacaaacacttcatgtttcatagataggggtcaattcctcatttaaatatattcaaatattaatatatttatatttaaaatatataaatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatataaatatattttatatatttatatttaaaatatatataaatatattttatatatttatatttaaaatatatat

SEQ ID NO: 30533 - DNA, 601 bp, Human
gacatcactttctgagcgaataatcacaagcaatacaagggcagagagaaacttaactgaggggaaaaacttcataaagcacaatagggcagctctaaagtgatgatattcattaagaaatgaatgaaattgaagcatgtcacttttgtcgggaacaaattttatttgtaaatctgactttattctcctgaaaggggatttagagacaaacacttcatgtttcatagataggggtcaattcctcatttaaatatattcaaatattaatatatttatatttaaaatatataaatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatat

SEQ ID NO: 30534 - DNA, 601 bp, Human
gcctagacatcactttctgagcgaataatcacaagcaatacaagggcagagagaaacttaactgaggggaaaaacttcataaagcacaatagggcagctctaaagtgatgatattcattaagaaatgaatgaaattgaagcatgtcacttttgtcgggaacaaattttatttgtaaatctgactttattctcctgaaaggggatttagagacaaacacttcatgtttcatagataggggtcaattcctcatttaaatatattcaaatattaatatatttatatttaaaatatataaatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaa

SEQ ID NO: 30535 - DNA, 601 bp, Human
gtctgttgtcaccgtggggccatgttggagtcggtagattttcagacagtgaagccacatgaagctgtgaatgctgatgtggctgctgcagagcccagtctctccccggtgcagggcctctgagacgacgggactgtcctcagatggttggaagaaatgggttatcttaggcagttaggaaaagagggacaggtgtcccaggatgtggaaaacttgagttcatcccctctcttccctccagcaaggatttcagtgctacatctaaaaagagaagccctgttgccgatttaataatttacartctctaaatccaaaagggcctccatgtgctagtgagactcatgccctcagttatgttcacgatcttcctgagaagtcagacaatacaggtagaacaaaagatagtggttgtactttctcttctgcgtagtgtgggtaagagcatgcggtttgccgcatgcagtgttgttaatcttttgattgtgttgtgaatggctgaaaaaaaagctgaaagtttgattgaactgaaatccaatccatgtcaacataaggaatattctagtgagtttactgtcctaagagaaggtctctcctggggaac

SEQ ID NO: 30536 - DNA, 601 bp, Human
ctgctagtgctattagtaagatgaccgaatccactcttctgtctgtgcacccttcaagaaaatatttgctattttacactcgcgaattccccaactacatctatttgaaaacagtggtttatatatgggggcggagttgatagaaagtctgtttgtgcttttatttaggtttcggggctccaggttataactcaacgccctcccgtcagccaaaacgtctagaagctgggccgtaattgccattatttccccagtcctgcagttccacctcacagttaggtgggcagaaatgtatgaaacrgaataccctttcctcgtcttctgggccgtgtggaggggctgctgagccactgagctctctcccctaatctggttggatgtggacccagtcggagcccctcttcggtggcaagaaccaccgtcaacccgggcgaaagcccaacgtcttccacggcagccccagcgcagcatgggcgccgccattgtaactccagggtcttggtcaggtgactcagcctcactatgccgcgaggctccctgggaagcgtagttctggaaatgcattaaaaacgccataggctcggaccggaagactactatt

SEQ ID NO: 30537 - DNA, 601 bp, Human
ctgacttcagtgaaaagcggcatttaacaaattaactgtaacttatcaagtaatcactcagtaaatgatgaaagctgatctttcccacattatctagaattaacataaatggcaacattctactactagagaaataatgataaatagttccacgtctcttatttaaaaaggaaattctcaaccatgttttggtttgcatgtataataaccagagagacacagatacaataaatcaccactaaatgatactcttaaaaaaattttgcaaaactccaccacactaaaccatctgatgcggcayatttttggtcccccaaatcactttcaattcctgagacctaatttcaggttacttttttaatgcttatttgctatcaaatctaagaagctgttaaatgctataataatctctcttatctggtcagtcctactctgttgggtctgtacataggcctctccaggtccttataaatgtgcttattccctatgaaatccatgtatgttcctatcctgctcttctcccaagtaattttgtgtatatacatatatatatatatacatattttacatcgttttgttttgtttcaatcatttcaacata

SEQ ID NO: 30538 - DNA, 601 bp, Human
aaagcgggtcaatatggagtttactgctcagccaagtaactggaccaacagtttactgttcttggtccagatttctggttcatgtttccgcttactattgtccacttacttgctccttgtgagatgacagaaatgtctccaaaggagacagccctattattgggaacttcaacttaaaagcgattcgctctcgctctgctgacagaactacagtatgcatttactgttgcatcagccagagccttagcttttgtactaacaggcaattagcaccaaataccacggccaggctgagcctgcraacactggcttctactccctgtgcaattatgagcgagccaccagaagcatgaggtaagcaagaagtcagcaatcaggacaactgcatccgatctagtaaccatcaggggcacctgcctgcatcagggctgggccgaacttcctgctgggatggacacagtgctggctgaaaacatgagaggcacagcccctttcccttgctccgaccccccacagcagggctggcccagctctgagaacttgcagtggggtggatcacaaagtgtacttacagggaggtctgcatagaagtagtgcttcc

SEQ ID NO: 30539 - DNA, 601 bp, Human
tctgtggcacttcctaggtcccaggtgctgctctcactgtgttccctcagttaattccacaacaaccctaggaaggaggaacaaggcgtggagggattaagaccttgcccacagccacatacagagctagtgagcatcaatgtcaatgtctgaattcagatggtcaggctccaaaatccgtgtctttcaccacttggcaggcccccagtttaagaactttaactgcatcagaaatactactgtgcttgtcaaaagacagactgcttggcccgacctcaaaggtttccgattcagtaggtcragggtggggcctgaagatttatatttcttaccagttcccaggagatgatgatgtcagtgccctggggaccacactttgagaatcctgcaaaaggctaacccgttttctatgctgagacgggaagtctcaatttgtaaaactaagctctgggtagggttgttggataaaatataggacacccagttaaatctgaatttcagaaaaaacaacaaatgctttattatatgagtatgtcccatgaaactctggattatttgaactatctgggccagaaagaccagaaagccacagatgaccaaa

SEQ ID NO: 30540 - DNA, 601 bp, Human
gcctctcaatcatttctcttccctcccaccttttttttttttttttttttaaagaggcgtcatcttgctctgctgcccaggctggaatgcagtggcatgatcatagctcactgcagccctgaacttttgagctcaagtgatcctcccacctcagcctcctgaatagctggggatacaggtgtatggcaccacacctaggtgttaattttttggcaagtaggtctcgctatgttgcccagcctgatctcaaactctgcgtacagtgatcctcccacagcctcctgagtcactagcattacaygtgtaggcacctaggctccacgttttgatttttaaatgtttcacttcttttaatgactgcttaaaatatccagctgctgggtctgtgactaggtggataggtttgtctaacttcagggtgagttattagcaagcctaataattacagttcaagccatgttcgctagtcagctatgccaatcccaatgctgatattttagtctccatctatcaggctcctgtgactgctttctcaatttgttcaagaaaactctagcggtgaaaagagggccctgctatccaagaactgaagtaggaagga

SEQ ID NO: 30541 - DNA, 601 bp, Human
aaccctgccttactgaaggactctcagagtggttctagcctctcaatcatttctcttccctcccaccttttttttttttttttttttaaagaggcgtcatcttgctctgctgcccaggctggaatgcagtggcatgatcatagctcactgcagccctgaacttttgagctcaagtgatcctcccacctcagcctcctgaatagctggggatacaggtgtatggcaccacacctaggtgttaattttttggcaagtaggtctcgctatgttgcccagcctgatctcaaactctgcgtacagkgatcctcccacagcctcctgagtcactagcattacacgtgtaggcacctaggctccacgttttgatttttaaatgtttcacttcttttaatgactgcttaaaatatccagctgctgggtctgtgactaggtggataggtttgtctaacttcagggtgagttattagcaagcctaataattacagttcaagccatgttcgctagtcagctatgccaatcccaatgctgatattttagtctccatctatcaggctcctgtgactgctttctcaatttgttcaagaaaactctagcggtgaaa

SEQ ID NO: 30542 - DNA, 601 bp, Human
gttgttggtcgtatatttatatttggttgggggctcatcaaagaatccaaggaaaattctaaacaaacaaacaaacaaacaacaacaacaaaaaaacagggttgcaaaaggctggggaaaaaatggctgcaaacaacctcaatataatagacagaaaataaaactaaagtcagagaggttctagaaggcaggaagggagagggaaagaagaatactgcttctgtggcttctacctgccatgttcgcctggctggtccccagggcttgaaggatcagctgcagctccctgacagctgttgcygcctcttctccacaggacatgtcgggctccaggaccacctccagaaggcccactcctaccaaagaggggcagagtcagcctcactgcagctctccaatttcaccaacagaaaaattaggcctaagtttcaggaaaaccctgccttactgaaggactctcagagtggttctagcctctcaatcatttctcttccctcccaccttttttttttttttttttttaaagaggcgtcatcttgctctgctgcccaggctggaatgcagtggcatgatcatagctcactgcagccctgaacttttg

SEQ ID NO: 30543 - DNA, 601 bp, Human
tgggaggagggacagaaggatgagcaaaggagagggggctgataaaatgctcacagcaccaaaggagctggctccctgcagactccaggcagacctcagctcccacggaactttagaacaaccaaagctactcggctgctgtgttaaaagctgttggatttgtatttaaaagaaacaaaaagtgtcacaacaagtgagatttaatgaacactctcagctgtcactgactgatgagttcttgccactatcgtttatctcttggcaaggacccagatgggactatttctcagttaacaggtgrcctatttatgatcccatagggttggtaggaatcacagttattttgaagaagaatgggataataaaaactttcttaaagcaatcaacacttggagcataaatggataaccatccaacttgcccacatttcatttatgttctgtggattaaaaaaaaactggcatgagtgataaatctaaaattgagaattctcttactctaaaagagagtgttgtctctgtaaagaaacttgtaggcagctaacctttatgccactcaaactcatgtggctgtgtttttccagtctttaagtaaaatagca

SEQ ID NO: 30544 - DNA, 601 bp, Human
accagcctggattcaaatgcagtatcaaacattaacaaaagacatgctatctagtgaagacaaaataccttttaaacaaattaagttaaattgcctcaagtgcacaaaagctttactagttaggtttacttcaatgcattctgcaccactgagggacagccttcattcacacatcatgagaatggcatcaggctcaatttctatcttctagaagtagagatttataacagcaaaactaaaaaaaactataccactgagcacagtgataaagtgcagtttcatatttttctctaaaacacaytcacacaacagaaatataacatcaagatggaaaactgtttctgcaaacagcaggggcccaaagatgcagtgggtaaggtttgttaagctatctcgttctgatcactgaaaataacaaggtttgaccaaaaaaaaagcgaacaaattttactgaacgtattttacaaagctcactcatctagatgagtggtaattccataaaagtattactacttattactgttaataagagcaccgaacatgtatccagcacaggctgttttcgaggccctgtcctaagttttctagacattagtacatt

SEQ ID NO: 30545 - DNA, 601 bp, Human
catgatcttttgtggatcctctgataaagaggtggagtctaatttcccctcaagtctgctttgaattcaatgtaattttctttttttttcttagagacagagtcttgctctgtcgcccaggctagagtgcagtggcgtgatcacagctcactacaacctcaaactcctggactcaagtgatcctcccacctcagcctcttgagtagctgggactacaggtgctcaccaccatgcctggctaaatttttaattttttatagagatggggtcttgctatgttgcccaggtggtcttgaactcstggcctcaagcaatccacccaccttggcttcccaaagtgctgggattataggcatgaggcactgtgcctggcctcaatctactttgaatagaacacattggaagtgacactgtgtgaggtctacagcttaggactcacttctgccttcatcctcccgaaatgctcccactgcctcataagaaagccaaggctaggcaagtgcatgaagaaagatcacatggatggagaagcccagcagacatcagcatcaaggccccaaggtatgagagcgactaccatggaccctctgcttcagctggc

SEQ ID NO: 30546 - DNA, 601 bp, Human
ctcttggtctcaaacaatcctcctgccttggcctcccaaagtgctgggattacaggcatgagccactaagcccagcctgctaaactgctttatgaaaatatcttgagcctccaccttaactctccctcccaccatgtactaccttcccttgcccaaacctaaacccttttatctgagttgctaagaggcagcaacagcaaaacgtgtcagtttttgctccccatctctccccaactccagtgatctctttggttgacacgagatgatggctaaatggcctgacatagggagaaaaaggtgrtgaaaaatcacaggcttggagaattgaacccatagtaaagctttggctcttccactctgagtcagaccacagggagatttctccctcagactggtcctccaaagagttcttcataggacaggagaaggttaggggtctccttcagaactcatggatgactctacctaaaattgggctgcttttttaaggttaccatcaccacctcttaaaataacgggtcccagcccactacctacagggggaggtggaacttcctccatttgttccaggcttcctcctcaccaacttggcttataaggg

SEQ ID NO: 30547 - DNA, 601 bp, Human
atcaaactctgtggacttccatggggaaaccttaaatgaatacattcaaaaaacaatcataaagaaagcgaaatgtacagaatgatcttttttttttttttttaaaggaaatgacttcaatgtagccatctttcagccagctcaaactcggcttttgagcttttttcagtattctgctttaagtatacaatgctcaaaattctgagtgagaaaattaaggcccaagttatctaaacaaaaataaggcatctctacaaccaggtcttcactctgttccgcctctagcttcagctgggaaagrtctgatagattaaggaagtaaaaattcttgccacaaggcaggtaagctggaagcagagaaggaaagggcctaaaacgaagcccttgggcacagtctgggtcacttcaagcctcctggcagccctagggtatattatatccctatagggtacagtacttttcttttttttttttctttgagacggagtcttgctctgtcgcccaggctggagtgcagtggcactatctcggctcactgcaagctccgcctcctgggtttacgccattctcctgcctcagcctcccgagtagctggcactac

SEQ ID NO: 30548 - DNA, 601 bp, Human
aacaagaaagggacggtaaaaatgccatatgacaatcttatgggactcctgtagcatacgtaatccactgttgacagaaacatccatatgtatgcaggactatgtcttcataaagacacaggctggaaaaaacaggaccaaatgagagcaatttgcttattagaaggaaagatgactttccccccatttcaacatttctactatttttagcagcatttacataaataaaaaatgaaaggaaaaaaatttacccttgagaaatagaagaaatgaatagattttgcctaaacaaaatgtgacrgctggagaagagggagggagggatgaagaggtggagcacagggcatgcagtggaacttctcagtgtgacacgatggtggatgcatgtcattgtgcatatgtcaaaacccacgcaatgtaccacacaaacaaggaaccctagtgtaaaccatggactctagccaataaggaagtgtgattggtttcatcattgtaacaaatgagcatcttgcattactgtggcacattaacaggagactctggggggagagtggggagcgggagtatgtgagaactctggacgttccattcaattttattg

SEQ ID NO: 30549 - DNA, 601 bp, Human
tgttgcttcacaacggcgatatgttcgtagagatgtgtcgttaggtgatttcgtcatgggaccatcacagagtgcactcacatgagcctggatggtacagcctactacagataggccatgtggagtagcctactgctccaaggctactgagtgtcccaaatcctgcaggcaactgtaacacaatggcattggtgtatctaagcatgtctgaacaagaaagggacggtaaaaatgccatatgacaatcttatgggactcctgtagcatacgtaatccactgttgacagaaacatccatatgyatgcaggactatgtcttcataaagacacaggctggaaaaaacaggaccaaatgagagcaatttgcttattagaaggaaagatgactttccccccatttcaacatttctactatttttagcagcatttacataaataaaaaatgaaaggaaaaaaatttacccttgagaaatagaagaaatgaatagattttgcctaaacaaaatgtgacagctggagaagagggagggagggatgaagaggtggagcacagggcatgcagtggaacttctcagtgtgacacgatggtggatgcatgtcat

SEQ ID NO: 30550 - DNA, 601 bp, Human
gcctctgttcaactcccctttttgtgcattcccagcaccccgtgcatgcttctggcatgacaggatcaccctggggtggctgtttccttacagatctgtatcctccacaagtttgtaaatgtctgtctcattcatctttgtgcccccagcctctgacacagtgcagaggacacagtgcacagtcacagatttgaaggaataaatacatttttacacgggctagagaacatatttagaatgtggagtccacaggggatgtttgtgtcatgtcaggatatcctgagggagaacagcaggagcmaaaaaatggacctgccctatttccagcacttctggacagagctcatcacaaaggaagaaagaaatcccagacctcactcacctctcactgacagcgaggttctgttgctttaaatagcccagaaaagtgttgaggacccaactagtcaccttttttggctctgccctagtttcttttatcacattttggaagaactccagtaggccgacttcgttctgttaaaaaaaaaaaaagaaaattacataaagcctccccaaaaatgaaagatcagcattctgaaggcaaatctgaaactgtccc

SEQ ID NO: 30551 - DNA, 601 bp, Human
tccccagcctctgttcaactcccctttttgtgcattcccagcaccccgtgcatgcttctggcatgacaggatcaccctggggtggctgtttccttacagatctgtatcctccacaagtttgtaaatgtctgtctcattcatctttgtgcccccagcctctgacacagtgcagaggacacagtgcacagtcacagatttgaaggaataaatacatttttacacgggctagagaacatatttagaatgtggagtccacaggggatgtttgtgtcatgtcaggatatcctgagggagaacagcrggagcaaaaaaatggacctgccctatttccagcacttctggacagagctcatcacaaaggaagaaagaaatcccagacctcactcacctctcactgacagcgaggttctgttgctttaaatagcccagaaaagtgttgaggacccaactagtcaccttttttggctctgccctagtttcttttatcacattttggaagaactccagtaggccgacttcgttctgttaaaaaaaaaaaaagaaaattacataaagcctccccaaaaatgaaagatcagcattctgaaggcaaatctgaaac

SEQ ID NO: 30552 - DNA, 601 bp, Human
tccccacctccaaaatcatgggaaagacatgttgctgaagccacccagtctatggaatatagtggcctgagttgagtgagacacactgcatttccgcagtgtgaaactggcatgagcttgtagtctatggctgtcaagagctggtgataaaggcagacacagttctccaggtggcccttggtcatctccgcggctctgtccccaccattcccacctgcctgcctccggcccctgcagcttctggcgttcctgagcctgctgtgctgctgctctctgagcttcgcactctgctttgtctgcrtgatctgtccctcccactgcagagcgactctcccctaatgcttcagggcatggctcaaacgtcccctcccgaggggagccctggttggttccccagcctctgttcaactcccctttttgtgcattcccagcaccccgtgcatgcttctggcatgacaggatcaccctggggtggctgtttccttacagatctgtatcctccacaagtttgtaaatgtctgtctcattcatctttgtgcccccagcctctgacacagtgcagaggacacagtgcacagtcacagatttgaaggaataaata

SEQ ID NO: 30553 - DNA, 601 bp, Human
aactctcatgcccagactcacctcagatttctccacgtgcttttccccatgcctggaacacttttccctgtcagccttggcctgtccctgctcatcctctcctcaggtcttagcttagctgctaccttcttcccctctcagagcacccctgtcactgactgtagccaccagcttcaaggctgcctgtgctttgattcagggctggtgtctgtcccaggaactgcgcttctcatgctgggcacagaccttagcacacagcagaggctaagtgaacatgagctgaataatgaaccaacgagakaactctcaactgcaaacctccccaagatcttatcagctgcagactcatagatcttgcctactggttagccccgtgggggtgatgtctgtcctgcaggcagctcgaagtcagcacgtctgaaatggaatacggcatcttccctcacccccggcctataaagtttattccttttcctttagctcctcctacattgaaaaagtctgccctctgtttcacctctgcccaagcaagaaatctggaagttctgccaattgagataattgctctcaacttggcctagctcacttcaacccagccact

SEQ ID NO: 30554 - DNA, 601 bp, Human
acacccacccagcctgggctccccctgccccgggaccttgcaagggccctgccacctgcctatgtgcccccagagaactctctttctgatgccccaaagtgacacctactgcccattctttccttcttgaaacttgcctctcccttggcttctgtgtcaccagtccccgccccgccccccccccaccccccagtttcctggttttccttctacttctgtgccatcgcgcctgcatttccttctctgtgcacgcttcccagttaaaggctaaagagcttcaggttcgttccccagccacccyggcacgctgcaccctccctgaaagttctcatctgtccaacagcttcaagtacagatgctgctgagtccatgttccacttacgttgtgctgtgtccctggattccccaaactctcatgcccagactcacctcagatttctccacgtgcttttccccatgcctggaacacttttccctgtcagccttggcctgtccctgctcatcctctcctcaggtcttagcttagctgctaccttcttcccctctcagagcacccctgtcactgactgtagccaccagcttcaaggctgcctgtgctttg

SEQ ID NO: 30555 - DNA, 601 bp, Human
caaaagctctctgaggcacgtcctgccattttcattttacagtgaggaaactgagggtcagagggggaactcattcaagctgagcagccgagtcgggaagggaactaacacccgggccacactaacacatggatgtgtgcatccatatccagtggctgaacatggagttgacaccatctagagttaacttatttgggcaaacaactgttgggagttatttgtcaatatctgtctgtcttcactccccgggatgctgctgagacaatgacacacccacccagcctgggctccccctgccccrggaccttgcaagggccctgccacctgcctatgtgcccccagagaactctctttctgatgccccaaagtgacacctactgcccattctttccttcttgaaacttgcctctcccttggcttctgtgtcaccagtccccgccccgccccccccccaccccccagtttcctggttttccttctacttctgtgccatcgcgcctgcatttccttctctgtgcacgcttcccagttaaaggctaaagagcttcaggttcgttccccagccaccctggcacgctgcaccctccctgaaagttctcat

SEQ ID NO: 30556 - DNA, 601 bp, Human
cgaggcccacaacgtgccgggcactgtgactttttccctcaaaagctctctgaggcacgtcctgccattttcattttacagtgaggaaactgagggtcagagggggaactcattcaagctgagcagccgagtcgggaagggaactaacacccgggccacactaacacatggatgtgtgcatccatatccagtggctgaacatggagttgacaccatctagagttaacttatttgggcaaacaactgttgggagttatttgtcaatatctgtctgtcttcactccccgggatgctgctgagrcaatgacacacccacccagcctgggctccccctgccccgggaccttgcaagggccctgccacctgcctatgtgcccccagagaactctctttctgatgccccaaagtgacacctactgcccattctttccttcttgaaacttgcctctcccttggcttctgtgtcaccagtccccgccccgccccccccccaccccccagtttcctggttttccttctacttctgtgccatcgcgcctgcatttccttctctgtgcacgcttcccagttaaaggctaaagagcttcaggttcgttcccca

SEQ ID NO: 30557 - DNA, 601 bp, Human
cagcacaccaccctggcaaagagaaggtggctcacaccgaggcccacaacgtgccgggcactgtgactttttccctcaaaagctctctgaggcacgtcctgccattttcattttacagtgaggaaactgagggtcagagggggaactcattcaagctgagcagccgagtcgggaagggaactaacacccgggccacactaacacatggatgtgtgcatccatatccagtggctgaacatggagttgacaccatctagagttaacttatttgggcaaacaactgttgggagttatttgtcartatctgtctgtcttcactccccgggatgctgctgagacaatgacacacccacccagcctgggctccccctgccccgggaccttgcaagggccctgccacctgcctatgtgcccccagagaactctctttctgatgccccaaagtgacacctactgcccattctttccttcttgaaacttgcctctcccttggcttctgtgtcaccagtccccgccccgccccccccccaccccccagtttcctggttttccttctacttctgtgccatcgcgcctgcatttccttctctgtgcacgcttc

SEQ ID NO: 30558 - DNA, 601 bp, Human
ggcaggtgctctggtattcagcacaccaccctggcaaagagaaggtggctcacaccgaggcccacaacgtgccgggcactgtgactttttccctcaaaagctctctgaggcacgtcctgccattttcattttacagtgaggaaactgagggtcagagggggaactcattcaagctgagcagccgagtcgggaagggaactaacacccgggccacactaacacatggatgtgtgcatccatatccagtggctgaacatggagttgacaccatctagagttaacttatttgggcaaacaactsttgggagttatttgtcaatatctgtctgtcttcactccccgggatgctgctgagacaatgacacacccacccagcctgggctccccctgccccgggaccttgcaagggccctgccacctgcctatgtgcccccagagaactctctttctgatgccccaaagtgacacctactgcccattctttccttcttgaaacttgcctctcccttggcttctgtgtcaccagtccccgccccgccccccccccaccccccagtttcctggttttccttctacttctgtgccatcgcgcctgcatttc

SEQ ID NO: 30559 - DNA, 601 bp, Human
ccacaagagttcaggagggtggcaggtgctctggtattcagcacaccaccctggcaaagagaaggtggctcacaccgaggcccacaacgtgccgggcactgtgactttttccctcaaaagctctctgaggcacgtcctgccattttcattttacagtgaggaaactgagggtcagagggggaactcattcaagctgagcagccgagtcgggaagggaactaacacccgggccacactaacacatggatgtgtgcatccatatccagtggctgaacatggagttgacaccatctagagttamcttatttgggcaaacaactgttgggagttatttgtcaatatctgtctgtcttcactccccgggatgctgctgagacaatgacacacccacccagcctgggctccccctgccccgggaccttgcaagggccctgccacctgcctatgtgcccccagagaactctctttctgatgccccaaagtgacacctactgcccattctttccttcttgaaacttgcctctcccttggcttctgtgtcaccagtccccgccccgccccccccccaccccccagtttcctggttttccttctacttctg

SEQ ID NO: 30560 - DNA, 601 bp, Human
ggtgaaaccctgtctctactaaaaagaaaatacaaaaattagctgggtgtggtggcgggtgcttgtaatctcagctactcaggaggctgagacttgagaatcacttgaaactgggaggtggaggttgcagtgggcagagattgtgccactgcactctagcctgggtgacagggcgagactctgtctaaaaaacaaaacaaaacaaaaaaaagacaaagaggcagcagatgccacaagagttcaggagggtggcaggtgctctggtattcagcacaccaccctggcaaagagaaggtggctmacaccgaggcccacaacgtgccgggcactgtgactttttccctcaaaagctctctgaggcacgtcctgccattttcattttacagtgaggaaactgagggtcagagggggaactcattcaagctgagcagccgagtcgggaagggaactaacacccgggccacactaacacatggatgtgtgcatccatatccagtggctgaacatggagttgacaccatctagagttaacttatttgggcaaacaactgttgggagttatttgtcaatatctgtctgtcttcactccccgggatgctgc

SEQ ID NO: 30561 - DNA, 601 bp, Human
tcacttgagatcaggagttcgagaccagcctgcccaacatggtgaaaccctgtctctactaaaaagaaaatacaaaaattagctgggtgtggtggcgggtgcttgtaatctcagctactcaggaggctgagacttgagaatcacttgaaactgggaggtggaggttgcagtgggcagagattgtgccactgcactctagcctgggtgacagggcgagactctgtctaaaaaacaaaacaaaacaaaaaaaagacaaagaggcagcagatgccacaagagttcaggagggtggcaggtgctytggtattcagcacaccaccctggcaaagagaaggtggctcacaccgaggcccacaacgtgccgggcactgtgactttttccctcaaaagctctctgaggcacgtcctgccattttcattttacagtgaggaaactgagggtcagagggggaactcattcaagctgagcagccgagtcgggaagggaactaacacccgggccacactaacacatggatgtgtgcatccatatccagtggctgaacatggagttgacaccatctagagttaacttatttgggcaaacaactgttgggagtta

SEQ ID NO: 30562 - DNA, 601 bp, Human
agctacgctcctctccttcccaatcattccagttctttgctgttcctgcacctgggctccaggtaggcactgccctctccctcaccaaatcctgttgagccttgaagactctggtagagctgtatcccatccataaactcttcagcacggctcctgcctccacagaacagccacacattttcagcaccaacaccagaatttctgaatggagaggccaaacccgggaggacagggatgaaagaccaagaggcgcggtggctcacgcctgtaatcccagcactttgggaggccaaggcgggckgatcacttgagatcaggagttcgagaccagcctgcccaacatggtgaaaccctgtctctactaaaaagaaaatacaaaaattagctgggtgtggtggcgggtgcttgtaatctcagctactcaggaggctgagacttgagaatcacttgaaactgggaggtggaggttgcagtgggcagagattgtgccactgcactctagcctgggtgacagggcgagactctgtctaaaaaacaaaacaaaacaaaaaaaagacaaagaggcagcagatgccacaagagttcaggagggtggcaggtg

SEQ ID NO: 30563 - DNA, 601 bp, Human
tggtcatcccccacacactgcagagtggggctctgcacctgatgggttcatggctgaatccccctgacgttccagaggctccctattccggctcagctctggctctgcacacagccacacctcttggcctctttccaccctctgctcctgccagctacgctcctctccttcccaatcattccagttctttgctgttcctgcacctgggctccaggtaggcactgccctctccctcaccaaatcctgttgagccttgaagactctggtagagctgtatcccatccataaactcttcagcacrgctcctgcctccacagaacagccacacattttcagcaccaacaccagaatttctgaatggagaggccaaacccgggaggacagggatgaaagaccaagaggcgcggtggctcacgcctgtaatcccagcactttgggaggccaaggcgggctgatcacttgagatcaggagttcgagaccagcctgcccaacatggtgaaaccctgtctctactaaaaagaaaatacaaaaattagctgggtgtggtggcgggtgcttgtaatctcagctactcaggaggctgagacttgagaatcactt

SEQ ID NO: 30564 - DNA, 601 bp, Human
ggtcctggtcatcccccacacactgcagagtggggctctgcacctgatgggttcatggctgaatccccctgacgttccagaggctccctattccggctcagctctggctctgcacacagccacacctcttggcctctttccaccctctgctcctgccagctacgctcctctccttcccaatcattccagttctttgctgttcctgcacctgggctccaggtaggcactgccctctccctcaccaaatcctgttgagccttgaagactctggtagagctgtatcccatccataaactcttcrgcacggctcctgcctccacagaacagccacacattttcagcaccaacaccagaatttctgaatggagaggccaaacccgggaggacagggatgaaagaccaagaggcgcggtggctcacgcctgtaatcccagcactttgggaggccaaggcgggctgatcacttgagatcaggagttcgagaccagcctgcccaacatggtgaaaccctgtctctactaaaaagaaaatacaaaaattagctgggtgtggtggcgggtgcttgtaatctcagctactcaggaggctgagacttgagaat

SEQ ID NO: 30565 - DNA, 601 bp, Human
acactggaagcatcccattctgccttgaattaaaattctgatgcacaagttctagtcctccccaggaggctgacagcacctgtggggtagaaccgggtcctggtcatcccccacacactgcagagtggggctctgcacctgatgggttcatggctgaatccccctgacgttccagaggctccctattccggctcagctctggctctgcacacagccacacctcttggcctctttccaccctctgctcctgccagctacgctcctctccttcccaatcattccagttctttgctgttcctgyacctgggctccaggtaggcactgccctctccctcaccaaatcctgttgagccttgaagactctggtagagctgtatcccatccataaactcttcagcacggctcctgcctccacagaacagccacacattttcagcaccaacaccagaatttctgaatggagaggccaaacccgggaggacagggatgaaagaccaagaggcgcggtggctcacgcctgtaatcccagcactttgggaggccaaggcgggctgatcacttgagatcaggagttcgagaccagcctgcccaacatggtgaa

SEQ ID NO: 30566 - DNA, 601 bp, Human
actgcactgtgtctagttctaacactggaagcatcccattctgccttgaattaaaattctgatgcacaagttctagtcctccccaggaggctgacagcacctgtggggtagaaccgggtcctggtcatcccccacacactgcagagtggggctctgcacctgatgggttcatggctgaatccccctgacgttccagaggctccctattccggctcagctctggctctgcacacagccacacctcttggcctctttccaccctctgctcctgccagctacgctcctctccttcccaatcatkccagttctttgctgttcctgcacctgggctccaggtaggcactgccctctccctcaccaaatcctgttgagccttgaagactctggtagagctgtatcccatccataaactcttcagcacggctcctgcctccacagaacagccacacattttcagcaccaacaccagaatttctgaatggagaggccaaacccgggaggacagggatgaaagaccaagaggcgcggtggctcacgcctgtaatcccagcactttgggaggccaaggcgggctgatcacttgagatcaggagttcgagac

SEQ ID NO: 30567 - DNA, 601 bp, Human
ccaacaacatagaaaaactaagtttaaagctaagaaatttctatttcctccagaagcgcaaacacctcatcttcttggagctttcctggactcttctggctggtgtgaatctccctcctctctgttcccactgcactgtgtctagttctaacactggaagcatcccattctgccttgaattaaaattctgatgcacaagttctagtcctccccaggaggctgacagcacctgtggggtagaaccgggtcctggtcatcccccacacactgcagagtggggctctgcacctgatgggttcayggctgaatccccctgacgttccagaggctccctattccggctcagctctggctctgcacacagccacacctcttggcctctttccaccctctgctcctgccagctacgctcctctccttcccaatcattccagttctttgctgttcctgcacctgggctccaggtaggcactgccctctccctcaccaaatcctgttgagccttgaagactctggtagagctgtatcccatccataaactcttcagcacggctcctgcctccacagaacagccacacattttcagcaccaacaccagaat

SEQ ID NO: 30568 - DNA, 601 bp, Human
aagttcagcaattccgtacattttaaccaacaacatagaaaaactaagtttaaagctaagaaatttctatttcctccagaagcgcaaacacctcatcttcttggagctttcctggactcttctggctggtgtgaatctccctcctctctgttcccactgcactgtgtctagttctaacactggaagcatcccattctgccttgaattaaaattctgatgcacaagttctagtcctccccaggaggctgacagcacctgtggggtagaaccgggtcctggtcatcccccacacactgcagartggggctctgcacctgatgggttcatggctgaatccccctgacgttccagaggctccctattccggctcagctctggctctgcacacagccacacctcttggcctctttccaccctctgctcctgccagctacgctcctctccttcccaatcattccagttctttgctgttcctgcacctgggctccaggtaggcactgccctctccctcaccaaatcctgttgagccttgaagactctggtagagctgtatcccatccataaactcttcagcacggctcctgcctccacagaacagcca

SEQ ID NO: 30569 - DNA, 601 bp, Human
accacaaaatgcttgctcaggaaatctacaatgtctactttcttaactaaaccaaatctgttactcataattcagaagctgtcaaccaaataaaccaacctttcaagcaatatactcaattaaaaagccaagttcaacaagaggttggacccttcaaacatcagtcttctgagaggtctttaaagatgaatgctaattcacgtaatcattctctaccaatttgatctccagagtgttccttgcctgggtatcattgtgagactatagctagttttgcagctactgcccttctaagctctgsaaacattagcactcatagctgaggctgttcattaattaatgtttgctctatgggtagcctagtatatcagtccagctaaacgttctttgaactgtgtaggaaaagagctgctatggtttggttttggcttctcagtccttgttccatttaaactgtaaaacacaactgttgcctgcttcctctttacttgattttggaacaaccaagcctacctttatttagaattgggtacccttcaggttcttaaaactttactgcttataaactgcttgggtaaataccaggggctccaggtccact

SEQ ID NO: 30570 - DNA, 601 bp, Human
ccctgctccagtgctcagaaattgttgcccacagctcacctgaaacactggggcactcaactggcttggacagctggatagctgtacctgcctaattttaccacaaaatgcttgctcaggaaatctacaatgtctactttcttaactaaaccaaatctgttactcataattcagaagctgtcaaccaaataaaccaacctttcaagcaatatactcaattaaaaagccaagttcaacaagaggttggacccttcaaacatcagtcttctgagaggtctttaaagatgaatgctaattcacrtaatcattctctaccaatttgatctccagagtgttccttgcctgggtatcattgtgagactatagctagttttgcagctactgcccttctaagctctggaaacattagcactcatagctgaggctgttcattaattaatgtttgctctatgggtagcctagtatatcagtccagctaaacgttctttgaactgtgtaggaaaagagctgctatggtttggttttggcttctcagtccttgttccatttaaactgtaaaacacaactgttgcctgcttcctctttacttgattttggaaca

SEQ ID NO: 30571 - DNA, 601 bp, Human
atcctgccttttgcattcccaacaccaccacttctgacttgctgtgggtctggccacagtgagctcaacaggtttccaatgcctgcagcccatccttggatgctatcctacatttcatgctgtgggacacatcttcctctcacctccagtcccttcttggtttcaaatccttccctgctccagtgctcagaaattgttgcccacagctcacctgaaacactggggcactcaactggcttggacagctggatagctgtacctgcctaattttaccacaaaatgcttgctcaggaaatctacratgtctactttcttaactaaaccaaatctgttactcataattcagaagctgtcaaccaaataaaccaacctttcaagcaatatactcaattaaaaagccaagttcaacaagaggttggacccttcaaacatcagtcttctgagaggtctttaaagatgaatgctaattcacgtaatcattctctaccaatttgatctccagagtgttccttgcctgggtatcattgtgagactatagctagttttgcagctactgcccttctaagctctggaaacattagcactcatagctgaggctgtt

SEQ ID NO: 30572 - DNA, 601 bp, Human
atgatgacaacaccacgcttctaggtatcagagtgcaaattatcatgttgtctttgctttattcatcacctactccctgaaaaatctagtaccttattaccagatcctagtgatccttccaaacatgaaatacggccatcctgccttttgcattcccaacaccaccacttctgacttgctgtgggtctggccacagtgagctcaacaggtttccaatgcctgcagcccatccttggatgctatcctacatttcatgctgtgggacacatcttcctctcacctccagtcccttcttggtttmaaatccttccctgctccagtgctcagaaattgttgcccacagctcacctgaaacactggggcactcaactggcttggacagctggatagctgtacctgcctaattttaccacaaaatgcttgctcaggaaatctacaatgtctactttcttaactaaaccaaatctgttactcataattcagaagctgtcaaccaaataaaccaacctttcaagcaatatactcaattaaaaagccaagttcaacaagaggttggacccttcaaacatcagtcttctgagaggtctttaaagatgaatgc

SEQ ID NO: 30573 - DNA, 601 bp, Human
aaaagcaattcttagtcacaggctctacagaaacaggccagaggctgacatgctatagtttcccaatccttatcctaagccaaacttgtcttcctcacagaccagctcctctgcatttcccaccacccatcttctgtctcaaatgatgacaacaccacgcttctaggtatcagagtgcaaattatcatgttgtctttgctttattcatcacctactccctgaaaaatctagtaccttattaccagatcctagtgatccttccaaacatgaaatacggccatcctgccttttgcattcccarcaccaccacttctgacttgctgtgggtctggccacagtgagctcaacaggtttccaatgcctgcagcccatccttggatgctatcctacatttcatgctgtgggacacatcttcctctcacctccagtcccttcttggtttcaaatccttccctgctccagtgctcagaaattgttgcccacagctcacctgaaacactggggcactcaactggcttggacagctggatagctgtacctgcctaattttaccacaaaatgcttgctcaggaaatctacaatgtctactttcttaactaaa

SEQ ID NO: 30574 - DNA, 601 bp, Human
aaccacctcctgagaggccccgttcacacctagacaatgtgctctaaaccaggatggcaaacttctggaaagagctagggtgcgcatatttgaggcttggtgagtgccctctgtcacatatgcttctttgttttaacaaaggtaaaagcaattcttagtcacaggctctacagaaacaggccagaggctgacatgctatagtttcccaatccttatcctaagccaaacttgtcttcctcacagaccagctcctctgcatttcccaccacccatcttctgtctcaaatgatgacaacaccaygcttctaggtatcagagtgcaaattatcatgttgtctttgctttattcatcacctactccctgaaaaatctagtaccttattaccagatcctagtgatccttccaaacatgaaatacggccatcctgccttttgcattcccaacaccaccacttctgacttgctgtgggtctggccacagtgagctcaacaggtttccaatgcctgcagcccatccttggatgctatcctacatttcatgctgtgggacacatcttcctctcacctccagtcccttcttggtttcaaatccttccctgct

SEQ ID NO: 30575 - DNA, 601 bp, Human
accaaagatgctggtttcccgtgtcctgtggcttgaatctcacagcttcacaaatgctccgatcttccctgtcttgacaatgcctttggctgaccttgcagtcacttgcgtctgcccagtttcttgctttaacaataacgatctagcaccagtggctactacctaccctgtgtaagcacatgccatctggattctgtgcctacccctctatagaagctcttctcttaaaaatcaacccccttgcttgtggccaaacattcagcttctccccatcccgctgcaccctgactcctggggctgyaccgtaagctccttgtgaaacctccttcttgggcctccggaatgtcctcctcttccttgcctgtccctctgctgctccttgccagttcatgccaggtggctccggtgtcctcttgctgggtcctctgacttgacccctagccgtgaggaggatgcccagggctgccgctgctgcctcaggtcctgtttctctccctggttgatgtcaaccacctcctgagaggccccgttcacacctagacaatgtgctctaaaccaggatggcaaacttctggaaagagctagggtgcgcatatttgag

SEQ ID NO: 30576 - DNA, 601 bp, Human
atcaaacaacccctccacccctgctcagaaccccactctttccactcctccgaaccaaagatgctggtttcccgtgtcctgtggcttgaatctcacagcttcacaaatgctccgatcttccctgtcttgacaatgcctttggctgaccttgcagtcacttgcgtctgcccagtttcttgctttaacaataacgatctagcaccagtggctactacctaccctgtgtaagcacatgccatctggattctgtgcctacccctctatagaagctcttctcttaaaaatcaacccccttgcttgkggccaaacattcagcttctccccatcccgctgcaccctgactcctggggctgcaccgtaagctccttgtgaaacctccttcttgggcctccggaatgtcctcctcttccttgcctgtccctctgctgctccttgccagttcatgccaggtggctccggtgtcctcttgctgggtcctctgacttgacccctagccgtgaggaggatgcccagggctgccgctgctgcctcaggtcctgtttctctccctggttgatgtcaaccacctcctgagaggccccgttcacacctagacaatgtg

SEQ ID NO: 30577 - DNA, 601 bp, Human
gcgtcccaccaagcgcctgttccaggcagcccccttctgctcccctcctctgcacatgccctcacctcccatttcacaaggacatcagctgagccacggttgagaactttctagggcactctcctcctcctcttccatcaaacaacccctccacccctgctcagaaccccactctttccactcctccgaaccaaagatgctggtttcccgtgtcctgtggcttgaatctcacagcttcacaaatgctccgatcttccctgtcttgacaatgcctttggctgaccttgcagtcacttgcgtstgcccagtttcttgctttaacaataacgatctagcaccagtggctactacctaccctgtgtaagcacatgccatctggattctgtgcctacccctctatagaagctcttctcttaaaaatcaacccccttgcttgtggccaaacattcagcttctccccatcccgctgcaccctgactcctggggctgcaccgtaagctccttgtgaaacctccttcttgggcctccggaatgtcctcctcttccttgcctgtccctctgctgctccttgccagttcatgccaggtggctccggtgtcct

SEQ ID NO: 30578 - DNA, 601 bp, Human
cagcagcagcacaggctactaatttgctgttgtcaggtaatactggtttctggatagtgaatgcgtctccgctgaagaagaaactgacaccgcggccttcagctctgtgtgctgctctcttccctcccattctctgaggccgcggttcgacagaggaggggaaaggggctctttcaaagctccaaaatttgtccagtccctcagagctcattcaggatcacagctccatctcctgcttggatgagagcagacaacgctgatgcttctacaaccacccccgaccccccgtgaaccatgctgyctgtcccaatcccccagcttatctcaggcccaaagtccaccttctctgcttctgttaaaacaggatgcaagaagaaggaagacattgggacttgggcctccaggtggtacctgctgcgcacaggattctgtgttcatctcacggatttcgcagtgcccctagctggcgtcccaccaagcgcctgttccaggcagcccccttctgctcccctcctctgcacatgccctcacctcccatttcacaaggacatcagctgagccacggttgagaactttctagggcactctcctcctcctcttc

SEQ ID NO: 30579 - DNA, 601 bp, Human
cctcagactcgacacgcaatggcagcagcagcacaggctactaatttgctgttgtcaggtaatactggtttctggatagtgaatgcgtctccgctgaagaagaaactgacaccgcggccttcagctctgtgtgctgctctcttccctcccattctctgaggccgcggttcgacagaggaggggaaaggggctctttcaaagctccaaaatttgtccagtccctcagagctcattcaggatcacagctccatctcctgcttggatgagagcagacaacgctgatgcttctacaaccaccccygaccccccgtgaaccatgctgtctgtcccaatcccccagcttatctcaggcccaaagtccaccttctctgcttctgttaaaacaggatgcaagaagaaggaagacattgggacttgggcctccaggtggtacctgctgcgcacaggattctgtgttcatctcacggatttcgcagtgcccctagctggcgtcccaccaagcgcctgttccaggcagcccccttctgctcccctcctctgcacatgccctcacctcccatttcacaaggacatcagctgagccacggttgagaactttcta

SEQ ID NO: 30580 - DNA, 601 bp, Human
acgatgcctgtcacacagtaggtcatcatatttgtgtcacaggcttcctcacacccatagggatgtctggcagactgcacatgttaattccacatatgccagggctaaacttgagtcagacgatgacaaagatcagtacctgtcacacagaccccgaaagaccccactcatcgcctaaataaataaaccctcagactcgacacgcaatggcagcagcagcacaggctactaatttgctgttgtcaggtaatactggtttctggatagtgaatgcgtctccgctgaagaagaaactgacacygcggccttcagctctgtgtgctgctctcttccctcccattctctgaggccgcggttcgacagaggaggggaaaggggctctttcaaagctccaaaatttgtccagtccctcagagctcattcaggatcacagctccatctcctgcttggatgagagcagacaacgctgatgcttctacaaccacccccgaccccccgtgaaccatgctgtctgtcccaatcccccagcttatctcaggcccaaagtccaccttctctgcttctgttaaaacaggatgcaagaagaaggaagacattggga

SEQ ID NO: 30581 - DNA, 601 bp, Human
acataaaagacgtaggggtggagagggacagaaaaggaacacaaaataactaaaaataacgtcgcctttgagaagttcatctaaggaccttaattcatcagttgggtcataaatttagactacaaaatctttccactgacgtaatcacacttgggatttctccatcacttttctgtccctacgatgcctgtcacacagtaggtcatcatatttgtgtcacaggcttcctcacacccatagggatgtctggcagactgcacatgttaattccacatatgccagggctaaacttgagtcagaygatgacaaagatcagtacctgtcacacagaccccgaaagaccccactcatcgcctaaataaataaaccctcagactcgacacgcaatggcagcagcagcacaggctactaatttgctgttgtcaggtaatactggtttctggatagtgaatgcgtctccgctgaagaagaaactgacaccgcggccttcagctctgtgtgctgctctcttccctcccattctctgaggccgcggttcgacagaggaggggaaaggggctctttcaaagctccaaaatttgtccagtccctcagagctcat

SEQ ID NO: 30582 - DNA, 601 bp, Human
cctccctcatgacctaatcgcccaccaaaggtcccatttcctcacaccatcaccttaggggtcaggatttcaacacaggaatttgggggaggatcccaacattcagatcgccgcaatgacataaaagacgtaggggtggagagggacagaaaaggaacacaaaataactaaaaataacgtcgcctttgagaagttcatctaaggaccttaattcatcagttgggtcataaatttagactacaaaatctttccactgacgtaatcacacttgggatttctccatcacttttctgtccctacratgcctgtcacacagtaggtcatcatatttgtgtcacaggcttcctcacacccatagggatgtctggcagactgcacatgttaattccacatatgccagggctaaacttgagtcagacgatgacaaagatcagtacctgtcacacagaccccgaaagaccccactcatcgcctaaataaataaaccctcagactcgacacgcaatggcagcagcagcacaggctactaatttgctgttgtcaggtaatactggtttctggatagtgaatgcgtctccgctgaagaagaaactgacaccgc

SEQ ID NO: 30583 - DNA, 601 bp, Human
gtgtctgcatgtggtggaaggagcgagggagctctcagaagtttctctgatgagggtgctaatcccattcataaaagcccctccctcatgacctaatcgcccaccaaaggtcccatttcctcacaccatcaccttaggggtcaggatttcaacacaggaatttgggggaggatcccaacattcagatcgccgcaatgacataaaagacgtaggggtggagagggacagaaaaggaacacaaaataactaaaaataacgtcgcctttgagaagttcatctaaggaccttaattcatcagttrggtcataaatttagactacaaaatctttccactgacgtaatcacacttgggatttctccatcacttttctgtccctacgatgcctgtcacacagtaggtcatcatatttgtgtcacaggcttcctcacacccatagggatgtctggcagactgcacatgttaattccacatatgccagggctaaacttgagtcagacgatgacaaagatcagtacctgtcacacagaccccgaaagaccccactcatcgcctaaataaataaaccctcagactcgacacgcaatggcagcagcagcacag

SEQ ID NO: 30584 - DNA, 601 bp, Human
actttatttctgctctggaggctgggaagtccaagataaaggcgctggcagattccatgtctagtgagggtccactttctcactggtggcaccttcttgctgtgtctgcatgtggtggaaggagcgagggagctctcagaagtttctctgatgagggtgctaatcccattcataaaagcccctccctcatgacctaatcgcccaccaaaggtcccatttcctcacaccatcaccttaggggtcaggatttcaacacaggaatttgggggaggatcccaacattcagatcgccgcaatgacrtaaaagacgtaggggtggagagggacagaaaaggaacacaaaataactaaaaataacgtcgcctttgagaagttcatctaaggaccttaattcatcagttgggtcataaatttagactacaaaatctttccactgacgtaatcacacttgggatttctccatcacttttctgtccctacgatgcctgtcacacagtaggtcatcatatttgtgtcacaggcttcctcacacccatagggatgtctggcagactgcacatgttaattccacatatgccagggctaaacttgagtcagacga

SEQ ID NO: 30585 - DNA, 601 bp, Human
tgattgccttggtctgtttgggctgctctaacaggttagtaccaaagacgacatggcttataaaccatggaaactttatttctgctctggaggctgggaagtccaagataaaggcgctggcagattccatgtctagtgagggtccactttctcactggtggcaccttcttgctgtgtctgcatgtggtggaaggagcgagggagctctcagaagtttctctgatgagggtgctaatcccattcataaaagcccctccctcatgacctaatcgcccaccaaaggtcccatttcctcacaccrtcaccttaggggtcaggatttcaacacaggaatttgggggaggatcccaacattcagatcgccgcaatgacataaaagacgtaggggtggagagggacagaaaaggaacacaaaataactaaaaataacgtcgcctttgagaagttcatctaaggaccttaattcatcagttgggtcataaatttagactacaaaatctttccactgacgtaatcacacttgggatttctccatcacttttctgtccctacgatgcctgtcacacagtaggtcatcatatttgtgtcacaggcttcctca

SEQ ID NO: 30586 - DNA, 601 bp, Human
tttggagaatatctggtgttactaaattggtattcagaacatctgtgaaccaccctgattaaacctcaaaaggaagaggggcagcgggcggctaaacaaactaaaaaaacctacctttactaacaagtaaaaggcaggccggatttttctaaaagcgtgggttgcctggatgttctgcaatcctagaaaataccatggcccattatcttagaatgcagactgtgtgcagaacccataagaagcactgaggtggaactggatttcttgagcgtgcaaaagataaggtccctaggcccatacragtcgatgattgccttggtctgtttgggctgctctaacaggttagtaccaaagacgacatggcttataaaccatggaaactttatttctgctctggaggctgggaagtccaagataaaggcgctggcagattccatgtctagtgagggtccactttctcactggtggcaccttcttgctgtgtctgcatgtggtggaaggagcgagggagctctcagaagtttctctgatgagggtgctaatcccattcataaaagcccctccctcatgacctaatcgcccaccaaaggtcccatttcct

SEQ ID NO: 30587 - DNA, 601 bp, Human
ccctatgccgatttcccgggctctaaaccaatggagtgtgtgttaaccaactgacttactgtactctaattcaagtgcagtgaaaccctattggggctgtccacttaaaacagctgatgtactgaggcagcccatcatcctgtaagtgtctgtttatcccaaagtatgactaaaaggcaattccaagtgaaacttaggtttggagaatatctggtgttactaaattggtattcagaacatctgtgaaccaccctgattaaacctcaaaaggaagaggggcagcgggcggctaaacaaactaaaaaaacctacctttactaacaagtaaaaggcaggccggatttttctaaaagcgtgggttgcctggatgttctgcaatcctagaaaataccatggcccattatcttagaatgcagactgtgtgcagaacccataagaagcactgaggtggaactggatttcttgagcgtgcaaaagataaggtccctaggcccatacaagtcgatgattgccttggtctgtttgggctgctctaacaggttagtaccaaagacgacatggcttataaaccatggaaactttatttctgctctggaggctg

SEQ ID NO: 30588 - DNA, 601 bp, Human
aaactacagcttagtccctatgccgatttcccgggctctaaaccaatggagtgtgtgttaaccaactgacttactgtactctaattcaagtgcagtgaaaccctattggggctgtccacttaaaacagctgatgtactgaggcagcccatcatcctgtaagtgtctgtttatcccaaagtatgactaaaaggcaattccaagtgaaacttaggtttggagaatatctggtgttactaaattggtattcagaacatctgtgaaccaccctgattaaacctcaaaaggaagaggggcagcggrcggctaaacaaactaaaaaaacctacctttactaacaagtaaaaggcaggccggatttttctaaaagcgtgggttgcctggatgttctgcaatcctagaaaataccatggcccattatcttagaatgcagactgtgtgcagaacccataagaagcactgaggtggaactggatttcttgagcgtgcaaaagataaggtccctaggcccatacaagtcgatgattgccttggtctgtttgggctgctctaacaggttagtaccaaagacgacatggcttataaaccatggaaactttattt

SEQ ID NO: 30589 - DNA, 601 bp, Human
atccgaaagtctgaaatctgaaatgctccagtgagcatttcctttgcacatcatcgtcaatgctcaaaaagttttagattttgaagcattttggatttccaggttagggatactcaacctgtatttatagcaactaggctcatgagatgctgcctatctgagatcatttggggactggttttaaaaaggtaggaatgacatcaatagcacattagtgttacactgtgtaaatgagggcttctgaaatgcttcatgccacttgaaaacatcttctatttaagtcttggttcccatcatgcamaattaatttctttggatgtgcttagaaaatacaaaggaaactacagcttagtccctatgccgatttcccgggctctaaaccaatggagtgtgtgttaaccaactgacttactgtactctaattcaagtgcagtgaaaccctattggggctgtccacttaaaacagctgatgtactgaggcagcccatcatcctgtaagtgtctgtttatcccaaagtatgactaaaaggcaattccaagtgaaacttaggtttggagaatatctggtgttactaaattggtattcagaacatctgtgaac

SEQ ID NO: 30590 - DNA, 601 bp, Human
tttctggacacagaagggcctagaatccactatacctatatttctaggatgtgacttatttgccaatatcccatgaaagaaaaggtcaggggcatccaagcatagtgaaacagcgaagtgtcattaattcacttgaaggtgaattaatggtaggggtgagtgcctaaattatggaaaagacaacagtgaattacaaactatttcttttaaaatgcacggttttctgacttctaaatacaggttgagttacctcatctgaaatgcttgggaccagaagtgtttccaattttggatatttttrgattttggaatatttgcattatacttaccagtttagcatccctaatccgaaagtctgaaatctgaaatgctccagtgagcatttcctttgcacatcatcgtcaatgctcaaaaagttttagattttgaagcattttggatttccaggttagggatactcaacctgtatttatagcaactaggctcatgagatgctgcctatctgagatcatttggggactggttttaaaaaggtaggaatgacatcaatagcacattagtgttacactgtgtaaatgagggcttctgaaatgcttcatgc

SEQ ID NO: 30591 - DNA, 601 bp, Human
ccacattttcatccatcctcaggaacctgatacataactctcttctccaggctcacacagctttctggacacagaagggcctagaatccactatacctatatttctaggatgtgacttatttgccaatatcccatgaaagaaaaggtcaggggcatccaagcatagtgaaacagcgaagtgtcattaattcacttgaaggtgaattaatggtaggggtgagtgcctaaattatggaaaagacaacagtgaattacaaactatttcttttaaaatgcacggttttctgacttctaaatacargttgagttacctcatctgaaatgcttgggaccagaagtgtttccaattttggatatttttggattttggaatatttgcattatacttaccagtttagcatccctaatccgaaagtctgaaatctgaaatgctccagtgagcatttcctttgcacatcatcgtcaatgctcaaaaagttttagattttgaagcattttggatttccaggttagggatactcaacctgtatttatagcaactaggctcatgagatgctgcctatctgagatcatttggggactggttttaaaaaggtaggaa

SEQ ID NO: 30592 - DNA, 601 bp, Human
ccactactggcatttaatacttccatgatgaaagtcactcagtgatggcatttgggtgtcacagaaaacatttcttgggacagtagcacagtcagaagctgtcgggagtgtggacatacctgtttagctgctgatgaagaaattgttctgctgtccagcaggtcaagaagctcagcgagtgcagagggtgtgacaggactggtggcccccaaaagagaaaacacatttacattgcacactgtcagggcatccatgaatggctgttcggaatcagaacacttgctctagtgggggtaaatakcggacccacgcctagggatgaaaacagcaggccaactgggctctcttttattttacttatttattttatatcttaggatataacaaatttttgtgactagtgttctttctttcaccacccaacaataacagctgtttggcagaagttgtagcaacagacaactgctcagtgtaattagtcaagaaaaggaggtggctgcaaaattcatgaaccacaacaggaaagggaaaacaaactccagtaattaaatattttcaacggaaagatcagcctaaaaattacttaaaaaaaaaaaaaacc

SEQ ID NO: 30593 - DNA, 601 bp, Human
ctagcacttaggcagaggtatagacagacaaaaggctgcttaggatgatgctatttttctgagttttcacacaccgggcatgtctgtaacattttatctacaaagtgcagagtctgacttcaccctccttgttgaggacagactctctgagggcaaccatgcagcagggacaagggagccctgggactggctgggaggcggtgtgggggcgggacaagagccccagcaggctgagagctgagctgaggctgccttgggcacgagggaaagttctcaggtgtaaaagggctacaggagacaygtcaggcggagatgttcagggcaagaccagacaataactatttccccaggttagcggtgatgacgagaagcaaactgcctgcattgcacatattggcttcatacgcttgctaaataaaatgtttctacctttcagcattaaaaacaccactactggcatttaatacttccatgatgaaagtcactcagtgatggcatttgggtgtcacagaaaacatttcttgggacagtagcacagtcagaagctgtcgggagtgtggacatacctgtttagctgctgatgaagaaattgttctgctgt

SEQ ID NO: 30594 - DNA, 601 bp, Human
agtctcgctctgtcactcaggctggagtgcagtggcacaatgatctcagctcactgcaacctccacctccctaattgaagtgattctcctgtatcagcctcccaagtagctgggattacaggtgcccgctgccacactcagctaatttctgtatttttagtagagacggggttttgccatgttgaccaggctggtctcaaactcctgacctcgtgatccacccgcctcagcctaccaaagtgctgggattacaggcgtgagccactgtgcccggccctctgggtatgtatttgtaagaatyttctgaattccacgagtctgtcaactgcctagcacttaggcagaggtatagacagacaaaaggctgcttaggatgatgctatttttctgagttttcacacaccgggcatgtctgtaacattttatctacaaagtgcagagtctgacttcaccctccttgttgaggacagactctctgagggcaaccatgcagcagggacaagggagccctgggactggctgggaggcggtgtgggggcgggacaagagccccagcaggctgagagctgagctgaggctgccttgggcacgagggaaagtt

SEQ ID NO: 30595 - DNA, 601 bp, Human
tcagagagtctctgttctggctcacagctttctaaaacccaagccatgcttggactcttctattaaatttggaaaaaaatatctgtaacacatttttcttttttaaaaaagtacactataaaaataagatacaaaaatattctcaacagattatggaaatgcaaatcaaatcctccctgatacgacttcacacccactaggacggctatagaatcaaaaagatggacaataacaagtgctggtgaggacatggagcaactggaacccttgcacactaacaggtgagactgtaagatggtgyggccattttagaatacagtctggcacttcctcattatatgaatgaaacacagcattaccatatgacccagaaattccattcctataggtatacacccagcctgtgtgcaaaaacttgtacatgaatgtttaaggctgcattattcctaatagccaaaatgtggaaacaactcaaatgtccatcaactgatgaatggacagacaaaatggaatgtgtccgtacaatggtgaaggggcttggcagacgagcagccccatttagccctaaaaaggggtgaaggactgatgcgtgccgcaacac

SEQ ID NO: 30596 - DNA, 601 bp, Human
actcagtcacctttcttccttatcccctggtcatctatctaatcacttattggagcctcttccagttctgccagaggcaacaccaataaccagtaggatcagagagtctctgttctggctcacagctttctaaaacccaagccatgcttggactcttctattaaatttggaaaaaaatatctgtaacacatttttcttttttaaaaaagtacactataaaaataagatacaaaaatattctcaacagattatggaaatgcaaatcaaatcctccctgatacgacttcacacccactaggayggctatagaatcaaaaagatggacaataacaagtgctggtgaggacatggagcaactggaacccttgcacactaacaggtgagactgtaagatggtgcggccattttagaatacagtctggcacttcctcattatatgaatgaaacacagcattaccatatgacccagaaattccattcctataggtatacacccagcctgtgtgcaaaaacttgtacatgaatgtttaaggctgcattattcctaatagccaaaatgtggaaacaactcaaatgtccatcaactgatgaatggacagac

SEQ ID NO: 30597 - DNA, 601 bp, Human
ttcccagcttctatttctgattctgaagaacaaggctgctttgtggcagcaacctcttaactcccctggctctggggtgctgaagggatgaggtttgtaaatgtcgggagcactggcaggacacctgggaggagggtgcagtgaaaggcagaaggaatgaagataatgcacaaggaagtgggtgagagacaggcagagaaaggcagattcataaccaattagagcacaaagtgggaggttctttggaattcggaattctgctctcaggacatgattcttctttctgtgtgtctgtcatccmtaggagtcagtcactcagtcacctttcttccttatcccctggtcatctatctaatcacttattggagcctcttccagttctgccagaggcaacaccaataaccagtaggatcagagagtctctgttctggctcacagctttctaaaacccaagccatgcttggactcttctattaaatttggaaaaaaatatctgtaacacatttttcttttttaaaaaagtacactataaaaataagatacaaaaatattctcaacagattatggaaatgcaaatcaaatcctccctgatacgacttca

SEQ ID NO: 30598 - DNA, 601 bp, Human
ggcggggtggtaccaagcagtgccgctagagaaacatcattcagcagcctcctggaacacatgggagcccggtggctgaaatgtcctttcctcccagagttagaatacataatgttagttaactccacaaattagtgcagtggccatgacagtcgaggcccccagtccccagtcccctaggcttatacaacagacgccggttgtcccatcctttgctcaatcctatttaagacgaggattgtgcactcctggctggagtccaggagggtgggagccactgggtggtagtggagcggccctrtctccaggccagactctcctgctcctggccctcttgacgctcacagagtggcctctgtggctgccgagccctgtgctgcagcataaatcctcagcttttgtctgtgtttaatcccaccctgagaagtgatatccaagtgcaactgtttccagccaggagcgcagctcccaggccctgctgctgcctacccaagacaaacagatgtaacaaggaatttctagcacagtgctggtcctctgtgttaataaatggccgaccaggagtactgggtaatgcaagctgggaactccccatcacaca

SEQ ID NO: 30599 - DNA, 601 bp, Human
ataagcggaagagtggcagagtgcttggggatcacttccaatcacaccattcagaaggagaagcagtgcacctctaggacagatgccttcaaacgaagaggctggctgctccccgagaaggagggccaggcggggtggtaccaagcagtgccgctagagaaacatcattcagcagcctcctggaacacatgggagcccggtggctgaaatgtcctttcctcccagagttagaatacataatgttagttaactccacaaattagtgcagtggccatgacagtcgaggcccccagtccccagycccctaggcttatacaacagacgccggttgtcccatcctttgctcaatcctatttaagacgaggattgtgcactcctggctggagtccaggagggtgggagccactgggtggtagtggagcggccctgtctccaggccagactctcctgctcctggccctcttgacgctcacagagtggcctctgtggctgccgagccctgtgctgcagcataaatcctcagcttttgtctgtgtttaatcccaccctgagaagtgatatccaagtgcaactgtttccagccaggagcgcagctcccagg

SEQ ID NO: 30600 - DNA, 601 bp, Human
ctcgaatgttggctggatttgcctgggccaaaataagcggaagagtggcagagtgcttggggatcacttccaatcacaccattcagaaggagaagcagtgcacctctaggacagatgccttcaaacgaagaggctggctgctccccgagaaggagggccaggcggggtggtaccaagcagtgccgctagagaaacatcattcagcagcctcctggaacacatgggagcccggtggctgaaatgtcctttcctcccagagttagaatacataatgttagttaactccacaaattagtgcagyggccatgacagtcgaggcccccagtccccagtcccctaggcttatacaacagacgccggttgtcccatcctttgctcaatcctatttaagacgaggattgtgcactcctggctggagtccaggagggtgggagccactgggtggtagtggagcggccctgtctccaggccagactctcctgctcctggccctcttgacgctcacagagtggcctctgtggctgccgagccctgtgctgcagcataaatcctcagcttttgtctgtgtttaatcccaccctgagaagtgatatccaagtgc

SEQ ID NO: 30601 - DNA, 601 bp, Human
ccatctgccccctttctctgacacgtttattttttgaactaggacttaaattttaaaaatcattttctaataataaaagttaatacacattcactgcagaaaatataaggaaatacaggagagatcaaaagagatcaccggaattcccattttctcaagaaaaccaatgttaatattttggtgttttttcttcccatctttttctttctgttttgtaacatacttgggatcataacgtatattcagtttgtgtcctgctttctttcatttagcacagaagtactttcttaataaaaagatstagctagtatccatcagatgtatttatcataatttatcccctcctcgtagatatctagactttgaccagtgttgattttgttcatctgcacagactcccaaaaaagctcctagctgaaaacctggctcaaaacagaaaccacctgtaaggacttgctcgtgaaaaatctacgcagcagttccctccaggaaaaccaggcggacgagcagcctgtgcctggaagtaggcggggcccctcctgggtctgcgtctgcagacacagaccagggagcgatttctcagcgcctgtggtagctgctg

SEQ ID NO: 30602 - DNA, 601 bp, Human
ttagcacgaacagcaaagcaaataaaagggagatgctctgagtctcagcagggctcaaagtcttccccagtctgattcaaaaacaaaccacaaatacttatcactgctgggacaggcactgcgccttcagcctggtgcctcagaacgtgcgctgtgactgtggccaaggaggtgtgcttggcaggtcctgggtaagctccctacagggcacccctctgccgctgcccgactgctcaggaaaagcctggccctactcttagaaaaatacagaatgcacgtgcctccaactcaattcagcagrtatgtacgtggcctgacaatgaggaaaccattgggagaaagggggcacagaagcgggaagaaacttcctcactctcaacatgcttatcagtggagtgctgccagcagaagcactggggacctggatggcgttccatggagctgccctgtaagtcggaggagtccatctgccccctttctctgacacgtttattttttgaactaggacttaaattttaaaaatcattttctaataataaaagttaatacacattcactgcagaaaatataaggaaatacaggagagatcaaaagagatcac

SEQ ID NO: 30603 - DNA, 601 bp, Human
ctagggtagctgttttcctcatttctcttgtcttctagcgaaagccagaattgggagccgggaggagggcttcctctgttggtctcccaccggtgccacctccgtccagtccacagtcatgactgaacacccaactttccctgttaccttggtggccgagaacgggccaaccaggagccattcctcctggaaaaacagagctcttccataattagcacgaacagcaaagcaaataaaagggagatgctctgagtctcagcagggctcaaagtcttccccagtctgattcaaaaacaaaccwcaaatacttatcactgctgggacaggcactgcgccttcagcctggtgcctcagaacgtgcgctgtgactgtggccaaggaggtgtgcttggcaggtcctgggtaagctccctacagggcacccctctgccgctgcccgactgctcaggaaaagcctggccctactcttagaaaaatacagaatgcacgtgcctccaactcaattcagcagatatgtacgtggcctgacaatgaggaaaccattgggagaaagggggcacagaagcgggaagaaacttcctcactctcaacatgcttatca

SEQ ID NO: 30604 - DNA, 601 bp, Human
atgaggatctgcactcaagtgccacagaacaagcctgaaactactggcacgtctttatcagtcaccacagatgaggcaggaagacgaggctgtggaggcccagtgcaggctcattttccttatcgagagctctttacagagctgtgagtgtccccggcaagctgatgggtgggtgggtattattctgaaaaagatgccgacaatttttttccccactgaaaaaatatctctagacaatatgattagacttggggagggagggatgccactcgttttagcttttatgtcttgtgctgtgctragaacacaaaatgacctggttttcagtcatgctcctgtcagggattttctccacaatttatgaatacttttcccttctgcctttcttcccacctcttagaagcatgaagctgaagttcctgtactctccctgctctgccggcacacctgctggttctttactgggaggtccttaggaagtagcgctaaccacaacagattcgaaatgccaaccctgggagagggcgacacacctgggaggtcacagcttggatttcgtgagcttgctgacacccttttaaactacacctccatggagagt

SEQ ID NO: 30605 - DNA, 601 bp, Human
ctactctgctttctgattaaaatgagcaagaagtgattgccgaaagccagagaagctggcacgtgggagccagggccctcccctctgcgacgccacaatgaccgaggacactgagtctggggagggataatctctctgagatgatgaatcactgcgtctaatcagtgaggacacctctctgattctcagtgatgttcagctgaaatgtgtggctttccttctccccctgctccccaccaagaagattcctttatcagaaagcagatctacacactggccgagtcttccagagcgctgggtyggggggagtgtgctgtgtgggcagggggagtgaggaagccaggaggtgctgaattcctatcagatagccactgactcttagggccaccacgtgacctcctgctctgcagcgtctccaagggcaatgacatgaggatctgcactcaagtgccacagaacaagcctgaaactactggcacgtctttatcagtcaccacagatgaggcaggaagacgaggctgtggaggcccagtgcaggctcattttccttatcgagagctctttacagagctgtgagtgtccccggcaagctgatgggtgg

SEQ ID NO: 30606 - DNA, 601 bp, Human
cctgtcaaaggagatttttgctactctgctttctgattaaaatgagcaagaagtgattgccgaaagccagagaagctggcacgtgggagccagggccctcccctctgcgacgccacaatgaccgaggacactgagtctggggagggataatctctctgagatgatgaatcactgcgtctaatcagtgaggacacctctctgattctcagtgatgttcagctgaaatgtgtggctttccttctccccctgctccccaccaagaagattcctttatcagaaagcagatctacacactggccgrgtcttccagagcgctgggtcggggggagtgtgctgtgtgggcagggggagtgaggaagccaggaggtgctgaattcctatcagatagccactgactcttagggccaccacgtgacctcctgctctgcagcgtctccaagggcaatgacatgaggatctgcactcaagtgccacagaacaagcctgaaactactggcacgtctttatcagtcaccacagatgaggcaggaagacgaggctgtggaggcccagtgcaggctcattttccttatcgagagctctttacagagctgtgagtgtc

SEQ ID NO: 30607 - DNA, 601 bp, Human
tgagaacactggtgacattaatgccatagctgtggcttgggacagggattgagaggcagctctcagggcacatgggcatcagctttcacaggatcctgttcccagtcaggctgcactgtttgttgttgtcccttgggcaaggggatcccaaacatctcacaatgacagcttcttctccaggatctcctttatcatgactggatctgctcggctttgagtcgctttccggaccaacccaatcagtttatttatagctctggggtttctgttcttcacatccattacctagaaggacagaaactacttacttaagaggagaaaatgaagggattcatgcccccaaatcccaaactaaggcttaagtttactgaaaattaaattccgcttatttccactagtattagacataaaatgtagaacagaaaaaggggaggggcctcacttctgagtaggtttctaggctcctgtcaaaggagatttttgctactctgctttctgattaaaatgagcaagaagtgattgccgaaagccagagaagctggcacgtgggagccagggccctcccctctgcgacgccacaatgaccgaggacactgagtct

SEQ ID NO: 30608 - DNA, 601 bp, Human
gtctctcttgaccactgctaatgcccatcacctacaatggctggcccttaggagttgctcaaaaatatttgttgaaggaactgcagaatgaaaagttttcttagaatgggtaacagtatctccaacatacattttatttagtttaaaattccttaatacaagaaggtgttactccttaaccactgctgcagcctcaccggaccctcctgatgtggatgaagcaggcggggtggctgctggtcggctgtggaggcacctccaggcacagggcctagagggtgagaacactggtgacattaaygccatagctgtggcttgggacagggattgagaggcagctctcagggcacatgggcatcagctttcacaggatcctgttcccagtcaggctgcactgtttgttgttgtcccttgggcaaggggatcccaaacatctcacaatgacagcttcttctccaggatctcctttatcatgactggatctgctcggctttgagtcgctttccggaccaacccaatcagtttatttatagctctggggtttctgttcttcacatccattacctagaaggacagaaattacttacttaagaggagaaaa

SEQ ID NO: 30609 - DNA, 601 bp, Human
tgctcccgcctgggcaacagagtgagaccctgtctcaaaaacatttttggtgaaattcttcagtgttattgttgggtgtggcctctgctcctcttctccggtcacttggttgatgacacacccttcttgcttgtttttccagcctgtgggccaaagctgaccaactcccccaccgtcatcgtcatggtgggcctccccgcccggggcaagacctacatctccaagaagctgactcgctacctcaactggattggcgtccccacaaaaggtgagactgggtctcgaggccggacccctgctsgtgcaaaaacttgaccttccatctcagttgctggtttcacaggcaggaccacccctgggcgcctctgtcccctggtcggggagtctgatcctgcctcccatgcagctgggtccccttcacactgtgtctacaccctttttcttctgttggggttttctcctcactggccattctctttcccactcctctaagtcctgccccgactcagatttcacctccttcaaagccatctccagccacctcagtcctttacattcctgtcgcactcagtcctagctaacattcctctgctgatagccc

SEQ ID NO: 30610 - DNA, 601 bp, Human
gggtgtggcctctgctcctcttctccggtcacttggttgatgacacacccttcttgcttgtttttccagcctgtgggccaaagctgaccaactcccccaccgtcatcgtcatggtgggcctccccgcccggggcaagacctacatctccaagaagctgactcgctacctcaactggattggcgtccccacaaaaggtgagactgggtctcgaggccggacccctgctcgtgcaaaaacttgaccttccatctcagttgctggtttcacaggcaggaccacccctgggcgcctctgtccccyggtcggggagtctgatcctgcctcccatgcagctgggtccccttcacactgtgtctacaccctttttcttctgttggggttttctcctcactggccattctctttcccactcctctaagtcctgccccgactcagatttcacctccttcaaagccatctccagccacctcagtcctttacattcctgtcgcactcagtcctagctaacattcctctgctgatagccctaagcactgcctaccgtagatcaagggtcttcaacccccaggctgtggactgctatgttgggtggcctgttag

SEQ ID NO: 30611 - DNA, 601 bp, Human
tctccggtcacttggttgatgacacacccttcttgcttgtttttccagcctgtgggccaaagctgaccaactcccccaccgtcatcgtcatggtgggcctccccgcccggggcaagacctacatctccaagaagctgactcgctacctcaactggattggcgtccccacaaaaggtgagactgggtctcgaggccggacccctgctcgtgcaaaaacttgaccttccatctcagttgctggtttcacaggcaggaccacccctgggcgcctctgtcccctggtcggggagtctgatcctgmctcccatgcagctgggtccccttcacactgtgtctacaccctttttcttctgttggggttttctcctcactggccattctctttcccactcctctaagtcctgccccgactcagatttcacctccttcaaagccatctccagccacctcagtcctttacattcctgtcgcactcagtcctagctaacattcctctgctgatagccctaagcactgcctaccgtagatcaagggtcttcaacccccaggctgtggactgctatgttgggtggcctgttaggaacctggctgcaggaggtga

SEQ ID NO: 30612 - DNA, 601 bp, Human
tgggcctccccgcccggggcaagacctacatctccaagaagctgactcgctacctcaactggattggcgtccccacaaaaggtgagactgggtctcgaggccggacccctgctcgtgcaaaaacttgaccttccatctcagttgctggtttcacaggcaggaccacccctgggcgcctctgtcccctggtcggggagtctgatcctgcctcccatgcagctgggtccccttcacactgtgtctacaccctttttcttctgttggggttttctcctcactggccattctctttcccactccyctaagtcctgccccgactcagatttcacctccttcaaagccatctccagccacctcagtcctttacattcctgtcgcactcagtcctagctaacattcctctgctgatagccctaagcactgcctaccgtagatcaagggtcttcaacccccaggctgtggactgctatgttgggtggcctgttaggaacctggctgcaggaggtgagtggcagtgagtgcgcattcctgcctgagctccgcctccagtctgatcagtggtggcattagattcccatgggagtgaaccctattgtgaact

SEQ ID NO: 30613 - DNA, 601 bp, Human
gcccggggcaagacctacatctccaagaagctgactcgctacctcaactggattggcgtccccacaaaaggtgagactgggtctcgaggccggacccctgctcgtgcaaaaacttgaccttccatctcagttgctggtttcacaggcaggaccacccctgggcgcctctgtcccctggtcggggagtctgatcctgcctcccatgcagctgggtccccttcacactgtgtctacaccctttttcttctgttggggttttctcctcactggccattctctttcccactcctctaagtcctgccccgactcagatttcacctccttcaaagccatctccagccacctcagtcctttacattcctgtcgcactcagtcctagctaacattcctctgctgatagccctaagcactgcctaccgtagatcaagggtcttcaacccccaggctgtggactgctatgttgggtggcctgttaggaacctggctgcaggaggtgagtggcagtgagtgcgcattcctgcctgagctccgcctccagtctgatcagtggtggcattagattcccatgggagtgaaccctattgtgaactgggcatgtgat

SEQ ID NO: 30614 - DNA, 601 bp, Human
aagccatgaaagtccggaagtaaggctgggccgcgggcgtagggctgggctgtgggaataaggctgggccgcgggcataaggctgggctgcaggagtaaggctgggccgcgggcgtagggctgggctgtgggaataaggctgggctgcggggctgcgggtgtaaggctgggctgcgggcttgggcttgctttgttctgagccaggctctgtaggaggcagagaaagccggcctgcgggtgggtcctgctggtggcttcagggctgtgcagtgtgggaacaaggttgctgctctcatctgtyccctgagggtctcgctgagctgaccctcactgggacagagccgcagaagcaccctcactgagaattagcaagtcctgttcatcgggagtgtctgtttatgtttggaaaggatttcttgttaagtgcgagttgattgtgaaaccctagtgcaagggtgttcagccccggctgtatgctggagtctcctgggggatgctaaaatccctgatgccaggccccaccccagaccagttagtgcaactctgtgggtggctctgggcagccatttcttagcagctccccaggagtggttcccgcgtg

SEQ ID NO: 30615 - DNA, 601 bp, Human
taaggctgggctgcgggcttgggcttgctttgttctgagccaggctctgtaggaggcagagaaagccggcctgcgggtgggtcctgctggtggcttcagggctgtgcagtgtgggaacaaggttgctgctctcatctgtcccctgagggtctcgctgagctgaccctcactgggacagagccgcagaagcaccctcactgagaattagcaagtcctgttcatcgggagtgtctgtttatgtttggaaaggatttcttgttaagtgcgagttgattgtgaaaccctagtgcaagggtgttcrgccccggctgtatgctggagtctcctgggggatgctaaaatccctgatgccaggccccaccccagaccagttagtgcaactctgtgggtggctctgggcagccatttcttagcagctccccaggagtggttcccgcgtgcagcccggtgcgagcaccgcctcccgagggttcctgaggccacccgtgtggggccccaggttggaagcctctgggcctgaggggtgctggccagcctgcccagcgctaagcagtgtagaatggaaccaccagttactctgcttgtcggggcgtgtcgggag

SEQ ID NO: 30616 - DNA, 601 bp, Human
tctcgctgagctgaccctcactgggacagagccgcagaagcaccctcactgagaattagcaagtcctgttcatcgggagtgtctgtttatgtttggaaaggatttcttgttaagtgcgagttgattgtgaaaccctagtgcaagggtgttcagccccggctgtatgctggagtctcctgggggatgctaaaatccctgatgccaggccccaccccagaccagttagtgcaactctgtgggtggctctgggcagccatttcttagcagctccccaggagtggttcccgcgtgcagcccggtkcgagcaccgcctcccgagggttcctgaggccacccgtgtggggccccaggttggaagcctctgggcctgaggggtgctggccagcctgcccagcgctaagcagtgtagaatggaaccaccagttactctgcttgtcggggcgtgtcgggagttgcttgggctgccccagcggatgcaccagcgctgacattcgggcaatgtcttgtgcattccaggcaatgtgccttagctgccttgagagatgtcaaaagctacctggcgaaagaagggggacaaattgcggtaagtccaggcaatgta

SEQ ID NO: 30617 - DNA, 601 bp, Human
gggtgttcagccccggctgtatgctggagtctcctgggggatgctaaaatccctgatgccaggccccaccccagaccagttagtgcaactctgtgggtggctctgggcagccatttcttagcagctccccaggagtggttcccgcgtgcagcccggtgcgagcaccgcctcccgagggttcctgaggccacccgtgtggggccccaggttggaagcctctgggcctgaggggtgctggccagcctgcccagcgctaagcagtgtagaatggaaccaccagttactctgcttgtcggggcgygtcgggagttgcttgggctgccccagcggatgcaccagcgctgacattcgggcaatgtcttgtgcattccaggcaatgtgccttagctgccttgagagatgtcaaaagctacctggcgaaagaagggggacaaattgcggtaagtccaggcaatgtagccggctcggtgtccagtcccacccatgagggtgtcctcaccggcctggggtgtaccgagacctgtgcctctggccctgagggtggaggaaagcaggtggccagggcagcccaatggctcaggaaggcggatgtggggcggac

SEQ ID NO: 30618 - DNA, 601 bp, Human
ggagtctcctgggggatgctaaaatccctgatgccaggccccaccccagaccagttagtgcaactctgtgggtggctctgggcagccatttcttagcagctccccaggagtggttcccgcgtgcagcccggtgcgagcaccgcctcccgagggttcctgaggccacccgtgtggggccccaggttggaagcctctgggcctgaggggtgctggccagcctgcccagcgctaagcagtgtagaatggaaccaccagttactctgcttgtcggggcgtgtcgggagttgcttgggctgccccrgcggatgcaccagcgctgacattcgggcaatgtcttgtgcattccaggcaatgtgccttagctgccttgagagatgtcaaaagctacctggcgaaagaagggggacaaattgcggtaagtccaggcaatgtagccggctcggtgtccagtcccacccatgagggtgtcctcaccggcctggggtgtaccgagacctgtgcctctggccctgagggtggaggaaagcaggtggccagggcagcccaatggctcaggaaggcggatgtggggcggactcagggacccaccccctctgtggcc

SEQ ID NO: 30619 - DNA, 601 bp, Human
gggatgctaaaatccctgatgccaggccccaccccagaccagttagtgcaactctgtgggtggctctgggcagccatttcttagcagctccccaggagtggttcccgcgtgcagcccggtgcgagcaccgcctcccgagggttcctgaggccacccgtgtggggccccaggttggaagcctctgggcctgaggggtgctggccagcctgcccagcgctaagcagtgtagaatggaaccaccagttactctgcttgtcggggcgtgtcgggagttgcttgggctgccccagcggatgcaccrgcgctgacattcgggcaatgtcttgtgcattccaggcaatgtgccttagctgccttgagagatgtcaaaagctacctggcgaaagaagggggacaaattgcggtaagtccaggcaatgtagccggctcggtgtccagtcccacccatgagggtgtcctcaccggcctggggtgtaccgagacctgtgcctctggccctgagggtggaggaaagcaggtggccagggcagcccaatggctcaggaaggcggatgtggggcggactcagggacccaccccctctgtggccagtcccacacct

SEQ ID NO: 30620 - DNA, 601 bp, Human
ggcgtgtcgggagttgcttgggctgccccagcggatgcaccagcgctgacattcgggcaatgtcttgtgcattccaggcaatgtgccttagctgccttgagagatgtcaaaagctacctggcgaaagaagggggacaaattgcggtaagtccaggcaatgtagccggctcggtgtccagtcccacccatgagggtgtcctcaccggcctggggtgtaccgagacctgtgcctctggccctgagggtggaggaaagcaggtggccagggcagcccaatggctcaggaaggcggatgtggggyggactcagggacccaccccctctgtggccagtcccacacctccagggcgggcaggactcgagttacccacaggaccactggcccttccttgtacactgtcccattgcacattactgttttgcttgtttgcttttggggtatttcccccacgctaccacccctgagtgctgttggtagttgcgggaggcctgcctcctaagcactccctggagaggactgtgggcaggcacaagctcccctgaagcacttttggggcttattcctggagatgatgggtctggcatctttgctgttctggta

SEQ ID NO: 30621 - DNA, 601 bp, Human
gaaagaagggggacaaattgcggtaagtccaggcaatgtagccggctcggtgtccagtcccacccatgagggtgtcctcaccggcctggggtgtaccgagacctgtgcctctggccctgagggtggaggaaagcaggtggccagggcagcccaatggctcaggaaggcggatgtggggcggactcagggacccaccccctctgtggccagtcccacacctccagggcgggcaggactcgagttacccacaggaccactggcccttccttgtacactgtcccattgcacattactgttttgsttgtttgcttttggggtatttcccccacgctaccacccctgagtgctgttggtagttgcgggaggcctgcctcctaagcactccctggagaggactgtgggcaggcacaagctcccctgaagcacttttggggcttattcctggagatgatgggtctggcatctttgctgttctggtaaacgttgttaaactcaaacttagagttttcttcctggccctttgctctccatatcaggttttcgatgccaccaatactactagagagaggagacacatgatccttcattttgccaaagaaaa

SEQ ID NO: 30622 - DNA, 601 bp, Human
ttgcgggaggcctgcctcctaagcactccctggagaggactgtgggcaggcacaagctcccctgaagcacttttggggcttattcctggagatgatgggtctggcatctttgctgttctggtaaacgttgttaaactcaaacttagagttttcttcctggccctttgctctccatatcaggttttcgatgccaccaatactactagagagaggagacacatgatccttcattttgccaaagaaaatgactttaaggtgagctgagcgtcttgtgttgtgctagagggctcgggagagaggmaaaggcctcaggaagcggcctgagtcctgcttggtccttcccctcctgctgccatgttccttagtcctgctcggtccctcccctcctgctgcccacgttttgtggccttaaatttgggcctttgtgtggtagggctcttgggggccgtggggcgttccagaggctgcagtgaggaggtgggctttcctgtgtttgggagttggtgggtggcgtgcttccgccttgtccgggtgatgacatcgcagtgatggcaaggttgatccttcgtggtgtttgttttctaacatccccacctcactt

SEQ ID NO: 30623 - DNA, 601 bp, Human
aggcctgcctcctaagcactccctggagaggactgtgggcaggcacaagctcccctgaagcacttttggggcttattcctggagatgatgggtctggcatctttgctgttctggtaaacgttgttaaactcaaacttagagttttcttcctggccctttgctctccatatcaggttttcgatgccaccaatactactagagagaggagacacatgatccttcattttgccaaagaaaatgactttaaggtgagctgagcgtcttgtgttgtgctagagggctcgggagagaggaaaaggcytcaggaagcggcctgagtcctgcttggtccttcccctcctgctgccatgttccttagtcctgctcggtccctcccctcctgctgcccacgttttgtggccttaaatttgggcctttgtgtggtagggctcttgggggccgtggggcgttccagaggctgcagtgaggaggtgggctttcctgtgtttgggagttggtgggtggcgtgcttccgccttgtccgggtgatgacatcgcagtgatggcaaggttgatccttcgtggtgtttgttttctaacatccccacctcacttccaccag

SEQ ID NO: 30624 - DNA, 601 bp, Human
caagctcccctgaagcacttttggggcttattcctggagatgatgggtctggcatctttgctgttctggtaaacgttgttaaactcaaacttagagttttcttcctggccctttgctctccatatcaggttttcgatgccaccaatactactagagagaggagacacatgatccttcattttgccaaagaaaatgactttaaggtgagctgagcgtcttgtgttgtgctagagggctcgggagagaggaaaaggcctcaggaagcggcctgagtcctgcttggtccttcccctcctgctgccatgttccttagtcctgctcggtccctcccctcctgctgcccacgttttgtggccttaaatttgggcctttgtgtggtagggctcttgggggccgtggggcgttccagaggctgcagtgaggaggtgggctttcctgtgtttgggagttggtgggtggcgtgcttccgccttgtccgggtgatgacatcgcagtgatggcaaggttgatccttcgtggtgtttgttttctaacatccccacctcacttccaccaggcgtttttcatcgagtcggtgtgcgacgaccctacagttgtggcc

SEQ ID NO: 30625 - DNA, 601 bp, Human
ttgtgaaaagtcagtttagatttgtccagtgggagcaggaggctcagagtatgagggtttgccacctttctttggctgggcactccttgttccccttggtagacagcagggtgcagctgtgaagtcatttttcccagtgagtggtcaccaatgtgcttagcaaggagtttagcatttgtctggttgtccactagcagatagtcatttgccccaacccaccatgttcagaaatctctttctgatgaaatctcaaagcagcttggtagagccaggcatttgtgaacttagatttttttttttwaattgtggcaaaatatacataatgtaaaatttaccatcttaatcatttttattatttatttatttatttatttatttatttattgaaacggactctccttctgttgcccaggctggaatgcagtgacacggtcttggctcactgcaacctctgcctcccaggttcaagcgattctcctgcctcagcctcccgaatagctgggattacaggtgtgcgccaccacgcccagctaattttttttgtatttttagaggagacgggggtttcactgtgttggccaggctggtctcaaactcctga

SEQ ID NO: 30626 - DNA, 601 bp, Human
ttcagaaatctctttctgatgaaatctcaaagcagcttggtagagccaggcatttgtgaacttagatttttttttttaaattgtggcaaaatatacataatgtaaaatttaccatcttaatcatttttattatttatttatttatttatttatttatttattgaaacggactctccttctgttgcccaggctggaatgcagtgacacggtcttggctcactgcaacctctgcctcccaggttcaagcgattctcctgcctcagcctcccgaatagctgggattacaggtgtgcgccaccaygcccagctaattttttttgtatttttagaggagacgggggtttcactgtgttggccaggctggtctcaaactcctgacctcaagtgatctgcttgccttggcctcccaaagtgctgggattacaggcgtgagccactgcatccggccattttagctattttttaagtgtgcagtacagcagcaaattatattcccattgttgggcaaccgccacactctatccgcaggactttctcatcttccccggctgaaactgtgccaggacacaggcacagctcccgactgactcgatctttgaag

SEQ ID NO: 30627 - DNA, 601 bp, Human
actctccttctgttgcccaggctggaatgcagtgacacggtcttggctcactgcaacctctgcctcccaggttcaagcgattctcctgcctcagcctcccgaatagctgggattacaggtgtgcgccaccacgcccagctaattttttttgtatttttagaggagacgggggtttcactgtgttggccaggctggtctcaaactcctgacctcaagtgatctgcttgccttggcctcccaaagtgctgggattacaggcgtgagccactgcatccggccattttagctattttttaagtgkgcagtacagcagcaaattatattcccattgttgggcaaccgccacactctatccgcaggactttctcatcttccccggctgaaactgtgccaggacacaggcacagctcccgactgactcgatctttgaagagtggctgcctctcagtgacggcagtggttgatgagaaaaagagcccaggcattcagaaatgctgagtttccctaaaatccacctggtttctggggcctgtgccactgtgggtgttggtagacctgtgttgttgcctaggagagcgagccctgcaaaggagccggcaca

SEQ ID NO: 30628 - DNA, 601 bp, Human
acgctgggccggataatctttatactgagccttctgtgcgctccccttttgaaagccccaaatcctgcttaatctcagcagaaagccttccagcgtgatttatcagccacccctttgtggtgttgcaggaagttaaaatctccagcccggattacaaagactgcaactcggcagaagccatggacgacttcatgaagaggatcagttgctatgaagccagctaccagcccctcgaccccgacaaatgcgacaggtgattcccgtggctggccgtctctgcaagacccacatgagggttctyactgaattcttgatgttcccacaaaggatttgctcctggatacctttaaaaaaatttttttaagacagttttttttgtagagatgaggtctcgctatgttgcccgggctggtcttgagctcctggcctcaggtgatccacatacagccgctggatacctttatcaactctctttgaaaatatcttttaaaaacaatccttgatgacaaatcatattcagtgggaatattttgaacactgtgtagaagtacaggaagtcaacatagagttgagcctgattttgctactgtccctccgatag

SEQ ID NO: 30629 - DNA, 601 bp, Human
gacaggtgattcccgtggctggccgtctctgcaagacccacatgagggttctcactgaattcttgatgttcccacaaaggatttgctcctggatacctttaaaaaaatttttttaagacagttttttttgtagagatgaggtctcgctatgttgcccgggctggtcttgagctcctggcctcaggtgatccacatacagccgctggatacctttatcaactctctttgaaaatatcttttaaaaacaatccttgatgacaaatcatattcagtgggaatattttgaacactgtgtagaagyacaggaagtcaacatagagttgagcctgattttgctactgtccctccgatagttcctttcttttttctttcctttctttccatttatttatttatttatttacttacttacttgcttgcctgcttgcttagagacagggtctccctttgtctcccaggctggagtgcagtggcatgatcatagctcactgcaggttcaaacttctgggctcaagtaatcctaccgcctcagcctcatgagtagctgggactacaggtgtgggtgtccacgcccagctaattttttttttctttagtagag

SEQ ID NO: 30630 - DNA, 601 bp, Human
tggtcttgagctcctggcctcaggtgatccacatacagccgctggatacctttatcaactctctttgaaaatatcttttaaaaacaatccttgatgacaaatcatattcagtgggaatattttgaacactgtgtagaagtacaggaagtcaacatagagttgagcctgattttgctactgtccctccgatagttcctttcttttttctttcctttctttccatttatttatttatttatttacttacttacttgcttgcctgcttgcttagagacagggtctccctttgtctcccaggctrgagtgcagtggcatgatcatagctcactgcaggttcaaacttctgggctcaagtaatcctaccgcctcagcctcatgagtagctgggactacaggtgtgggtgtccacgcccagctaattttttttttctttagtagagatgaggtcttgctatgttgcccaggctggtcttgaacttctagactcaagcaatcctcttgcctcggcctcccaaagtgctgggattacaggcatgagccactgcacaggcccctttctttttttctccattttctttcttttttctcccccttttctggg

SEQ ID NO: 30631 - DNA, 601 bp, Human
tgaaaatatcttttaaaaacaatccttgatgacaaatcatattcagtgggaatattttgaacactgtgtagaagtacaggaagtcaacatagagttgagcctgattttgctactgtccctccgatagttcctttcttttttctttcctttctttccatttatttatttatttatttacttacttacttgcttgcctgcttgcttagagacagggtctccctttgtctcccaggctggagtgcagtggcatgatcatagctcactgcaggttcaaacttctgggctcaagtaatcctaccgcctcagcctcatgagtagctgggactacaggtgtgggtgtccacgcccagctaattttttttttctttagtagagatgaggtcttgctatgttgcccaggctggtcttgaacttctagactcaagcaatcctcttgcctcggcctcccaaagtgctgggattacaggcatgagccactgcacaggcccctttctttttttctccattttctttcttttttctcccccttttctgggaggcaggccagcctcacagccagacaccagctgtgggagttgtcttacgcatatgctctgcccct

SEQ ID NO: 30632 - DNA, 601 bp, Human
aacaatccttgatgacaaatcatattcagtgggaatattttgaacactgtgtagaagtacaggaagtcaacatagagttgagcctgattttgctactgtccctccgatagttcctttcttttttctttcctttctttccatttatttatttatttatttacttacttacttgcttgcctgcttgcttagagacagggtctccctttgtctcccaggctggagtgcagtggcatgatcatagctcactgcaggttcaaacttctgggctcaagtaatcctaccgcctcagcctcatgagtarctgggactacaggtgtgggtgtccacgcccagctaattttttttttctttagtagagatgaggtcttgctatgttgcccaggctggtcttgaacttctagactcaagcaatcctcttgcctcggcctcccaaagtgctgggattacaggcatgagccactgcacaggcccctttctttttttctccattttctttcttttttctcccccttttctgggaggcaggccagcctcacagccagacaccagctgtgggagttgtcttacgcatatgctctgccccttagaaggattcagtctg

SEQ ID NO: 30633 - DNA, 601 bp, Human
ggctcaagtaatcctaccgcctcagcctcatgagtagctgggactacaggtgtgggtgtccacgcccagctaattttttttttctttagtagagatgaggtcttgctatgttgcccaggctggtcttgaacttctagactcaagcaatcctcttgcctcggcctcccaaagtgctgggattacaggcatgagccactgcacaggcccctttctttttttctccattttctttcttttttctcccccttttctgggaggcaggccagcctcacagccagacaccagctgtgggagttgtctyacgcatatgctctgccccttagaaggattcagtctgtgccctggaggggcctacggtcccgccttgctgttctctggggatcacatcttcggagacgggccaggtgcatcctgctgtgggtggtggcctgagctgtggttctcggtggggtctctctgcagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcac

SEQ ID NO: 30634 - DNA, 601 bp, Human
aatcctaccgcctcagcctcatgagtagctgggactacaggtgtgggtgtccacgcccagctaattttttttttctttagtagagatgaggtcttgctatgttgcccaggctggtcttgaacttctagactcaagcaatcctcttgcctcggcctcccaaagtgctgggattacaggcatgagccactgcacaggcccctttctttttttctccattttctttcttttttctcccccttttctgggaggcaggccagcctcacagccagacaccagctgtgggagttgtcttacgcatatrctctgccccttagaaggattcagtctgtgccctggaggggcctacggtcccgccttgctgttctctggggatcacatcttcggagacgggccaggtgcatcctgctgtgggtggtggcctgagctgtggttctcggtggggtctctctgcagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaac

SEQ ID NO: 30635 - DNA, 601 bp, Human
cggtggggtctctctgcagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaaggtgcggggtgtgctgccgcatgggccgttctggctgtagggcggttgcagggtctatagggtgggtggggagcggtgtgctgctgctgctgctgctgctgctgcttggtgtgcttgctgtgtgtgttatctgtgtgtgcgcctgcacgtctctatgcatatctgtgtgcatctctgtatggctctgtgtgtgtgtgtgtctacgcctatccatgtggctttgtgtgtgtgtgtctttgtgttactttgtatgtgtttgtatgtgtgtctctggtgtgtgtatctctgtgcatgtgtgtgatgtgtgcgcggttgtgcactaggaagggaaggggcaggaagagctgagcctggtctctgggtagggtgtgtgcg

SEQ ID NO: 30636 - DNA, 601 bp, Human
ggggtctctctgcagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaaggtgcggggtgtgctgccgcatgggccgttctggctgtagggcggttgcagggtctatagggtgggtggggagctgtgcgctgctgctgctgctgctgctgctgcttggtgtgcttgctgtgtgtgttatctgtgtgtgcgcctgcacgtctctatgcatatctgtgtgcatctctgtatggctctgtgtgtgtgtgtgtctacgcctatccatgtggctttgtgtgtgtgtgtctttgtgttactttgtatgtgtttgtatgtgtgtctctggtgtgtgtatctctgtgcatgtgtgtgatgtgtgcgcggttgtgcactaggaagggaaggggcaggaagagctgagcctggtctctgggtagggtgtgtgcggctg

SEQ ID NO: 30637 - DNA, 601 bp, Human
tgatgaacatccacgtgcagccgcgtaccatctacctgtgccggcacggcgagaacgagcacaacctccagggccgcatcgggggcgactcaggcctgtccagccggggcaagaaggtgcggggtgtgctgccgcatgggccgttctggctgtagggcggttgcagggtctatagggtgggtggggagctgtgtgctgctgctgctgctgctgctgctgcttggtgtgcttgctgtgtgtgttatctgtgtgtgcgcctgcacgtctctatgcatatctgtgtgcatctctgtatggctcggtgtgtgtgtgtgtctacgcctatccatgtggctttgtgtgtgtgtgtctttgtgttactttgtatgtgtttgtatgtgtgtctctggtgtgtgtatctctgtgcatgtgtgtgatgtgtgcgcggttgtgcactaggaagggaaggggcaggaagagctgagcctggtctctgggtagggtgtgtgcggctgtggctgtcccagtggcctggggcccccacggtgtaaccaggtagtgcacagccctacgtgggctgcctgctccagccctggctcttggaggagctgcgggcatctgg

SEQ ID NO: 30638 - DNA, 601 bp, Human
ggtgtgctgccgcatgggccgttctggctgtagggcggttgcagggtctatagggtgggtggggagctgtgtgctgctgctgctgctgctgctgctgcttggtgtgcttgctgtgtgtgttatctgtgtgtgcgcctgcacgtctctatgcatatctgtgtgcatctctgtatggctctgtgtgtgtgtgtgtctacgcctatccatgtggctttgtgtgtgtgtgtctttgtgttactttgtatgtgtttgtatgtgtgtctctggtgtgtgtatctctgtgcatgtgtgtgatgtgtgsgcggttgtgcactaggaagggaaggggcaggaagagctgagcctggtctctgggtagggtgtgtgcggctgtggctgtcccagtggcctggggcccccacggtgtaaccaggtagtgcacagccctacgtgggctgcctgctccagccctggctcttggaggagctgcgggcatctggaatcagtggtccccctccaccacctctcagtttgccagtgctctgagcaagttcgtggaggagcagaacctgaaggacctgcgcgtgtggaccagccagctgaagagcaccatccagacggc

SEQ ID NO: 30639 - DNA, 601 bp, Human
tgaggagctgacctacgaggagatcagggacacctaccctgaggagtatgcgctgcgggagcaggacaagtactattaccgctaccccaccggggaggtgagcgcaggctggggcgggctgacggtccccagcacacatgaccactgctgtgcagggctgggccacccctccagggagttcacttccgtgtgggttctgggggctcctacaccctccaccttggaactgagtccccccaaactgaaccttctaacagcctggggtgaagtgcattttcccataagcagaagtgagatgtgyttccctagggacatagaactatatgggagaggaggaaggtggtgtgtgaaggtccactgggcagggtggtgggcaggctggcaggaggggtggctctatatcccctgggcagcgtctgtgcttccccgtgcacggtgcccgggtggctgtggctgaggacgctgttgcctcctctgccgatgggatcctcctgggcccggtgtgtcctccctgcccgtgccctgctgagcagtgtcgtgcctcaggcccctgcaggcccactgtcctctggcctcagactgagccttacacaccggggcc

SEQ ID NO: 30640 - DNA, 601 bp, Human
acaaagttttgctcttcttgcgcaggctgcagtgcaatgcatgcactcactgcaacctccacctcccaggttcaagcgattctcctgcctcagcctcctgagtagctgggattatacgcatgtgctaccacaccctggctaattttgtatttttagtagagatggggttttgccatgttggtcaggctggtcttgaactcctgacctcaggtgatccacctgcctcggcctcccaaagtgctgggattacaggcgtgagccaccacgcctggccgtgtctcatttctaactgtgggtgtayaatttcaatttcagaggagatgccctacctgaaatgccctcttcacaccgtcctgaaactgacgcctgtcgcttatggtgagtagcaacccctgccaagccctgtccccctgaaggtggccacagtagcttcttgtggccgtgggctgtaagcggtgctgtccctttaacagcagcttcctctgcccccatcccacgccctccaggctgccgtgtggaatccatctacctgaacgtggagtccgtctgcacacaccgggagaggtcagaggtgagtggaggccccaagcctcatcctggc

SEQ ID NO: 30641 - DNA, 601 bp, Human
tcctggccatcatcacacgatagccctagtgggtgatgggcgctcaggaggccccggggccgcttgcctgcaggtgctggcctgtctggggccatgggcctgctggctgccttcctcagcacctctttgttcctgcctgtctgttctgtggcttctggggccttctcattttctttcttcctgtgtcctcttcctcccatttctgctgagctcgagatatgaatattagtgaggaagatacattctctctttttttttatttgagacagggtctcagtctgttccccaggctggagtgcgktggcgcagtcacggctcactgcagcctcaacctcctgggttcaagtgatcctcccgcctcagcctcccgcgtagctgagactacaggtgcgcaccaccatgcccagctaattttaatttattcatttttttagataatggggtctcactgtgttgcccaggctggtcttggaactcctgggctcaagtgatcctcctgccttagtctcccaaagtgctaggataaaggtgtgagccgttgtgcccagcgtctcttctctttaacatcagcatggcacagttcttgttgcctttcctttct

SEQ ID NO: 30642 - DNA, 601 bp, Human
ccccggggccgcttgcctgcaggtgctggcctgtctggggccatgggcctgctggctgccttcctcagcacctctttgttcctgcctgtctgttctgtggcttctggggccttctcattttctttcttcctgtgtcctcttcctcccatttctgctgagctcgagatatgaatattagtgaggaagatacattctctctttttttttatttgagacagggtctcagtctgttccccaggctggagtgcggtggcgcagtcacggctcactgcagcctcaacctcctgggttcaagtgatcytcccgcctcagcctcccgcgtagctgagactacaggtgcgcaccaccatgcccagctaattttaatttattcatttttttagataatggggtctcactgtgttgcccaggctggtcttggaactcctgggctcaagtgatcctcctgccttagtctcccaaagtgctaggataaaggtgtgagccgttgtgcccagcgtctcttctctttaacatcagcatggcacagttcttgttgcctttcctttctggcagctaaaaccagtgctttcagtttccagagttactgtttcaaacagga

SEQ ID NO: 30643 - DNA, 601 bp, Human
ggtgctggcctgtctggggccatgggcctgctggctgccttcctcagcacctctttgttcctgcctgtctgttctgtggcttctggggccttctcattttctttcttcctgtgtcctcttcctcccatttctgctgagctcgagatatgaatattagtgaggaagatacattctctctttttttttatttgagacagggtctcagtctgttccccaggctggagtgcggtggcgcagtcacggctcactgcagcctcaacctcctgggttcaagtgatcctcccgcctcagcctcccgcgyagctgagactacaggtgcgcaccaccatgcccagctaattttaatttattcatttttttagataatggggtctcactgtgttgcccaggctggtcttggaactcctgggctcaagtgatcctcctgccttagtctcccaaagtgctaggataaaggtgtgagccgttgtgcccagcgtctcttctctttaacatcagcatggcacagttcttgttgcctttcctttctggcagctaaaaccagtgctttcagtttccagagttactgtttcaaacaggatcagcaggtcagcgccgccat

SEQ ID NO: 30644 - DNA, 601 bp, Human
gagactacaggtgcgcaccaccatgcccagctaattttaatttattcatttttttagataatggggtctcactgtgttgcccaggctggtcttggaactcctgggctcaagtgatcctcctgccttagtctcccaaagtgctaggataaaggtgtgagccgttgtgcccagcgtctcttctctttaacatcagcatggcacagttcttgttgcctttcctttctggcagctaaaaccagtgctttcagtttccagagttactgtttcaaacaggatcagcaggtcagcgccgccatgtgcytgtgattaggctcagaaccaccaagaacacggtgttgagagacgggaggcgtggagagcagaggcctggggggtggcgggtggggaggcgcttcaggagacctcgaggcctggccgtgcagctgctgtctaccttggggggaggcctgacatttggaggtgggccaggctgcctctgactgagtagagtgggcctctgctcaggtggacgcgtgttgtgaaagtgagtttgaattcaccgtgtacaggctgccaaaagtacaacactgtgctagtactagtcagacctttctcttagacc

SEQ ID NO: 30645 - DNA, 601 bp, Human
ccaggctggtcttggaactcctgggctcaagtgatcctcctgccttagtctcccaaagtgctaggataaaggtgtgagccgttgtgcccagcgtctcttctctttaacatcagcatggcacagttcttgttgcctttcctttctggcagctaaaaccagtgctttcagtttccagagttactgtttcaaacaggatcagcaggtcagcgccgccatgtgcttgtgattaggctcagaaccaccaagaacacggtgttgagagacgggaggcgtggagagcagaggcctggggggtggcggktggggaggcgcttcaggagacctcgaggcctggccgtgcagctgctgtctaccttggggggaggcctgacatttggaggtgggccaggctgcctctgactgagtagagtgggcctctgctcaggtggacgcgtgttgtgaaagtgagtttgaattcaccgtgtacaggctgccaaaagtacaacactgtgctagtactagtcagacctttctcttagaccgagcgtgactttctgtcatggcgttcccgaaacaggtgactgtctagtcccaggaagcttggccttcggattttggcatg

SEQ ID NO: 30646 - DNA, 601 bp, Human
cttgtgattaggctcagaaccaccaagaacacggtgttgagagacgggaggcgtggagagcagaggcctggggggtggcgggtggggaggcgcttcaggagacctcgaggcctggccgtgcagctgctgtctaccttggggggaggcctgacatttggaggtgggccaggctgcctctgactgagtagagtgggcctctgctcaggtggacgcgtgttgtgaaagtgagtttgaattcaccgtgtacaggctgccaaaagtacaacactgtgctagtactagtcagacctttctcttagamcgagcgtgactttctgtcatggcgttcccgaaacaggtgactgtctagtcccaggaagcttggccttcggattttggcatgaagggatgaggtgtccgccccagtcgctggcagttgcctggctggtgggctgacctgagagaggctggggtcccttggccgccttggtccctgtcaccccctccacttcggaatgtgggtcaccggatgctgtcctgcctttagccatatgacaacagccctggtcagggagccactgcccccgctatgggattgggcctgagccggtcctggagctct

SEQ ID NO: 30647 - DNA, 601 bp, Human
tttggaggtgggccaggctgcctctgactgagtagagtgggcctctgctcaggtggacgcgtgttgtgaaagtgagtttgaattcaccgtgtacaggctgccaaaagtacaacactgtgctagtactagtcagacctttctcttagaccgagcgtgactttctgtcatggcgttcccgaaacaggtgactgtctagtcccaggaagcttggccttcggattttggcatgaagggatgaggtgtccgccccagtcgctggcagttgcctggctggtgggctgacctgagagaggctggggtyccttggccgccttggtccctgtcaccccctccacttcggaatgtgggtcaccggatgctgtcctgcctttagccatatgacaacagccctggtcagggagccactgcccccgctatgggattgggcctgagccggtcctggagctcttccctgcagggaatgggggcagggccatgatggagacagatcccggttctgaggctggaggcccacaccccatcacgctgtccctctcatgggagggctgtgtctggtcctggccgcagaacctgcttcctgctgcacattttctgcgccttt

SEQ ID NO: 30648 - DNA, 601 bp, Human
ttggaggtgggccaggctgcctctgactgagtagagtgggcctctgctcaggtggacgcgtgttgtgaaagtgagtttgaattcaccgtgtacaggctgccaaaagtacaacactgtgctagtactagtcagacctttctcttagaccgagcgtgactttctgtcatggcgttcccgaaacaggtgactgtctagtcccaggaagcttggccttcggattttggcatgaagggatgaggtgtccgccccagtcgctggcagttgcctggctggtgggctgacctgagagaggctggggtcycttggccgccttggtccctgtcaccccctccacttcggaatgtgggtcaccggatgctgtcctgcctttagccatatgacaacagccctggtcagggagccactgcccccgctatgggattgggcctgagccggtcctggagctcttccctgcagggaatgggggcagggccatgatggagacagatcccggttctgaggctggaggcccacaccccatcacgctgtccctctcatgggagggctgtgtctggtcctggccgcagaacctgcttcctgctgcacattttctgcgcctttg

SEQ ID NO: 30649 - DNA, 601 bp, Human
ggtcaccggatgctgtcctgcctttagccatatgacaacagccctggtcagggagccactgcccccgctatgggattgggcctgagccggtcctggagctcttccctgcagggaatgggggcagggccatgatggagacagatcccggttctgaggctggaggcccacaccccatcacgctgtccctctcatgggagggctgtgtctggtcctggccgcagaacctgcttcctgctgcacattttctgcgcctttggtctccaggcttgttttgcagcctccgtgccccatcctaagccagggtgccctttgtgtagtagagatggctcttcagatcctgcctcgggtcagcggaagggagtcagcacagttgccttcccctccccagcctgtgagcctcaggcccagcctctccctcctagatgcccctcctcagctctcaagagaggctggaagcaaagctcttttctccgacctcacgctctgctgtgatcatcattctttccctccttgctttgcaagcaccgtgtttgtctgtgtggggaatcctttggtaccatccgaggaagggggcatgggagggaattgcccccattcttgc

SEQ ID NO: 30650 - DNA, 601 bp, Human
tggtcagggagccactgcccccgctatgggattgggcctgagccggtcctggagctcttccctgcagggaatgggggcagggccatgatggagacagatcccggttctgaggctggaggcccacaccccatcacgctgtccctctcatgggagggctgtgtctggtcctggccgcagaacctgcttcctgctgcacattttctgcgcctttggtctccaggcttgttttgcagcctccgtgccccatcctaagccagggtgccctttgtgtagtagagatggctcttcagatcctgcctcaggtcagcggaagggagtcagcacagttgccttcccctccccagcctgtgagcctcaggcccagcctctccctcctagatgcccctcctcagctctcaagagaggctggaagcaaagctcttttctccgacctcacgctctgctgtgatcatcattctttccctccttgctttgcaagcaccgtgtttgtctgtgtggggaatcctttggtaccatccgaggaagggggcatgggagggaattgcccccattcttgctgcctggcagtcaccgcacactcagcagcccatggtccctggcc

SEQ ID NO: 30651 - DNA, 601 bp, Human
cgcctttctctcttttgtctttgtcttgcttaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaagtcagtgcactcccctttccttcctgcctgggggacgcatgccgggcgtgatgccacagatctgggattgcgtgcgtgtgtgtttgcaagaatrcgtgcgtgggtgcgtgtgggtgcgcgtgcgtatgttgtaggtgtctgtgcacgtgtgttgtgggggcatgtgcacacactcacgtgttgagggagaacataggaagcaccctccgaagttaagatcctgggggctttccttgctggtgacaaccgtgactgcgttcgcctcctttctgaggatggggtctttacagggcagaagcaggcagtgcagaaggaagagtgagatgtccaagacccgttcacgttcgtgaatggttatttctaaaacaaagaaagtggctactttctcacataa

SEQ ID NO: 30652 - DNA, 601 bp, Human
cacactcacgtgttgagggagaacataggaagcaccctccgaagttaagatcctgggggctttccttgctggtgacaaccgtgactgcgttcgcctcctttctgaggatggggtctttacagggcagaagcaggcagtgcagaaggaagagtgagatgtccaagacccgttcacgttcgtgaatggttatttctaaaacaaagaaagtggctactttctcacataaataacatggttatcccagcaggtagtaaaaaacctaacaaacaaggccaggcgcggtggctcacgcctgtaatcmcagcgctttgggaggccgaggtgggcggatcacctgaggacaagagttccagaccagcctggccaacatggcgaaaccctgtctttactaaaaatacagaaattagccaggtgtggaggcgggcgcctgtaatcccagcttctcaggaggctgaggcaggagaattgcttgaacccaggaggcggaggttgcagtgagccgagatggtgccactgcactccagcctgggtgacagagggagactccgtctcaaaaaaaaaaagcaaaaaaccccaacccgatttcacttatttcattaat

SEQ ID NO: 30653 - DNA, 601 bp, Human
ctgcatcaggcccagtgtcgggcatgtggtggggacgcgtagacacggtgaggtggctgtgattagcggaagcctggaggcctggctttggtggtagctccacactaacatgagtgcagcaatttaattgcccaggttccttcccctcccaggccctcagtctccttagctttgcacatgataggagcaggactgggagagctctcatacatattcccttgcaggtctcagatctgagggtttttatgaaaagccagcagaactgaaatggtgtccctgtggcatccgttctgatggaaaygtgcagttgtatttggaagttcagaggccgctgctttgatgcttggggggaccaggctggggaagggggttgatatcctgagctgcacagacctccgtcgtggaggacgcagtggcaggggctgcatcctcctgtccgcttcagagctgcccctggcgttgggaggacagtccttcagggtggccaggttcttagggacgtctgaagctgctggctgggccggcgtggggtttttcagggcttcgtccctgcagattgcgccctgcctcctgactgacttctctctctgcttctcctccg

SEQ ID NO: 30654 - DNA, 601 bp, Human
ttgcactgctttcttcctgcttgctcatttggcctcctgcctgttaaaatattgaggatgagagcagttttgtgatgtgaggtcttccgtgggggaaggaggagatgggcgtaggagtagggaggagagattcctgaatgtttttggaaaagcgtgcaggcggtcatggtggctgcactactgttgggtgtgttccgacaccgccgcacgaccgctggcttctcccctaccctctcagggctgcaggtcgtggtttgtaatggccgtggtttagggctcggcataaatccacatttccttrtcagaatcagatcttggtggcgagctgcatctgtgccaggtgccattagccttaaagccccctcctgccccaggagtgtcctttgttttggaaggaaaacttactcagagcctaatctgtaaaccaaacctatggggaatagtgggagtgtggtggggcctgagctctgagcctctccctccccatgaggaccccccacaccccaaaagagctccaagtggagacccttggggatccgtttgtcctgggttggagcctgctcagcgtcatagtcacgcccggggctgggtgcagcctcca

SEQ ID NO: 30655 - DNA, 601 bp, Human
gcctaatctgtaaaccaaacctatggggaatagtgggagtgtggtggggcctgagctctgagcctctccctccccatgaggaccccccacaccccaaaagagctccaagtggagacccttggggatccgtttgtcctgggttggagcctgctcagcgtcatagtcacgcccggggctgggtgcagcctccatctctaacccatgtggtcacttctgctcctcccagagctctctgcagagtttcaggttcagccttagctctggcagccactgggtagctggggctgtgttcccactgctgtgggatcccttccccaccaggagcagaggccttcctgccacagaactttaatgacagccacatgaagtgtcatccccttgcccccccaaaaacacacccgcccctttatttcctgtttgctccttaagttaccttaactactttatgcagaaactggaaaggtgtgatgaggaatgcagcctgagatgctgaaaagaatgactggctttggaaatgggagaggtttggcatggcgctcagattttggtggcaaaggggtgaagggccagaggatgtaccagtgtcctccatgtccacgtt

SEQ ID NO: 30656 - DNA, 601 bp, Human
cagtcccccgtttaatggttgaggggctgagtgaccggcccgtgcttccagcaggtgagccgcagagccggggcctgaaaggccccttgcttcagaaagccggccgcctcctctctgcggcttctgggagtgggctgggtgcccgttccctgctgctgtcctgaggcccctgccctgtgacccgcaaggcatgggcagctgttggaccctcgtgtacccccacagccacccccttgcagctgcttcccacagccaggctttgcttacctaaggtgggcctgcccttaacttccagcttctyggggcgcaccctccatcctcagggccagtgtctgtgatgcgcggggccagcgtgcagtgcttcaggatctgggcttctccttgtgtgaaactttttggacttggagcctgaaggttttacatctgtgcatgtcctgatcctttagaccagcagtccccgacctttttggtaccagggacccgtttcgtggaagagaattttccccaccatggcagggtaggggatggtttggggataaaactgttctgcctcagatcgtctggcattagattctctgaagggaacgcacagcctagatcc

SEQ ID NO: 30657 - DNA, 601 bp, Human
cccacatctaggattgtagccacatctgattctaggagtccacctgggctctgtgaccagaatttatgatgaaagtcagaccaagccaggcctgcatcttggttctactcctcctggcctctatccttggcactctgggcaagttaaagcaattctaggacctcagcttcctcatctgtaatatggagataataacttcataaagttgtcataatgagactatagatacagcacttagcacaatatctggcccctaggaagtgcgtgggggatgacggctgctgttgttatcagggaggawcttggtgccctgggcctgtggagacttctgggcttgctggcattgggtcagcctttggataccctcctgtaacctgagggatttcttctctggggcagcaggaacacccagacttggggaggggaaatccctggggtctcaaggccatggcctgaagtctttttttttttttgagatggaattctgctcttgttgcccaggctggagtgcagtggcgcgatcttggctcactgcaacctccttctcccgggttcaagcgattctcctgcctcaacctcccgagtagctgggattacaggc

SEQ ID NO: 30658 - DNA, 601 bp, Human
ctcctgaaaacagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccacyctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgag

SEQ ID NO: 30659 - DNA, 601 bp, Human
ggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgcygaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgttggggtgtcttgccctggggggcttggaacctctgaaggtggggagcggaacacctggcatccttccccagcacttgcattaccgtccctgctcttcccaggtggggacagtggcccaagcaaggcc

SEQ ID NO: 30660 - DNA, 601 bp, Human
tggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgttggggtgtsttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgt

SEQ ID NO: 30661 - DNA, 601 bp, Human
caagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctcyccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagata

SEQ ID NO: 30662 - DNA, 601 bp, Human
agtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcractctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctc

SEQ ID NO: 30663 - DNA, 601 bp, Human
tacattcgtgttcagaaaaaaaagccatagaataatactatttcgttaactgataccaagattgccaggaatcttgacttccctaagtcatatgacagtttcttgggaatttacctttttaatgtcagtgttaattagcactgttactttgaaagaaaacccggttgattttcatgatgacagattcccatgttgactggtggctcttctgagtgtctaactggatcagcttttgaatgggaatcttgtagcctcgtctccccagttgtaggcatgagaggggctgtcccagtaatgaatytgcaggggccccagtgctctatctttgtaccttgctcgtgcttggatggttgtgccatacacaggcagctctccattgccctcccaccatagatgagactttgttctcctggaagctgtggtgttttgtgcttttgagtatctgagtgttttgtgttctgtgacctgaatgaattgaggagcaggtggatcgagacttggctgaggcccttgtggtctttcttggcttgcgatcttgttaaacacggtgttctgaacccactggcatttggctcatcatcccactgactctggagccagt

SEQ ID NO: 30664 - DNA, 601 bp, Human
ttttttttctctgtatagcaattaaaggagggagattctgtgatgtagtcagcctgcttccttagcctagaagtccttagtcctttggtatttccaattgacttttttttttttttctaaaatgcaaatctaataatgtcccgcctgagctctccagtggctccctgtggattcctgtgggtttcatgcaaagactgagctgctctgtggcccgaatcgtctggcccctctggaccccaggacgcccccaacatctctgcctggcatatcttgggcacctctctgcctgccctggagcacyggtcctcactgttcccatcactcttctccctcctgcctgccaggtctttgctccgaccccactgctgcctcctgtgcaccaaggcacggtgaccacctccaacacagcctggttgctaccagccacctcctcccaggcagctgtgccaggtgcagatgacacctggagcactgcccttttcatacccgagtgtttccaagggcctgggaagtgtttaatcagcattattttaaataaacattgaaatatatctacagcgtagacctatcataattattttgccatttttccaaggttgaa

SEQ ID NO: 30665 - DNA, 601 bp, Human
tgccaggtgcagatgacacctggagcactgcccttttcatacccgagtgtttccaagggcctgggaagtgtttaatcagcattattttaaataaacattgaaatatatctacagcgtagacctatcataattattttgccatttttccaaggttgaacatttaggtttctctcttttcacaatcatttttttttcaaatactgaaatgaatcttttaaggcttcttattttttattatttatttatttacttatttatttattttgagacagagtcttgctctgttgccccggctggagtrcagtggtgtgatctcagctcactgcaacctccgtctcccaggttcaagcaattctcctgtctcagcctcctgagtacctgggattacaggtgtgtgccaccacgcccagctaatttttttgtatttttagtagagacagggtttcaccatgttggccaggctgatcttgaacccctgacctcaggtgatccgcccaccttggcctcccaaagtgctgggatcacaggcataagccactgtgcctggcctttttaaggctttttatacatgctggcagattgccttacacaaatactgtgt

SEQ ID NO: 30666 - DNA, 601 bp, Human
ttcaaatactgaaatgaatcttttaaggcttcttattttttattatttatttatttacttatttatttattttgagacagagtcttgctctgttgccccggctggagtgcagtggtgtgatctcagctcactgcaacctccgtctcccaggttcaagcaattctcctgtctcagcctcctgagtacctgggattacaggtgtgtgccaccacgcccagctaatttttttgtatttttagtagagacagggtttcaccatgttggccaggctgatcttgaacccctgacctcaggtgatccrcccaccttggcctcccaaagtgctgggatcacaggcataagccactgtgcctggcctttttaaggctttttatacatgctggcagattgccttacacaaatactgtgtccacttaggctttattgcttttattttttttttttaagagaaacataaacagttttcctaatatgttgtaccatttaaaggcagcagaatagaagtcatcttattgcaaaaacaagacattggagggaagagagcgcagggctggaggatgtgagaggcgtcctgtgcgggtgggcgttcatggctggcccc

SEQ ID NO: 30667 - DNA, 601 bp, Human
agattaagatgttatttctggccaggtgtggtggctcatgcctgtaatcctagcactttgggaggctgaggcgggcggatcacttgaggttaagagtttgagaccagcctggccaacatggtgaaactccatctctactaaaaatacaaaaattagccagacatggtggcacatgtctgtaatcccagctacttgggaggctgaggcaggagaatcacttgaaccggggaggcggaggttgcattgagctgatatcgcaccactgcactccagcctgggcaacgagagcgaaactctgtcwcacacacacacacacacacacacacacacacacaaagatgttatttctaatacctataaaagttttagaatatcaatctataaattttgtgtaaccttgcaaaaagaaatattcaggcacagatgattttactgagaattctacccaacatataaagaagaagagagcagcaagtctgcatagtctctttcaggaagtagaggaggagtgaatgcttcccaactcactttataattgacatcactctgacactaagaccaaagacaataccaaataaggaaaatacaggccaatatcctt

SEQ ID NO: 30668 - DNA, 601 bp, Human
gtctgtaatcccagctacttgggaggctgaggcaggagaatcacttgaaccggggaggcggaggttgcattgagctgatatcgcaccactgcactccagcctgggcaacgagagcgaaactctgtctcacacacacacacacacacacacacacacacacaaagatgttatttctaatacctataaaagttttagaatatcaatctataaattttgtgtaaccttgcaaaaagaaatattcaggcacagatgattttactgagaattctacccaacatataaagaagaagagagcagcaartctgcatagtctctttcaggaagtagaggaggagtgaatgcttcccaactcactttataattgacatcactctgacactaagaccaaagacaataccaaataaggaaaatacaggccaatatccttcatgaacttagatgtaaaaatcatcaataaaatattaacaaatcaattctagcaatatgtaaaaagaataatacgtagcgaccaagtcaagtttttcctgggaatgtcagacttgtttagtatttaaaagtctgccaggcgcagtggctcacacctgtaatcccagaactttgg

SEQ ID NO: 30669 - DNA, 601 bp, Human
tagtatttaaaagtctgccaggcgcagtggctcacacctgtaatcccagaactttggaaggccgaggcaggtggattacctgaggtcaggagttcaagaccagactggccaacatggcgaaaccctgtctctaccaaaaaatacaaatattagccgggtgtggtggtgcatgcctgtagtcccagctactctggaggctgaggtgggagaatcacttgaacccggtaggcggaggttgcagtgagctgagatcatgccactgtactccagtctgagtgacagagagtgaggccctatctcaaaaaaaaaaaatttttttttaagttcagcatagaattatatataactcagcaattctactcctatgcatatgtatacctaacacaaatgaaaaaagtccacacaaaaacgtgtacatgaattttcatagcagcacagcctatcatggccaaaagctggaaacagtgcccatgcccatcaactgatgaatgaacagacacattatggcatctccatgcaatgcaagaatatttagcagtaaaaggaatgaagtggcgggcgcggtggctcatgcctgtaatcccaggactttgaggggcca

SEQ ID NO: 30670 - DNA, 601 bp, Human
catttagacagaatgtctagaagaggcaaatatatagagatagcaagtaggttctaacaggctggggtctgggaaaaaatggagaatgactgctattggatacagggtttctttgcggggatcatggaaatgttccaaagttgacggcggcaatgctgtgcaactgtaaaaaccgttgaattgcatactttcaacgggtggaccgtgtggcgtgtgcattttcacccaacagaggtgttagtgaagtagtgcaggcatacacgcaaagacattctcacggagatgtagaacgtaaatggaytcttttttttcttttctcctcaggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaaccgataatttagtaagtaaaataaattttatttttagttttcaaaatgtgaaatctgttcatgaaattttaggcttctaagtagaactttagactgcttgtagttctgctaaagga

SEQ ID NO: 30671 - DNA, 601 bp, Human
actttcaacgggtggaccgtgtggcgtgtgcattttcacccaacagaggtgttagtgaagtagtgcaggcatacacgcaaagacattctcacggagatgtagaacgtaaatggattcttttttttcttttctcctcaggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaacygataatttagtaagtaaaataaattttatttttagttttcaaaatgtgaaatctgttcatgaaattttaggcttctaagtagaactttagactgcttgtagttctgctaaaggagagactcatacaactctaaaagaatttttatggtgtgtgtaatgtggatatccccaagtcttccagccttctctaggtatcttttatttatttagtttttatttttagatttattttatttttgtagacacatcttactgtattcccccagatggtctcaaactcctggcctcaagcaatcttccc

SEQ ID NO: 30672 - DNA, 601 bp, Human
tgtttgtaaaggtccgtagggctggggtgttcgggtggcatgtctgtgacctgtgtctgtccttggcttatcatggacatggacacagacttgagctgtattctccaagacagctctgtcttttttttttttttttttgagacggagtctcgctctgttgcccaggctggagtgcagtggtgtgatctcagctcactgcaagctccgcctcccaggttcaagccattctcctgcctcagcctcccgagtagctgggactacaggcacccgccaccacgcccggctaattttttttgtattkttagtagagacgggatttcaccgtgttagccaggatagtctcgatctcctgatcttgtgatctgcctgcctcagcctcccaaagtgcagggattacaggtgtgagccaccacgcccggcgacagctctgtcttgaggctgacagtgatttgtgatgccctccccccagggccagggctccaaaatccagtgttttctgtgccctccagaggcaatggagaacatcttggttccgtcatcactggattgctctgaatgagctgcacctgaggcacctgtacagcactgtcagctttgggca

SEQ ID NO: 30673 - DNA, 601 bp, Human
actacaggcacccgccaccacgcccggctaattttttttgtatttttagtagagacgggatttcaccgtgttagccaggatagtctcgatctcctgatcttgtgatctgcctgcctcagcctcccaaagtgcagggattacaggtgtgagccaccacgcccggcgacagctctgtcttgaggctgacagtgatttgtgatgccctccccccagggccagggctccaaaatccagtgttttctgtgccctccagaggcaatggagaacatcttggttccgtcatcactggattgctctgaaygagctgcacctgaggcacctgtacagcactgtcagctttgggcagaccacactctctgggtgtgctctcctgccagagtgtaaccacgtgtttacttctcagagctgggtacacaaagatccggcatcagggaaccttcactggattcccttcgagccatcttggtcccatatcaaaaccctggttagggccttcaacagaaaaggtttttggaaaactcatttttcctgaataaattgctgaggtcttagtttttaagaaaattctcattatatactcgatgcttaccatgaaacagat

SEQ ID NO: 30674 - DNA, 601 bp, Human
cctgcctcagcctcccaaagtgcagggattacaggtgtgagccaccacgcccggcgacagctctgtcttgaggctgacagtgatttgtgatgccctccccccagggccagggctccaaaatccagtgttttctgtgccctccagaggcaatggagaacatcttggttccgtcatcactggattgctctgaatgagctgcacctgaggcacctgtacagcactgtcagctttgggcagaccacactctctgggtgtgctctcctgccagagtgtaaccacgtgtttacttctcagagctggrtacacaaagatccggcatcagggaaccttcactggattcccttcgagccatcttggtcccatatcaaaaccctggttagggccttcaacagaaaaggtttttggaaaactcatttttcctgaataaattgctgaggtcttagtttttaagaaaattctcattatatactcgatgcttaccatgaaacagattttgtgggtgagttatctgacttgaatctgtctcctcctctctgagatgagactaacagtgcatgctctttgggtgaggatccgatgctctctccacccctgagtctgt

SEQ ID NO: 30675 - DNA, 601 bp, Human
ctgccactgtgaacatctgcattgagtcatgagaccaccagctctttcagaattcactgggtcatctttatgactttctacaagaaggaccctctaggtctctgaccccagcctggtttgggaatgaactccctcagattatgaagtgagtcctcaatctgcatactgggcccccggtcccatgtttatggaaggcacaattccattcatttctttcttttatttcttctgaaaatattttacttattcttttgaaaaattgtgtaaaatacacataatataaaatttaccatcttagctrttttaaaatttacagttcaatggtgttaagtttattcacattgttgggcaaccatcaacaccatccatctccagaactttctcatcttctcaaactcaaactctgaccccattaaacactcattccggattccccctcccctagcccctggaacccaccgttctactgtctgtctctgtgaattcgatgactccaggtctctcatgttaagcggaatcgtacagtgtttgtccttctggatcctttgcttgtttcattgtgcagaatgcctggagggttcatccatgcggaagcactatt

SEQ ID NO: 30676 - DNA, 601 bp, Human
ctggatcctttgcttgtttcattgtgcagaatgcctggagggttcatccatgcggaagcactattgtgttttagccattctgatgatatgtagtgatattaatatttctttgtggttttaattttcatttccctgatggctaataatgttgaacattattataccctctgtgtattttctttgataaaatgtctgctgcttatgtcttttgccttttttttttttttttttttgagacagagtctcactccatcacccaggctggagtgcagtggcgcgatctcggcttactgcaaactcygcctcctgggttcatgccattctcctgcctcaccctcctgagtagctgggactacaggtgcctgccaccacacccggctaattttttgtatttttagtagagacggggtttcaccgtattagccaggatggtctcgatctcctgacctcgtgatccgcccgccttggcctcccaaagtgctgggattacaagcatgagctaccacgcctggccgtcttttgcgcattttttagttggatttttttttaacttctgagtgttgagagttctttgcttattgtagatactagttctctgttg

SEQ ID NO: 30677 - DNA, 601 bp, Human
gttttctccaagtctatagtagctaagtatttttctcatcctcttaacaggtctttttcagagccagcctttttaattttaataaagttcaatttattaggttttccttttatggatcattcttttggtgtcaagtctaagaactctttgcctaaccctaggtcccaaagacttcgtcttaagttttttcctaaaagtttttaaatagagacaaggtctcactatgttgcccaggcttgtcccaaactcctgggctcaagtgtgaaccaccatgcctggcctcaaaagttttatagttgtmcattttgcatttaaatccgtgatccattttgagtggatttctctatagaataactctcaaagctgggcacattgtttcctcccaccctgtgattccttttcaaaattgtttagctgttctggttcctttgcctgtccacataaattttagaatgctcttgtctagagctacaaaaacatcttgcttagattttgataggaattgtattatacctgtatatcaatctggggagaattgacatctttactgcattaagtcttccagtccacaggtatggcatgtctctccattgattgacaa

SEQ ID NO: 30678 - DNA, 601 bp, Human
tcccaaagacttcgtcttaagttttttcctaaaagtttttaaatagagacaaggtctcactatgttgcccaggcttgtcccaaactcctgggctcaagtgtgaaccaccatgcctggcctcaaaagttttatagttgtacattttgcatttaaatccgtgatccattttgagtggatttctctatagaataactctcaaagctgggcacattgtttcctcccaccctgtgattccttttcaaaattgtttagctgttctggttcctttgcctgtccacataaattttagaatgctcttgtstagagctacaaaaacatcttgcttagattttgataggaattgtattatacctgtatatcaatctggggagaattgacatctttactgcattaagtcttccagtccacaggtatggcatgtctctccattgattgacaactctgatttcattcatcagtgctttgtagtttttgacacataagttgtgtacatgcgtttttagaattatacccaagcatttcctttcctggcctgtgccatctcgaataagagtggcaagagcagacatccttgccttgtcaccgccttaggggacacctt

SEQ ID NO: 30679 - DNA, 601 bp, Human
tatagtgatctcttcctgttttatttctgatattgatcttttgtgtctctattttttttttagtcagtctttctagaggtttatgtaattttcaaagaacagtattttgttttattgatttttttggttgtttttctgttttcagtttcattgatttcaccttgatctttattatttcctttcttctgctttcggttcatgatgttcctctttttctaagatcttaaggtggaagctgggatgattgatttgactagcttaacttttattacagcctaattaatgtggcaggctttaagcrtagccactaagcttacacattccgctcgatgatggcccacagaatcaccgccttggggtggcgtccccttatgctatgtaactgctcacatgtcagggcacatgagtgtgccaggcccggcactggaggctcctctcccctgccagctgcccacccaggcgtcacagtcagtggataaagtggcccatgtggatctaaccccagatgcatagagtcctccatggggcatgtagaaacatttgcatggggctcgctgtaggccgggcacagttccaagcactgtacaagcaagaacactgg

SEQ ID NO: 30680 - DNA, 601 bp, Human
atcacacttagtccgtgccggggtcaagagtcaaggtgggtgccaggggctgactccccagcacagcttggaatacctcagccctggtcacttctagtgcctcccaggcctgtgctataatctcttgaatgctcttatcggtcagggagagcttggttcatggaaaactcaagagtccaccaagccaagtctaatgaaaaagatgtgtgatcagaaagcagggtcttcctcgatatactcctgggctgtaaggcacgtggaatatggcagtgagatgaagataatcttttggaagccacartgcaggctgacgttgcaggctggcttgttgtgtttaatacacagttgaacatctcttgctttccgtgtgtgctgcgtgcattctgaagccgcgtcatctgaggatgttctttccctcaagcttctctttccttttttaatggtgtcattatgctacttatgttaaagttttaaacatgggttttccgttttctagtaattccttcaacatgtgtgttctgacttgcagcagattcaaagtgccatcacaggcaccatcagccctcagggaattgtggtgccggcgtccgcgctgcagcag

SEQ ID NO: 30681 - DNA, 601 bp, Human
ctcttgctttccgtgtgtgctgcgtgcattctgaagccgcgtcatctgaggatgttctttccctcaagcttctctttccttttttaatggtgtcattatgctacttatgttaaagttttaaacatgggttttccgttttctagtaattccttcaacatgtgtgttctgacttgcagcagattcaaagtgccatcacaggcaccatcagccctcagggaattgtggtgccggcgtccgcgctgcagcagggaaacgtagccatggcgacggtggcaggtacgatgacagaaaaatggacacrctctccatgagtttttgcagaaaatggtcctgtgtgttagaatgacagtataaatataatttcaagttcatgccattttctaatatagcaatgttagaagctagaggtctctgaatgcctctttcttgttaatactcaataacaaatattttatgcagattgtgtttctttgtttctctaccaaaaatatattggaaagaaaaaaggttttatgtaggaattgaaaatatacaccaaaaaccagttgtcattttcaaataacatagctttttgttgtgcttttaatagcaccgtgaaaat

SEQ ID NO: 30682 - DNA, 601 bp, Human
aaaattctgaaagaacaggaaaaaagtcactcataaccaccccctgccacccacacacacacacacacacacacacacacaccacaccacacacacacagagttatccagtgctaacgttggatcatgtgcacgtgcaccaggggcagaggtcttgtaggcacacactccccagggtccccacaaagggcacggcagaactgccaggcaagcttttcagaccagtgagcctggcccacacctccatcatgacaatgtcattgggccagggctttcaggcctctctgtcacccaggctggaktgcagtggcgctatctctgcggctgctgagccttgcccgtctttggtgtgtgttatcagttcttactttaagaacattgattctgggccgggcacggtgacgtctgtaatcccagtactttgggaggccaaggtggacagatcacgaggtcaggagttcaagactagcctggccagtatggtgaaaccctgtccttaaaaatacaaaaattagctgggtgcagtggtgcacgcctgtaatcccagctactcgggaggctgaggcaggagaatcgcttgaacccgggaagcagaggttgca

SEQ ID NO: 30683 - DNA, 601 bp, Human
ctcactgcaacctccacctcccaagttcaagtgattctcctgcctcagcctcccgagtagctgggattacaagtgtgtgccactatgcctggctaatttttgtatttttagtagaaatgggtttcaccacgttggccagtctggtctcaaaatcctgggctcaagcagtccgcctgcctcggcctcccaaagtgctgggattacaggcgtgagctaccgcacccagctctcaagaaggttggtgttcttttttccaatcttttgtgtttttctcatcttttagaagcttctctttttttgyaggtgctctgatttttttttttttttttttttttaagagacggtctcgctctgttacccaggctggagtatagtggcacaaacacagctcactgaagcattgacctcccaggctcaagcaatcctcccaccttcacctcctgagtagtgggactacaggcatgtgccaccttgcccagttaatttttaaatgtttttgtaaagacggggtctcactatgttgcccatgctggtcttgaactcctgggctcaaatagtcctcctgccttggcctcccaaagtactgggattacaggtgtga

SEQ ID NO: 30684 - DNA, 601 bp, Human
aaagacggggtctcactatgttgcccatgctggtcttgaactcctgggctcaaatagtcctcctgccttggcctcccaaagtactgggattacaggtgtgagccactgtgcctggactaaagttaggtttatatgtgaactcttaaacaggctgacctatccatgctgcggaccctacggagcgattttgcttccttccttccttccctggtctgcgcagtgcgcagtggcagcatcatctcagcaggcacctggggagggagacgctgtgtgagggaggccgtgccagggcctggagcayggccttgtaacgagcagatcttctctcgtgttttgtgagaaggaatttaacaaagaaatgccattcacatctttttcttttaaaatgaagttggcagagtagcctacgctttcctgggtgacaggagggaaggtccgtatctctagtgcctgtggaggcgtctggaacaaggagtcagcctgtgccctcctgttctgcggaccctctttctgcctttgtgctgtttctgtttctttcccctctgctcccctggcgtgtcctgctcttgagagttggattttctggtgtccctgttcattc

SEQ ID NO: 30685 - DNA, 601 bp, Human
ggaagctgagatgggttagagacatcgcagggccgggtgcacccacaggtgggccaccgggtgggtgcctttcgctggaagcgagtttgtcccacagggcgcgccgttttgcccagcacgtgtgcacccggcttcctcccccgggccatggccgcgtcttctccctgtccccaggacatcttaggaagtgcagtggtgggcctgcttgctgagttgatgggggagacctgctctgcacgctgtgtggcaccattgctgccagcctgctgatccagggcaggagagagcaggcggggctctsctgggacaagcacagggaggccaaggcgggaaggcagacgccagtttggcttggccctaagtttgcccttctcccctgctgtcgccactgattgttgtgaggctgtggccatatccgcctgtgtcccagcctcctcctcctcggccttctgcactgcatctgccctgccctcccactgtctcctctccagggtgcctccgctggggctgaagcctgtttgtcctcagcactctgtccttgccctcccctgactgtgggcccctgagcccgtagccatctcgccatttcgcggcccacttt

SEQ ID NO: 30686 - DNA, 601 bp, Human
gtgggcctgcttgctgagttgatgggggagacctgctctgcacgctgtgtggcaccattgctgccagcctgctgatccagggcaggagagagcaggcggggctctcctgggacaagcacagggaggccaaggcgggaaggcagacgccagtttggcttggccctaagtttgcccttctcccctgctgtcgccactgattgttgtgaggctgtggccatatccgcctgtgtcccagcctcctcctcctcggccttctgcactgcatctgccctgccctcccactgtctcctctccagggtgyctccgctggggctgaagcctgtttgtcctcagcactctgtccttgccctcccctgactgtgggcccctgagcccgtagccatctcgccatttcgcggcccactttcctctggctgcctcgggctcctcagttgaggatagggtccatgggagtgactggcctgagggcttgaaactggtgggtagtgttgctgagtggtcctgggaggagaagggccctctcctgggcagaaggcctggcaggagcctgggctgcgcctcttctgcttgcctgccctggcctcttggtctccaccgagcc

SEQ ID NO: 30687 - DNA, 601 bp, Human
tcacgtcaaagccaaagtaaactctcactgctgactttgctggtaccgttcattctcttgggtccttgttgatcccaaatcaagggctttagtgcattcaggttttagagtaaatgtcgtgttggtttccacatatagacagtcatcaaccttggagaaattatttaccatagctagaaatcattttcggttggtacttctgtgagttttgctatctagttctgattggattttttttttttatttttctgcactcccaggctggagtgcagtggcgcgatctcggctcactgcaacctcygcttcctgggttcaagcaattcttctgcctcagcctcccgaatagctgggactacaggtgcgtgccaccatgcccggctaattttttgtatttttagtagagataaggtttcaccgtgttagccaggatggtcttgatctcctgacctcgtgatctggccaccttggcctcccaaagtactgggattacaggcgtgagccaccacacctggccagatttttttttttttttcccagatggccaggctggtctcgaactcctgacctcaagttatccacctgcctcagcctcccaaagtgc

SEQ ID NO: 30688 - DNA, 601 bp, Human
ccatgcccggctaattttttgtatttttagtagagataaggtttcaccgtgttagccaggatggtcttgatctcctgacctcgtgatctggccaccttggcctcccaaagtactgggattacaggcgtgagccaccacacctggccagatttttttttttttttcccagatggccaggctggtctcgaactcctgacctcaagttatccacctgcctcagcctcccaaagtgctgagattacaggcgtgaggcaccgcgcctggccctctggttggattttttgtatgtgaaatgtttcartcatacataaaagaagaataccatagcaggcactcctgtcaccagccctgggttcagttccttactgacagcacaggtgaatccagcagagatctcaccccaggaaagccgtcgatggcatcagcttatcccagtgtcagttgattcctgtggtacccatgatggaaatttgtcccccagcctgcctggccatttcctactccacctgtttcaccagctgtgggatgggggcagtttgtaaacacttcatgcctcagtctcctcttctgtaaaataaagacactgacagtgactgtctca

SEQ ID NO: 30689 - DNA, 601 bp, Human
aataaagacactgacagtgactgtctcagcaggtgcttctgaggaatcagtgaattattatagaatggaccaaggtaattgaaatgtgctgtgtattgcttgtggcagaggctcccgggccagaacgcatccacccatcctctttatatggatgtagtttattgttcataagttaaagttcaataaagttgataaagaatctatagattgtatcaagcctggtgtagactcaccgctggactgcatagctgctcctcatgatgtcgctgctgttatcgtcaccgctgaaccgttaaacgtggggggcggtctgccttggcctatacgctaaccagccactgcagcactaggacattcctgggacgaggagaaacactttgttcgtgagactacagttaggttttggctagaagcactgttgacgtgaccattattttctaatgattatgtaatgctcacattttgcctaaatcgtcttgatttcctttgtaaactcgaaggccatggtaaccttctttttttattttcagcatccctacccaacagaggatgagaaaaaacagattgctgctcagacaaatttgacactactccaagtcaa

SEQ ID NO: 30690 - DNA, 601 bp, Human
tcagcaggtgcttctgaggaatcagtgaattattatagaatggaccaaggtaattgaaatgtgctgtgtattgcttgtggcagaggctcccgggccagaacgcatccacccatcctctttatatggatgtagtttattgttcataagttaaagttcaataaagttgataaagaatctatagattgtatcaagcctggtgtagactcaccgctggactgcatagctgctcctcatgatgtcgctgctgttatcgtcaccgctgaaccgttaaacgtggggggcggtctgccttggcctataygctaaccagccactgcagcactaggacattcctgggacgaggagaaacactttgttcgtgagactacagttaggttttggctagaagcactgttgacgtgaccattattttctaatgattatgtaatgctcacattttgcctaaatcgtcttgatttcctttgtaaactcgaaggccatggtaaccttctttttttattttcagcatccctacccaacagaggatgagaaaaaacagattgctgctcagacaaatttgacactactccaagtcaacaactggtaaggtgccctgcttcct

SEQ ID NO: 30691 - DNA, 601 bp, Human
tttctaatgattatgtaatgctcacattttgcctaaatcgtcttgatttcctttgtaaactcgaaggccatggtaaccttctttttttattttcagcatccctacccaacagaggatgagaaaaaacagattgctgctcagacaaatttgacactactccaagtcaacaactggtaaggtgccctgcttcctgaaatcatgctgtcagcacggtagagcacttggaaaccctggcaccaatacatggtgaaatcttgctgaaaataggaggtctctctttttcttttttcccaactgagayggggtcttgctgtgttgcccaggctggtctcgaactcctggcctcaagtgatcctcccacctcagcttctcaaagtattgggatcatgggtgtgagtcactgcacccgactaaaaatatgagttcttttaatgggcaatgggagcaggagacttaggaataaaccaggttcaacctaagttttcatatcaatacctcattatggactgcatcctgcctgcctctttagagctgtttctctagggtgctactgtccccaagccccacattcatacaaaactgtgatgtgttgttagtggat

SEQ ID NO: 30692 - DNA, 601 bp, Human
aacagaggatgagaaaaaacagattgctgctcagacaaatttgacactactccaagtcaacaactggtaaggtgccctgcttcctgaaatcatgctgtcagcacggtagagcacttggaaaccctggcaccaatacatggtgaaatcttgctgaaaataggaggtctctctttttcttttttcccaactgagacggggtcttgctgtgttgcccaggctggtctcgaactcctggcctcaagtgatcctcccacctcagcttctcaaagtattgggatcatgggtgtgagtcactgcaccygactaaaaatatgagttcttttaatgggcaatgggagcaggagacttaggaataaaccaggttcaacctaagttttcatatcaatacctcattatggactgcatcctgcctgcctctttagagctgtttctctagggtgctactgtccccaagccccacattcatacaaaactgtgatgtgttgttagtggatgagcctctggatggtgggaggccaagagtgagaggtcctgccccatgaggggaccctctgccactctttcttgtgggggtcctgctccacagaagagtctgggagcc

SEQ ID NO: 30693 - DNA, 601 bp, Human
gcactgaagtggggggtggtcttccattttggttattagtcacttgtcacatttttttaatttacttattcagatgtaggaaacagtttcagcttaataaaactggcatgcataaaagaagaaagcacaaattcttccagttgtaaacattattatctttatcttagctgtgctaaaatgtgaacttgttgaagttccagcaagaaagtctttgtctttgtgcagtcgtgtgtgcgggaggtatgcttcggggttgcataagtacttccatgatcctgcattcttgccattcttttagatktgggtagtcacaacagactatactatttgcgttatttcctgttaaatcttttaaatagaatattaacaaaaatttaaagattctgagtatgttgttgctgcagtggttgttatattctgctcatgtgcttgttttcctggagctatgtggaaaccacatactttggttggggcacacctgtggtgggtgggctgaagtgggagggatgcgtctctggatgtgctggtgccccgtcactgctcagcaccctcctgcttttctgcattcatgatttcctggtgttccctgacttgctactat

SEQ ID NO: 30694 - DNA, 601 bp, Human
ggaggccgaggtgggcagatcacgaggtcaggagttcaataccagcctgaccaacatggtgaaatcctgtctctactaaaaatagaaaaattagctgcgtgtggtggtgcacacctgtaatcccagctactgaggaggctaaggcagtagaatggcttgaactcgggaggtggaggttgcagtgagcccagatcgcaccattgcactccagcctgggcgacagggtgagactcagtctcaaaaaaaaagaaaacaaccaacacattacagtagcagtggggccttccctcccaggtctcgytggggttgtgggtggccatggagcttgtgctgcagggatcaccaggttcctctaaatgaagcatggcgggatccgatctgcttcattattattagactgtgtgctaatataattgtagatatttttaaatcttggacttttaaaattaagcaaccttagagctgatccagttctagtgttgttgttttgcagaggggggcattaaaaaaagaaagaagttgtcacagtgacaaaccagagtagaatctgagtctaaaagtaatgcttttgtttccctgatatcgtgaacatggctactca

SEQ ID NO: 30695 - DNA, 601 bp, Human
ggagttcaataccagcctgaccaacatggtgaaatcctgtctctactaaaaatagaaaaattagctgcgtgtggtggtgcacacctgtaatcccagctactgaggaggctaaggcagtagaatggcttgaactcgggaggtggaggttgcagtgagcccagatcgcaccattgcactccagcctgggcgacagggtgagactcagtctcaaaaaaaaagaaaacaaccaacacattacagtagcagtggggccttccctcccaggtctcgctggggttgtgggtggccatggagcttgtgctgcagggatcaccaggttcctctaaatgaagcatggcgggatccgatctgcttcattattattagactgtgtgctaatataattgtagatatttttaaatcttggacttttaaaattaagcaaccttagagctgatccagttctagtgttgttgttttgcagaggggggcattaaaaaaagaaagaagttgtcacagtgacaaaccagagtagaatctgagtctaaaagtaatgcttttgtttccctgatatcgtgaacatggctactcagctatccagatagagaagtctggcttttaa

SEQ ID NO: 30696 - DNA, 601 bp, Human
ttccctcccaggtctcgctggggttgtgggtggccatggagcttgtgctgcagggatcaccaggttcctctaaatgaagcatggcgggatccgatctgcttcattattattagactgtgtgctaatataattgtagatatttttaaatcttggacttttaaaattaagcaaccttagagctgatccagttctagtgttgttgttttgcagaggggggcattaaaaaaagaaagaagttgtcacagtgacaaaccagagtagaatctgagtctaaaagtaatgcttttgtttccctgatatygtgaacatggctactcagctatccagatagagaagtctggcttttaatagatgagcaatgtgtgactctagcaagaggtcaactactttatcattcatgttactgaaaaaagaagacagaaacgaggccttaagcatggttggtattgctgcttttgcgttaggttggggtaatgcatgaatctggacgggttctggtttgataggcgctttcacgggacagatgttgtttttctttccgtttctttccatttcagctctttttgtagcaaagtggcccagtcagtggcatagggtggtg

SEQ ID NO: 30697 - DNA, 601 bp, Human
gccatggagcttgtgctgcagggatcaccaggttcctctaaatgaagcatggcgggatccgatctgcttcattattattagactgtgtgctaatataattgtagatatttttaaatcttggacttttaaaattaagcaaccttagagctgatccagttctagtgttgttgttttgcagaggggggcattaaaaaaagaaagaagttgtcacagtgacaaaccagagtagaatctgagtctaaaagtaatgcttttgtttccctgatatcgtgaacatggctactcagctatccagatagasaagtctggcttttaatagatgagcaatgtgtgactctagcaagaggtcaactactttatcattcatgttactgaaaaaagaagacagaaacgaggccttaagcatggttggtattgctgcttttgcgttaggttggggtaatgcatgaatctggacgggttctggtttgataggcgctttcacgggacagatgttgtttttctttccgtttctttccatttcagctctttttgtagcaaagtggcccagtcagtggcatagggtggtgggtgcagcagaacgcatgtctggtttgctatc

SEQ ID NO: 30698 - DNA, 601 bp, Human
tgcagggatcaccaggttcctctaaatgaagcatggcgggatccgatctgcttcattattattagactgtgtgctaatataattgtagatatttttaaatcttggacttttaaaattaagcaaccttagagctgatccagttctagtgttgttgttttgcagaggggggcattaaaaaaagaaagaagttgtcacagtgacaaaccagagtagaatctgagtctaaaagtaatgcttttgtttccctgatatcgtgaacatggctactcagctatccagatagagaagtctggcttttaayagatgagcaatgtgtgactctagcaagaggtcaactactttatcattcatgttactgaaaaaagaagacagaaacgaggccttaagcatggttggtattgctgcttttgcgttaggttggggtaatgcatgaatctggacgggttctggtttgataggcgctttcacgggacagatgttgtttttctttccgtttctttccatttcagctctttttgtagcaaagtggcccagtcagtggcatagggtggtgggtgcagcagaacgcatgtctggtttgctatctttgtcctctagtcac

SEQ ID NO: 30699 - DNA, 601 bp, Human
atatttttaaatcttggacttttaaaattaagcaaccttagagctgatccagttctagtgttgttgttttgcagaggggggcattaaaaaaagaaagaagttgtcacagtgacaaaccagagtagaatctgagtctaaaagtaatgcttttgtttccctgatatcgtgaacatggctactcagctatccagatagagaagtctggcttttaatagatgagcaatgtgtgactctagcaagaggtcaactactttatcattcatgttactgaaaaaagaagacagaaacgaggccttaagcrtggttggtattgctgcttttgcgttaggttggggtaatgcatgaatctggacgggttctggtttgataggcgctttcacgggacagatgttgtttttctttccgtttctttccatttcagctctttttgtagcaaagtggcccagtcagtggcatagggtggtgggtgcagcagaacgcatgtctggtttgctatctttgtcctctagtcactgcaggaggaaaagctggcctagggatttgagtctccttgcactttctcacatttaaaggcaacagctcatagcataagaatgggaac

SEQ ID NO: 30700 - DNA, 601 bp, Human
gttttgcagaggggggcattaaaaaaagaaagaagttgtcacagtgacaaaccagagtagaatctgagtctaaaagtaatgcttttgtttccctgatatcgtgaacatggctactcagctatccagatagagaagtctggcttttaatagatgagcaatgtgtgactctagcaagaggtcaactactttatcattcatgttactgaaaaaagaagacagaaacgaggccttaagcatggttggtattgctgcttttgcgttaggttggggtaatgcatgaatctggacgggttctggtttrataggcgctttcacgggacagatgttgtttttctttccgtttctttccatttcagctctttttgtagcaaagtggcccagtcagtggcatagggtggtgggtgcagcagaacgcatgtctggtttgctatctttgtcctctagtcactgcaggaggaaaagctggcctagggatttgagtctccttgcactttctcacatttaaaggcaacagctcatagcataagaatgggaactgaagacagcagcctttaatcttaatgtattttgagattgctatcatactcatttgatatgaaac

SEQ ID NO: 30701 - DNA, 601 bp, Human
cccagtcagtggcatagggtggtgggtgcagcagaacgcatgtctggtttgctatctttgtcctctagtcactgcaggaggaaaagctggcctagggatttgagtctccttgcactttctcacatttaaaggcaacagctcatagcataagaatgggaactgaagacagcagcctttaatcttaatgtattttgagattgctatcatactcatttgatatgaaacaatgtccagcctgccttgccaacctgtgactgttgggccaggtgcagtggctcacatctgtaatcccagcactttsggagaccaaggcaggcagatcacaaggtgaagagatcgagaccatcttggccaacatggtgtaaccccgtttactaaaaatacaaaaatgagctgggcgaggtggtgggcgcctatagtcccacctactcaggaggctgaggcagcagaatcgcttaaacccaggaggcggaggttgcggtgagctgagatcgtgccactgcactccagcctgtgcgacagggcgagactccatctcaaaaatacagaaacaatgtccagcctgccctgccagcctgtgattgttgctgctctcgttctc

SEQ ID NO: 30702 - DNA, 601 bp, Human
cactgcaggaggaaaagctggcctagggatttgagtctccttgcactttctcacatttaaaggcaacagctcatagcataagaatgggaactgaagacagcagcctttaatcttaatgtattttgagattgctatcatactcatttgatatgaaacaatgtccagcctgccttgccaacctgtgactgttgggccaggtgcagtggctcacatctgtaatcccagcactttcggagaccaaggcaggcagatcacaaggtgaagagatcgagaccatcttggccaacatggtgtaaccccctttactaaaaatacaaaaatgagctgggcgaggtggtgggcgcctatagtcccacctactcaggaggctgaggcagcagaatcgcttaaacccaggaggcggaggttgcggtgagctgagatcgtgccactgcactccagcctgtgcgacagggcgagactccatctcaaaaatacagaaacaatgtccagcctgccctgccagcctgtgattgttgctgctctcgttctctgtggagtcttatcacaggcgtgagtgcctggtctgacagagtcgccagcgtctgtcggggatttcatc

SEQ ID NO: 30703 - DNA, 601 bp, Human
cctagggatttgagtctccttgcactttctcacatttaaaggcaacagctcatagcataagaatgggaactgaagacagcagcctttaatcttaatgtattttgagattgctatcatactcatttgatatgaaacaatgtccagcctgccttgccaacctgtgactgttgggccaggtgcagtggctcacatctgtaatcccagcactttcggagaccaaggcaggcagatcacaaggtgaagagatcgagaccatcttggccaacatggtgtaaccccgtttactaaaaatacaaaaatkagctgggcgaggtggtgggcgcctatagtcccacctactcaggaggctgaggcagcagaatcgcttaaacccaggaggcggaggttgcggtgagctgagatcgtgccactgcactccagcctgtgcgacagggcgagactccatctcaaaaatacagaaacaatgtccagcctgccctgccagcctgtgattgttgctgctctcgttctctgtggagtcttatcacaggcgtgagtgcctggtctgacagagtcgccagcgtctgtcggggatttcatcactgctggtgcctacgtgctg

SEQ ID NO: 30704 - DNA, 601 bp, Human
aaaatacagaaacaatgtccagcctgccctgccagcctgtgattgttgctgctctcgttctctgtggagtcttatcacaggcgtgagtgcctggtctgacagagtcgccagcgtctgtcggggatttcatcactgctggtgcctacgtgctgtgctggccacatgtctaggaccactggaggacttacgcctccagtcatctaagaaacagctcatcattgggaatggtttttgaaaagatgcagctcttgccttagatcgtgctttgtggtgaaacaagaggaggtggcagtcccattcyctgatggctcagacacgttgccacccagaggctcggccccgttggtgatctggtgacgtccagacgagtgcagactgcccgatcgtctcaggcatgatggcactacagaaagtcttgcttctttaacatttttcttccttagggaaaacagtgtcagattcacaaattcaacagtatcatctatgtcgttatgagtatctagttcacaaacatgccctaaaggagttgagacaaaaaaaaaaatgccatggacgagttggtgcttatttgcatgatttttaaaacaacaggctctgtgtt

SEQ ID NO: 30705 - DNA, 601 bp, Human
ttctctgtggagtcttatcacaggcgtgagtgcctggtctgacagagtcgccagcgtctgtcggggatttcatcactgctggtgcctacgtgctgtgctggccacatgtctaggaccactggaggacttacgcctccagtcatctaagaaacagctcatcattgggaatggtttttgaaaagatgcagctcttgccttagatcgtgctttgtggtgaaacaagaggaggtggcagtcccattctctgatggctcagacacgttgccacccagaggctcggccccgttggtgatctggtgaygtccagacgagtgcagactgcccgatcgtctcaggcatgatggcactacagaaagtcttgcttctttaacatttttcttccttagggaaaacagtgtcagattcacaaattcaacagtatcatctatgtcgttatgagtatctagttcacaaacatgccctaaaggagttgagacaaaaaaaaaaatgccatggacgagttggtgcttatttgcatgatttttaaaacaacaggctctgtgtttctgggcatttagagaattcagaagagctgttgagtcctcttaagtagttactatag

SEQ ID NO: 30706 - DNA, 601 bp, Human
tccttagggaaaacagtgtcagattcacaaattcaacagtatcatctatgtcgttatgagtatctagttcacaaacatgccctaaaggagttgagacaaaaaaaaaaatgccatggacgagttggtgcttatttgcatgatttttaaaacaacaggctctgtgtttctgggcatttagagaattcagaagagctgttgagtcctcttaagtagttactatagtggagaacttgagtcattctttgtagcgtgcttcgtagagcagcgtgtttgttagaaggatttgttaatcctgtatagsgtctttacgaaggctgttttcatggaagcttctctttgttgactccaggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggtacaggtggccggccaaggccagacatggtggaccatggggtggggattatgaacaagaggcctggatcaggcctgtt

SEQ ID NO: 30707 - DNA, 601 bp, Human
acagtgtcagattcacaaattcaacagtatcatctatgtcgttatgagtatctagttcacaaacatgccctaaaggagttgagacaaaaaaaaaaatgccatggacgagttggtgcttatttgcatgatttttaaaacaacaggctctgtgtttctgggcatttagagaattcagaagagctgttgagtcctcttaagtagttactatagtggagaacttgagtcattctttgtagcgtgcttcgtagagcagcgtgtttgttagaaggatttgttaatcctgtatagggtctttacgaargctgttttcatggaagcttctctttgttgactccaggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggtacaggtggccggccaaggccagacatggtggaccatggggtggggattatgaacaagaggcctggatcaggcctgttagctgtgagcct

SEQ ID NO: 30708 - DNA, 601 bp, Human
aagaggcctggatcaggcctgttagctgtgagcctcaggtaatgtggtgaacgaaagtgcgtggttctctttctctgcaactaaaacatgaggaagctgcattctgcgtgcacgggagctctcagtaagagttaggagcaccagtagtagagaatgtaaaacacgtgatagagatatgaaatcattaattctgtctcaaagacacagtcatgcccatggatcttctcctttgcttctgtgtttgctctccttttccctccgacgccgggtgtggaggagggacttaccccgttctcaccaygtggcttctttctcttcatcccccatgcccttctcttgtttttgcttgttccctgtggcctctgctctccatcccctgacgtaggcagccattctgatgtgttttataggcatctttctgttcgcatgaggtcttcatattttggatggttttgtgtgcatgtgtttttatttttttttatttgtttgctttgtttttttttttttttttttttgagacagagtctcactctgttgcccaggctggagtgcaatggcgcaatctcggctcactgaaacctctgcctaccaggttcccgcc

SEQ ID NO: 30709 - DNA, 601 bp, Human
gaacgaaagtgcgtggttctctttctctgcaactaaaacatgaggaagctgcattctgcgtgcacgggagctctcagtaagagttaggagcaccagtagtagagaatgtaaaacacgtgatagagatatgaaatcattaattctgtctcaaagacacagtcatgcccatggatcttctcctttgcttctgtgtttgctctccttttccctccgacgccgggtgtggaggagggacttaccccgttctcaccacgtggcttctttctcttcatcccccatgcccttctcttgtttttgcttrttccctgtggcctctgctctccatcccctgacgtaggcagccattctgatgtgttttataggcatctttctgttcgcatgaggtcttcatattttggatggttttgtgtgcatgtgtttttatttttttttatttgtttgctttgtttttttttttttttttttttgagacagagtctcactctgttgcccaggctggagtgcaatggcgcaatctcggctcactgaaacctctgcctaccaggttcccgccattctcctgcctcagcctcccgagtagctcggagtagctacaggtgcc

SEQ ID NO: 30710 - DNA, 601 bp, Human
agatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagytggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggttttgatttgttttcattgtttacttaggagtggtgctttttctcagaaaacaggccacggtgtttcatacagaatgtctt

SEQ ID NO: 30711 - DNA, 601 bp, Human
tgggttctgttttctttggttttgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttrttttaaaatctttcaggagctttactgaaagacttggttatcaagtcttttggggagagaatgacattttttttttgagacagagttttgctcttgttgcccaggctggagggcaatggtgcaatctcagctcactgcaacctccacctcttatgttcaagcaattctccttccttagcctcctgagtagctgggattacaggcatgcgccaccacacccggctaattttgtatttttagtagagatgggtttctccatgttggtcgggctggtctcgaactcccgacctcaggtgatct

SEQ ID NO: 30712 - DNA, 601 bp, Human
atttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagaatgacattttttttttgagacagagttttgctcttgttgcccaggctggagggcaatggtgcaatctcagctcactgcaacctccacctcttatgttcaagcaattctccttccttagcctcctgagtagctgggattacaggcatgcgccaccacacccggctaattttgtatttttagtagagatgggtttctccatgttggtcgggctggtctcgaactcccgacctcaggtgatctgcctgcctcagcctcccaaagtgc

SEQ ID NO: 30713 - DNA, 601 bp, Human
ttgaaacttacattttctcaaaaacttaaagacaggcaatggagcatggtaacagaataacagatttcacacagaaaacatgggtttgtatctcacagtgctattttgccagtcaaggcctttcattctgtagtttaacttactaaaaggagggagacttctgataatagcatccactgagagcttaccacatgcgcagtactgcaatacaattaacatgcattgactcgttccctcagaacaaccctgtgacgtagacattattatcccacattgcaacttagggaaaaacaaatagagrcattaagtagcttgctcaggccatagagctgtaaagtagcagaaccaggactgaaactacagcactctggctttagatgaacgctgagctctccacagtatgctgtgtgcttgaaccacagtcaaaaggaaagtgttcaggcctgtgagcaaaaggtatgtcttacctgtcaatcaggtccaggtattatgatgacatatcattcagtgccttttattgagtacttgtccatttcaggaataatgatcaacgctgtaaacacagaaataagtaagataattggcttcaaggaacccacag

SEQ ID NO: 30714 - DNA, 601 bp, Human
tgtgagcaaaaggtatgtcttacctgtcaatcaggtccaggtattatgatgacatatcattcagtgccttttattgagtacttgtccatttcaggaataatgatcaacgctgtaaacacagaaataagtaagataattggcttcaaggaacccacagcctcatctgaagttgagacagtcacacaattcattactatcagtatcatagagagagaaatgtgcttcaagatgccacatgaacacagatgaaggcacacaataaaattaggcagtatttgttaattgctgataaacacaacaygtattcagaagctgtggggatcagcaaaagcaaaagatgcatgctctctatcttttaagaagagtctaaagtggttagaggaaaaagaggaaaacatacatgaaaataactattacaaaaagtttaagcacaagttcacattgaccaaaatatgtaccataggacaagttccagtggatttatcaaatattaacaccttttaagaattttcaatagatttttgggtacaggtggtgttcagttacatgcaaaagttatttagtgattatttctgaaatgttggtgcacatgtcacctgag

SEQ ID NO: 30715 - DNA, 601 bp, Human
tattatgatgacatatcattcagtgccttttattgagtacttgtccatttcaggaataatgatcaacgctgtaaacacagaaataagtaagataattggcttcaaggaacccacagcctcatctgaagttgagacagtcacacaattcattactatcagtatcatagagagagaaatgtgcttcaagatgccacatgaacacagatgaaggcacacaataaaattaggcagtatttgttaattgctgataaacacaacacgtattcagaagctgtggggatcagcaaaagcaaaagatgcrtgctctctatcttttaagaagagtctaaagtggttagaggaaaaagaggaaaacatacatgaaaataactattacaaaaagtttaagcacaagttcacattgaccaaaatatgtaccataggacaagttccagtggatttatcaaatattaacaccttttaagaattttcaatagatttttgggtacaggtggtgttcagttacatgcaaaagttatttagtgattatttctgaaatgttggtgcacatgtcacctgagcagtgtacactgtacccaatgtgtagtcttttatccctcac

SEQ ID NO: 30716 - DNA, 601 bp, Human
tctgaagttgagacagtcacacaattcattactatcagtatcatagagagagaaatgtgcttcaagatgccacatgaacacagatgaaggcacacaataaaattaggcagtatttgttaattgctgataaacacaacacgtattcagaagctgtggggatcagcaaaagcaaaagatgcatgctctctatcttttaagaagagtctaaagtggttagaggaaaaagaggaaaacatacatgaaaataactattacaaaaagtttaagcacaagttcacattgaccaaaatatgtaccatasgacaagttccagtggatttatcaaatattaacaccttttaagaattttcaatagatttttgggtacaggtggtgttcagttacatgcaaaagttatttagtgattatttctgaaatgttggtgcacatgtcacctgagcagtgtacactgtacccaatgtgtagtcttttatccctcaccccttcctacctttcccccaagtccccaaaatccattatataactcttgttcctttgcatcctcatagcttagctctcacttataagtgagaacatccaatatttggttttccattcctga

SEQ ID NO: 30717 - DNA, 601 bp, Human
acatgcatgtacaagtgtctttttcatataatgacttcttttcctttgggtagatacccagtagtggtattgctggatcaaatggtagttctacttttagttctttaaggaatctctatactgttttccatagtggttgtactagtttacattcccaccagcagtgtagaagtgttcccttttcaccatatccatgccaacatctattaaattttgatttttaaattatggtcattcttgcaggagtaaggtggtatctcattgtgcttttaatttgcatttccatgataattagtgatgytgagcattttttcatatgtatgaggcgtatcaaaaaatttttcttatgccatttgtatatcttcttttgagaattgtctattcatgtccttagcccactttttgatggaattatttggcttttttcttgcttttttgagatccttgtagattctggatattagtcctttgtcgaatgcagtttgtgaatattttctcccactctgtggggtgtctgtttactctgctgattatttattttgctgtgcagaagctttttagtttaattggatcccatttacttatttttggttttgttgca

SEQ ID NO: 30718 - DNA, 601 bp, Human
actagtttacattcccaccagcagtgtagaagtgttcccttttcaccatatccatgccaacatctattaaattttgatttttaaattatggtcattcttgcaggagtaaggtggtatctcattgtgcttttaatttgcatttccatgataattagtgatgttgagcattttttcatatgtatgaggcgtatcaaaaaatttttcttatgccatttgtatatcttcttttgagaattgtctattcatgtccttagcccactttttgatggaattatttggcttttttcttgcttttttgagwtccttgtagattctggatattagtcctttgtcgaatgcagtttgtgaatattttctcccactctgtggggtgtctgtttactctgctgattatttattttgctgtgcagaagctttttagtttaattggatcccatttacttatttttggttttgttgcatttgcttttgggttcttggtcatgaactctttgcctaagccaatgtctagaagagtttttccagtgttatcttctagaatttttatggtttcaggtctcagatttaatctttgatccatcttgagttgatttttgtataa

SEQ ID NO: 30719 - DNA, 601 bp, Human
gttcccttttcaccatatccatgccaacatctattaaattttgatttttaaattatggtcattcttgcaggagtaaggtggtatctcattgtgcttttaatttgcatttccatgataattagtgatgttgagcattttttcatatgtatgaggcgtatcaaaaaatttttcttatgccatttgtatatcttcttttgagaattgtctattcatgtccttagcccactttttgatggaattatttggcttttttcttgcttttttgagatccttgtagattctggatattagtcctttgtcraatgcagtttgtgaatattttctcccactctgtggggtgtctgtttactctgctgattatttattttgctgtgcagaagctttttagtttaattggatcccatttacttatttttggttttgttgcatttgcttttgggttcttggtcatgaactctttgcctaagccaatgtctagaagagtttttccagtgttatcttctagaatttttatggtttcaggtctcagatttaatctttgatccatcttgagttgatttttgtataaagtgagagatgaggatccagctttattctttta

SEQ ID NO: 30720 - DNA, 601 bp, Human
agctcaagcaattcttgtgcctcagcctcctgagtagcagggactacaggcacaggcatgtgccactacgcccagctaatttttgtatttttaatagagacagggtttcaccatgttggccaggctggtcctgaactcctgaccttaagtgatccacccacctcagcctcccaaagtgctgggattacaggtgtgagccaccgaacctggccaataatattatgtattatttatataaatatactgatttttcacatacactattaacataattattttctttttattatacatgcttcayagataggttttgtgatgaataatagtctttgcaggtgtgttttagttaatcatagtcctattataaggatattcaggctttttagtttttcagttacatgtagtactgtcataaagatctctgtagaaagcttttttcattttcaaagtgatatttttaagatgtattcctagacatggaattaccgaattgaagaagatgaaaatgttttaagttcttgacatttctgccaaattacactctgaaaagattttcaatatactgagcacagagtatcctcttttcaaatatttttaaaaa

SEQ ID NO: 30721 - DNA, 601 bp, Human
atgttttaagttcttgacatttctgccaaattacactctgaaaagattttcaatatactgagcacagagtatcctcttttcaaatatttttaaaaatttgttattagggaaattacatctttccatgtgttgttaaccagctgtgtttctttttaagaaagttcttggccgggcgcagtgtctcacgcctgtaatcccagcactttgggaggccgaggctggcggatcacgaggtcaggagatcgagaccatcctggctaacacggtgaaactccgtctctactgaaaataaaaaaaaatwaaaaaataaaaaaattagccaggcgtggtggcgggtgcctgtagtcccaactactcgggaggctgaggcaagagaatggcgtgaacccgggaggcagagcttgcagtgagccaagatggtgccactgcactccagcctgggcaacagagcaagattccgtctcaaaaaaagaaaaagaatgttcttcacccaaaatatattgggatcttgggattaagaaacaatctttttaatcaagtgttttgttttttttttcattttgtagccaaagaaactctccctgatttggtttccatcatt

SEQ ID NO: 30722 - DNA, 601 bp, Human
tcctcttttcaaatatttttaaaaatttgttattagggaaattacatctttccatgtgttgttaaccagctgtgtttctttttaagaaagttcttggccgggcgcagtgtctcacgcctgtaatcccagcactttgggaggccgaggctggcggatcacgaggtcaggagatcgagaccatcctggctaacacggtgaaactccgtctctactgaaaataaaaaaaaataaaaaaataaaaaaattagccaggcgtggtggcgggtgcctgtagtcccaactactcgggaggctgaggcargagaatggcgtgaacccgggaggcagagcttgcagtgagccaagatggtgccactgcactccagcctgggcaacagagcaagattccgtctcaaaaaaagaaaaagaatgttcttcacccaaaatatattgggatcttgggattaagaaacaatctttttaatcaagtgttttgttttttttttcattttgtagccaaagaaactctccctgatttggtttccatcattcctgacacagtcccgagtactgaccttctcattgaaactacagcctctgcctgttacacattgaacaacat

SEQ ID NO: 30723 - DNA, 601 bp, Human
tttttaatcaagtgttttgttttttttttcattttgtagccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcgtaagtccttcagttctgcccgtcagctgcctccctttcccctcaccagcctgtgtgtaaataatccggttgtgaatgtgcggtcatgaccatcatgtgcaacatggcagcaaacaggatgtaaagccaggccagatcatctggtcagccctcagtgatcagccaaggaaagaactgaatccaccacaccacatgcttgtcccttctcttctaaagtatcaacagagggtcagactccagaacttctcttggttgtgcattccagcattgtattggcctaatgaattagtttcccaaagccacagctgtgatttaataacagcagaatgtaggcaaagcaggagtcctctgaataggcaagtgcccttttcc

SEQ ID NO: 30724 - DNA, 601 bp, Human
ttttaatcaagtgttttgttttttttttcattttgtagccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcgtaagtccttcagttctgcccgtcagctgcctccctttcccctcaccagcctgtgtgtaaataatccggttgwgaatgtgcggtcatgaccatcatgtgcaacatggcagcaaacaggatgtaaagccaggccagatcatctggtcagccctcagtgatcagccaaggaaagaactgaatccaccacaccacatgcttgtcccttctcttctaaagtatcaacagagggtcagactccagaacttctcttggttgtgcattccagcattgtattggcctaatgaattagtttcccaaagccacagctgtgatttaataacagcagaatgtaggcaaagcaggagtcctctgaataggcaagtgcccttttcct

SEQ ID NO: 30725 - DNA, 601 bp, Human
aattatggccattagtgcaggcgatgcgtaagtccttcagttctgcccgtcagctgcctccctttcccctcaccagcctgtgtgtaaataatccggttgtgaatgtgcggtcatgaccatcatgtgcaacatggcagcaaacaggatgtaaagccaggccagatcatctggtcagccctcagtgatcagccaaggaaagaactgaatccaccacaccacatgcttgtcccttctcttctaaagtatcaacagagggtcagactccagaacttctcttggttgtgcattccagcattgtattggcctaatgaattagtttcccaaagccacagctgtgatttaataacagcagaatgtaggcaaagcaggagtcctctgaataggcaagtgcccttttcctcacttccatcttaggaggggatgtcacaccaggtggtttagaagaagcagtgatgggctgggcacagtggctcatgcctgtaatcccagcactttgggaggcccaagcagatggatcacttgaggtcagaagttcgagaccagcctggccgacatggcaaaaccctgtctctagtaaaaatacaaaaattagctgggtgtg

SEQ ID NO: 30726 - DNA, 601 bp, Human
ggccgacatggcaaaaccctgtctctagtaaaaatacaaaaattagctgggtgtggtggtgcgtgtctgtaattctagctacttggaagactgaggtttgagaatcacttgagcccaggaggcagaggttgcaatgagccgtgatcgtgccactgcactccagcctggttgacagagtgagattctgtctcaaaaaagaaaaaaaaaaaaaagcagcagcagcagtgatgacacaggagaagcagtcagggggtagcctgatgagaaagtcttgctttcacagttttttctctgtcttatmtcttccgcatcttattcccttttgataatagaaggtccaatgcatgtcattccacatctgtgttcctgttttcaacttttccctattaaaaaaaaaaaggaggagaatgaaaaaccttgtataaccaaattatttactattagttaatttagagtgatgagattggaaaggggcatgaagattatctttttctctttatacaattctgaattgtttgacttattacaaatagatatgttacttttgtaaataaccaaacaagaaaagaaatggctatgatagcctagttttaatgagtta

SEQ ID NO: 30727 - DNA, 601 bp, Human
tgagaatcacttgagcccaggaggcagaggttgcaatgagccgtgatcgtgccactgcactccagcctggttgacagagtgagattctgtctcaaaaaagaaaaaaaaaaaaaagcagcagcagcagtgatgacacaggagaagcagtcagggggtagcctgatgagaaagtcttgctttcacagttttttctctgtcttatctcttccgcatcttattcccttttgataatagaaggtccaatgcatgtcattccacatctgtgttcctgttttcaacttttccctattaaaaaaaaaaaggaggagaatgaaaaaccttgtataaccaaattatttactattagttaatttagagtgatgagattggaaaggggcatgaagattatctttttctctttatacaattctgaattgtttgacttattacaaatagatatgttacttttgtaaataaccaaacaagaaaagaaatggctatgatagcctagttttaatgagttacaaagcagatgacttcacctgtactgaagaaatgtgtgcttggctgtacagggatgtacatgttacctctactacagccccacccaatttaggcccct

SEQ ID NO: 30728 - DNA, 601 bp, Human
caacttataaacaaatattatgaatataacagccttgcaatttaataactttttacagttttgaatattagagacccatcactttgatggatttatttgcccttcagttattaccaagtgattctgaaaagtccaggggttactaataagtgctgatttgactgctcctccctgccaggctagtatggaggagaaagacttttcactcttgaaggaacacaccatgctcttctccgtacatctttgcactctctggttttggttttatgtttacaaatgcctgtgatatggggggaaaaakaatctttgtttaagaaaaaaaatcagccatgtgctaatcaggtgatagaagagaaagagatctaaggcggcactgatctaagccagaggtgggacatttaggataaagttaaaagcagaacatgggctgggcacagtggctcacatctgtaatcccagcactatgagaggccgaggcaggcggatcatgaagtcaggagatcgagaccaccctggctaacacagtgaaaccccatctctactaaaaatacaaaaaattagcctggcgtggtggcatgcgcctgtagtcccagctacttcg

SEQ ID NO: 30729 - DNA, 601 bp, Human
tggcctgacttcatggatggctgctgcggagtagcagttgaggagcgaagaggtcttacagaacacccacaggccgcatccagaagcctcactcattctccctgatctcagaatgtccttttcttttcagctatgcctccaacaaagcaagtaaagctgcttccgtccttctgtattctctgtgggcacacacggaactgcatcatgcctacaagaaggtaagaacatgaacaaggaatgtgtcatagttaacagagccaggtaataatggcccacttgacttgaccctgggaagaaatcrctaaaaaactgcattttcttgtgtgccagttttgttacctttcacgtttctgtttgcttattccaaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtc

SEQ ID NO: 30730 - DNA, 601 bp, Human
attttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtasatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgg

SEQ ID NO: 30731 - DNA, 601 bp, Human
ggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaaygccgttaaatccaaatctcttctaaacgatggcattctatgtaatgcctttcctggacttttttggccactgccctggactagtgaaagaatggactctatctttatctgcaagaggaactaaggccttctatcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaa

SEQ ID NO: 30732 - DNA, 601 bp, Human
gttcccattcgaaggggtgggtctcccaagaatcctcaaaaatgtcctccagagaaagaatcagctttaagcttctgccaggctcagaaagcatgagccaatttatgacagcacctgtttaaatagaacttggttacccctttcccacctccctccctatagctcatgcctagaggggccttgagcaggaccagcagggaatcccaccaaggccctttccagggggcctgcagcctacctgaaaccattcctagaaggagaagggtagaagatgtcagtgtaaataaaggttggagttttkattatagccagtttctgacatcggactggattttgtgatgaaaagtgaccactggactgtgttacctgagagtaaatataatgtcttgtggccttgcagagtttctttccatggccagggggagagcttctcctaccaaatatattgtaaagaggccatgggagatgaaataaagttgggatttgcttacatcctatgtattctgcttattcaacatggcacagcacacccatgccatccactaactgtgccaaaagcagcctgaaagcagagccctgtctcacagcagcatggacctgt

SEQ ID NO: 30733 - DNA, 601 bp, Human
ctaccacccaggagagattgacacagcgagagccaagagcccaaactcctgcaccagcatccaaggccctgcacaatccagatgcaacctaacttcccatatgccccttcttccctccatgaacacctcctaccctgtccattcaactgtcccataaagataccaagccttcccacctccaaacctaagtgcccaaatctcctctgcttgaaataacttcaaggacaacccaagccccccaacttctgaaaacccttcctgaaatgtgctacagtaactggggggatgtgagtcacagacytacaagcccacctaggaaatccccagggactcatggactccaggacaacaagcctgtgctagaccttgagcttggtgcttggtgcttggcacttgaatgtggtgtttgctgaatgagcaaatgaatgaatgaatgaatgaatgaactcaccttctaaagtcctgttccactcactgacagagcacataggctaccttttagtttaacggtctttgtatgtgtacataacaagatattaaaattaaggtttccagcaaggcacaatagttgccgtatactaaaacagaccaaatgcagcat

SEQ ID NO: 30734 - DNA, 601 bp, Human
tctcatagagcgagactgcctactaccacccaggagagattgacacagcgagagccaagagcccaaactcctgcaccagcatccaaggccctgcacaatccagatgcaacctaacttcccatatgccccttcttccctccatgaacacctcctaccctgtccattcaactgtcccataaagataccaagccttcccacctccaaacctaagtgcccaaatctcctctgcttgaaataacttcaaggacaacccaagccccccaacttctgaaaacccttcctgaaatgtgctacagtaacyggggggatgtgagtcacagacttacaagcccacctaggaaatccccagggactcatggactccaggacaacaagcctgtgctagaccttgagcttggtgcttggtgcttggcacttgaatgtggtgtttgctgaatgagcaaatgaatgaatgaatgaatgaatgaactcaccttctaaagtcctgttccactcactgacagagcacataggctaccttttagtttaacggtctttgtatgtgtacataacaagatattaaaattaaggtttccagcaaggcacaatagttgccgtatac

SEQ ID NO: 30735 - DNA, 601 bp, Human
aactgtagtttcctgcagagagaaggagccagcactctgttccaagacctcaggccaagcctccctggtccaggccaggggtttcagagctcattatcttcccaggaggtgcccatcccagaaatctgaaggcatttccttttgttgtctagagctaagcaccaggagggacagaggattggggatgccatttctggaagagaagggttttcccctctaaagcccaaatagacattctccctctagaccctaaagaggatcttggcccctacctcatctcatagagcgagactgcctactrccacccaggagagattgacacagcgagagccaagagcccaaactcctgcaccagcatccaaggccctgcacaatccagatgcaacctaacttcccatatgccccttcttccctccatgaacacctcctaccctgtccattcaactgtcccataaagataccaagccttcccacctccaaacctaagtgcccaaatctcctctgcttgaaataacttcaaggacaacccaagccccccaacttctgaaaacccttcctgaaatgtgctacagtaactggggggatgtgagtcacagactta

SEQ ID NO: 30736 - DNA, 601 bp, Human
gagaggcaactgtagtttcctgcagagagaaggagccagcactctgttccaagacctcaggccaagcctccctggtccaggccaggggtttcagagctcattatcttcccaggaggtgcccatcccagaaatctgaaggcatttccttttgttgtctagagctaagcaccaggagggacagaggattggggatgccatttctggaagagaagggttttcccctctaaagcccaaatagacattctccctctagaccctaaagaggatcttggcccctacctcatctcatagagcgagactscctactaccacccaggagagattgacacagcgagagccaagagcccaaactcctgcaccagcatccaaggccctgcacaatccagatgcaacctaacttcccatatgccccttcttccctccatgaacacctcctaccctgtccattcaactgtcccataaagataccaagccttcccacctccaaacctaagtgcccaaatctcctctgcttgaaataacttcaaggacaacccaagccccccaacttctgaaaacccttcctgaaatgtgctacagtaactggggggatgtgagtcac

SEQ ID NO: 30737 - DNA, 601 bp, Human
gaataggcaaatctatagaaatagaaatgaaaagtacatttgtggtattcagggattctgcacctttgcattccttccccccccaaaaaaaacattaaatgtctttcagaatcacactggaaggccaacatcagtcttagtttggagcagagggtctgagcaggagagtctaactggatctccccaaacccctccctgtctctggagcttcagctccaagcaaagttgggtcagtagcctctactgagacacaaggaaagcagatagataaggaggacttagccaagggaggagctcaggyggcaggagagagggagggtggatgtgtgctgaccacaggtaagtgttgctggctgtaggggagccgcaggagcccattcctacctctccccaacgccacatttggatccctgtgactgactgcatcaaggagtcaccaactctgcagagctgtggctgtggggtaaatgctcctcctgggattcatgtgggcaggtgatcaatgggggtcgtggttttatttatttataacattccaaattcttaccaggagaaaatactccatggggtataggctgggacccacacaagagcactggcc

SEQ ID NO: 30738 - DNA, 601 bp, Human
tgtagctgtccctgagtatgggaccctggcccaaggccatctgcaccaggaggacctaacaggctactctaggagccctgtccatcacttcctccaggaagccttccctgatccccaagaccagatcagaactccccaggtgctcccataacaaccactggattgtaatggcctggttacttgtctgtctcctcactagagggtaatacacctgagggcagtgactgtgtctttgtcactagcataccctgaagcccagcccagtgcctgacacacggaaggtgacaggatcccagacccrcatctaaccaagtgaaccctagcatcctctgggagtgtctccctccctaacctggttctcaccctgccccaggttcccaggcccaaggctcaaatgtcccacagcgaagcccactcactgggaacttttccaggggctctgtgagcagcatatccccaaagatcgtccggcaatactcagccatcttagcctgctggcggggtctgcggggagcaaaagcggggatagggttcagccgctcagcaccaaccctattatgcatccttttgtgcccttgatgacccagatcaggggccagga

SEQ ID NO: 30739 - DNA, 601 bp, Human
acaccccgaggctcctggcatgccatgggctcctacctgcccaagcaccaggtatgtagtccttcatctccaggaagatgaagagcgcaggcatggtgaggggcatgttgctctcactgtgcaggcacaggtggtggtaccctgtgagacaggacagggtaggcagtgagccagagcccgttcctgccagcactgtgcacacacagcctaggacccaagggtctgagtctggcactgcaccatcctggctgtgtgacttcagccaggttactttaactctctgagactttactcatctatraagaggggatgagtgtctactcatgtggttattgtgaggatgaagtgagaatgtattataagcccttagcaaattttaaatgcccataagtgtcagctacttgagaaactgccccagccgtttcagaaaattacagcaattctgttaggtgggcagagttcccgcctctcttaggttcctggagaggtactgttctgccctactccttacaatgtgagggcttaggtaaggcctcactccaggccccctcccagaagctgccccaccctgtgcacaggctcctgctgctgatcttggaac

SEQ ID NO: 30740 - DNA, 601 bp, Human
tttaggaaggacacagcccttacacacctgcttgatcacctgcactacttcctggatgtgggagttgttaatctctctcttcaacctgttggtgtaattggagttttagaaaagggagaaaacccctagggagagtagggtaacatgaagtctacgcaggatgtaggcaaatgagaaatccaacatagggcaggaaccagctgggggcaggtgtggggacccaaggagtatgtaggggccactgggagtcctggggccctctgagggaaccatttccccatcaaaacacactgtccttccktgggaaacagtgccaccacagtggacaggctacaatcccaaggcctcagctccctccctgcaggcttggctgcctccagagctctgcccatgtagtgttggcctccgtgttttgtctgaggaggacactctgatcaaaggtgacaggtgggatccgctttttggagagccaggggacagatgcatctttgggaagtgagtcaggatccatttgtagaggcccctttccacctgaagtggggtctgcccagccctgggcctcccctccagggctcacctctcctgggccatcttgtctgtg

SEQ ID NO: 30741 - DNA, 601 bp, Human
agaggcagggtgggggagtggtagagcccatcaggagcctctcaggaaaggggatcctaaccaggcggagatctgcagagctgcctcatttgaaagggcctcaggaccccacagtgaaggatgatggcccccttcccctaccctctcactggcagctccctggggcaaggcccctttacaacccggaacccattcagttctgctgggggtcccagtagtgaacctgttacctgcttttccatctcccgtatctgttccaggcaagccgcctgcttctcctccagcttctcctggtgcctcyccaagttctccgtcatctgggtgggagtggatggcagagaatcaggacaacacagacaggcaagctgggtcagaatccagctgtaatcccagctaactagttgtaagactttgggcaaattccttaacattaggtagtttttaaaatttgtaagataaggatagcagcacctgtctcactggactgtaaaagattatacaagacagctcatgtgaggcacctggcagagtgcctggcacaggtcaggacccagtaggtggcagctgtgttctgtggttaatgatccctaggggagcttca

SEQ ID NO: 30742 - DNA, 601 bp, Human
cctcaccgactccttcacctctgcctccagacccttcatcctggcctcgtactctgccagcgcctccttctggaactgtggagacagcaaggacccctgcctggctcaggaggggcctgctggccaccctcgctccctggacagtgggaacaggagatgcccaatatccatgttcggagctcccaggagactggggtgagaggcagggtgggggagtggtagagcccatcaggagcctctcaggaaaggggatcctaaccaggcggagatctgcagagctgcctcatttgaaagggcctcrggaccccacagtgaaggatgatggcccccttcccctaccctctcactggcagctccctggggcaaggcccctttacaacccggaacccattcagttctgctgggggtcccagtagtgaacctgttacctgcttttccatctcccgtatctgttccaggcaagccgcctgcttctcctccagcttctcctggtgcctctccaagttctccgtcatctgggtgggagtggatggcagagaatcaggacaacacagacaggcaagctgggtcagaatccagctgtaatcccagctaactagtt

SEQ ID NO: 30743 - DNA, 601 bp, Human
ttgtcacccaggctggagtgcagtgacccaatctcagctcactgcaacctctgcctcccagattcaagcaattctcctgcctcagccttttgagtagctgggattacaggcgcatgccaccacgctcggctaatttttgtatttttagtagagatggggtttcaccatgttggccagggtagtctcgaactcctgacctcgtgatccgcccaccttgggctaccaaagtgctgggattacaggcatgagctgctgcacccggacactatttcattttcaactgcctttcatggaagaatgyttaacctttggtctctttcttgatttatgacagctcacagcttgcaagaaaaatacctatggataggctgtgtgcctttttttttttttagatggaatcttaactctgtcatccaggctggggtgcagtggtgagatcttggctcactgcaacctctgcctcccgggttccagcaattctcctgcctcagcctcctaagtagctgggattacaggcgtgcaccaccacacctggctaatttttgcatttttttagtaaagatggggttttgtcatgttgaccaggctggtctcagactcc

SEQ ID NO: 30744 - DNA, 601 bp, Human
agctgctgcacccggacactatttcattttcaactgcctttcatggaagaatgcttaacctttggtctctttcttgatttatgacagctcacagcttgcaagaaaaatacctatggataggctgtgtgcctttttttttttttagatggaatcttaactctgtcatccaggctggggtgcagtggtgagatcttggctcactgcaacctctgcctcccgggttccagcaattctcctgcctcagcctcctaagtagctgggattacaggcgtgcaccaccacacctggctaatttttgcatttttttagtaaagatggggttttgtcatgttgaccaggctggtctcagactcctggcttcaggtgatctgcccacctcagcttcccaaagtgtttgggattatgggcatgagtcactgcacccagcctgttaatgttattttcaagcaatccttcaaaagtttattccaaggccttgctctcctagtagcaaagcctgtctgttgcacactgggctcttggtagcatcttccttttggtggatgtcgtgcagacccggggcagtaaggcatgttaaccttgaggacatcggacctggctg

SEQ ID NO: 30745 - DNA, 601 bp, Human
aaaaatacctatggataggctgtgtgcctttttttttttttagatggaatcttaactctgtcatccaggctggggtgcagtggtgagatcttggctcactgcaacctctgcctcccgggttccagcaattctcctgcctcagcctcctaagtagctgggattacaggcgtgcaccaccacacctggctaatttttgcatttttttagtaaagatggggttttgtcatgttgaccaggctggtctcagactcctggcttcaggtgatctgcccacctcagcttcccaaagtgtttgggattrtgggcatgagtcactgcacccagcctgttaatgttattttcaagcaatccttcaaaagtttattccaaggccttgctctcctagtagcaaagcctgtctgttgcacactgggctcttggtagcatcttccttttggtggatgtcgtgcagacccggggcagtaaggcatgttaaccttgaggacatcggacctggctggcctgactgttgggtctccctcctaggacacggcgagccatgggcggggcagtgcctttcaaagctgctctcacagagcgcttagccctcatccagccctcc

SEQ ID NO: 30746 - DNA, 601 bp, Human
cagcaattctcctgcctcagcctcctaagtagctgggattacaggcgtgcaccaccacacctggctaatttttgcatttttttagtaaagatggggttttgtcatgttgaccaggctggtctcagactcctggcttcaggtgatctgcccacctcagcttcccaaagtgtttgggattatgggcatgagtcactgcacccagcctgttaatgttattttcaagcaatccttcaaaagtttattccaaggccttgctctcctagtagcaaagcctgtctgttgcacactgggctcttggtascatcttccttttggtggatgtcgtgcagacccggggcagtaaggcatgttaaccttgaggacatcggacctggctggcctgactgttgggtctccctcctaggacacggcgagccatgggcggggcagtgcctttcaaagctgctctcacagagcgcttagccctcatccagccctccagggagcaggtgcagagactcatagcagagcaacccccacacctgacccccggcataaggtaagaggaaccccggctccaggtgtatttcagcaccagtgttggggggcacatcctcccaag

SEQ ID NO: 30747 - DNA, 601 bp, Human
ccacagatatggaagcctgtcctcctgctgtatgtattaagggtgctaattttttttcaggttgtacttttgttttatttatttatttattatttctttattttttttgagacggagtttcactcttgttgcccaggttggagtgcagtggcgtgatctcagcttactgcaatatccgcctcctgggttcaaaccattcttgtgtctcagcctcccaagtagctgggattacaggcacacgccaccatgccagctaagttttgtatttttagtagagacaatgtttcgccacgttggccasgctggtctcgaactcctgacctcaggtgatctgcctgcttcagcctcccaaagtgctgggattacaggcatgagccaccgtgcccggccgtacttttgttttagacagctgatgcatcctatattcccaacactttgggaggtcgaggcaggaagatggcttgagcacaggagtttgagaccagcctggtcaacatagtgagaccccatctctacaaaataaataaataaaataaaataaaaacagctgatttcgaactacataagatttaaaacaggagttaacaaaaacaactctcat

SEQ ID NO: 30748 - DNA, 601 bp, Human
aggccggagtgcagtggtgcaatctcagctcattgcagcctcaacgtcccagaccaagcgatcttcccatctcagcctcctgagtagctgggactgcaggcgcatgccaccacacctatctaattttgtttatgttttgtagagatgaggtctcactatgttgcccaggctaatcttgaactcctggcttaagtgatcttcctgccttggcctgccagagtgctgggattacaggtgtgagccaacatgcccggccagggattttatttctaagcattttaaaatcaatgctatatatatrtgtgtgtgtgtgtgtgtgtgtgtgtgtgtgtgtatacacatacacatatacgtatatatatgtgtgtgtgtatataaatatatacacacatatgtatatatatgtgtgtatataaatatatacatacacatatacatatatgtgtgtatatatatacatatatagtatatgtgtgtatatatataatcaaatgctatatagcaagtgtcataaatatcaaatgtgtccatttcacatagggctttgcttttgccatgtcattctaacgtaagaaaaactacaccaaaaatatagtgtggc

SEQ ID NO: 30749 - DNA, 601 bp, Human
cacctggagtcacagctactcaggaggctgaggcatgagaatcacttgaacccaggaggcagaggttgcagtgagtggagattgtgtcactgcactccagcctgggtgacagagcgagactccaaaaaataaataaataaataaaaataaaaatcatttctctctcttttcttccttcttaggatgctttcattggatttggaggaaatgtgatcaggcaacaagtcaaggataacgccaaatggtatatcactgattttgtagagctgctgggagaactggaagaataacatccattgtygtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggtttttttttttttgagacagaatcttgctctgttgcccaggctggagtgcagtggcgcggtctcggctcactgcaagctctgcctcccaggt

SEQ ID NO: 30750 - DNA, 601 bp, Human
ctctcttttcttccttcttaggatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggtttttttttttttgagacagaatcttgctctgttgcccaggctggagtgcagtggcgcggtctcggctcactgcaagctctgcctcccaggttcacgccattctcctgcctcagcctcccgagtagctgggactacaggcacccgccaccacatccggctaattttttgtatttttagtagagacggggtttgaccgtgttagccaggatggtcttgatctcctgaccttgtgatccgcctgcctcagcctcc

SEQ ID NO: 30751 - DNA, 601 bp, Human
ctctttgccacctccatagtcatccccacaagcccagccccgacagagtcccctccctcgtcacttgtggcatcctccatcctggggatcgatgctactgcaacaccaccaaagttccactgtcaactcggccctcagcattggagtgccagggacatgcctcattacagcaccaatcaagttcaagttcaaggtccccattcctgcatcctctcccactcagctttgcagaagctttagcttcctcccactaccatctccccaccccaaacactcagacctcttcatcgcagactccctyttcctcaccctagcccagagctctgggtcctggtcactgagccccctttctatctttacttagccatggctctcaccaggcggcttctctcctgcacgaagtgcttcctaactcctgaggaaagggtcctgtcctccagctgggcctccttacaacaggccactcacccaactccccttctttcagcctgtcctgagactctgatcaattaggtactgttaatatagcagtgccatttcttgaacattggggagtggaatccaacgtttaagagaatgtgctgaagtcagacacagggag

SEQ ID NO: 30752 - DNA, 601 bp, Human
agaagagacagctttctctccatgtctgggtccccaccaccacaagcagcagatatgtgcagtgggctagagtgaggactagacttcactttctttctttctttctttctttctttttttaagagacagggtttggttctgctgcccacgctggagtgcagaggcatgatcacggctcactgcagcctggaactcttgatactccttcttcagcctcctggaacagttaggactacaggtacatgccaccatgcctggcttatttttcttttcttttttttttttttttttttttttttttgtagagacagggtcttgctatgttgtccaggctggtctccaattcctggcctcaagcgatcctcccacctcggcctcccaaagcactgggatacaggcgtgagccaccatgctcagcccagactccactttctatgcctccactaacataatccatacattggtaagcaggccagtgactgtggagtcaacggtctcaagaaaaacttgagggaagcccagtcatttgaattgtttctggctaaaactagcctcatatgcttctgccgtgggtagagctggttgcccacctgccctttct

SEQ ID NO: 30753 - DNA, 601 bp, Human
gcacccaggacagtgtgtggcagagtggggactcaataaagtctactaaaggaagaagagacagctttctctccatgtctgggtccccaccaccacaagcagcagatatgtgcagtgggctagagtgaggactagacttcactttctttctttctttctttctttctttttttaagagacagggtttggttctgctgcccacgctggagtgcagaggcatgatcacggctcactgcagcctggaactcttgatactccttcttcagcctcctggaacagttaggactacaggtacatgccmccatgcctggcttatttttcttttcttttttttttttttttttttttttttttgtagagacagggtcttgctatgttgtccaggctggtctccaattcctggcctcaagcgatcctcccacctcggcctcccaaagcactgggatacaggcgtgagccaccatgctcagcccagactccactttctatgcctccactaacataatccatacattggtaagcaggccagtgactgtggagtcaacggtctcaagaaaaacttgagggaagcccagtcatttgaattgtttctggctaaaac

SEQ ID NO: 30754 - DNA, 601 bp, Human
agctgaggccagaatcatggttcctagcccctaatccaatatctccacgtaagcctgtggcctcaccagaatcccagcagctctagggtgctggcctcagacctcccgccagtccgggccctcattaaagacgaggggaccatggctcaacaaggtcagagctgtgagcaaaactctggtctcttgattaactctcctgcttcgggaaagcacccgaatgcatggccaaggccacagaaaggacttcatcacagccacaaacccttacaaaatgcttacaacgagccaggcactgtctacrtactctacatacatcacctcatttaatactaacaaaacctgttatcgctcccacattccggatgaggaagatggagcacaaagaagttaagagacgagcccaagttcacggctagtaagaggcgaagctagaatctgaagccagcctgcctggctccagactgggttgaggcattgaagctgagtggtgaagtgagccccattccaaggcatccgatctcttgccgactatatggcaggtccaactccaggcaggcccgccagcagggaattgtaccatttaaaggaacctccatacaag

SEQ ID NO: 30755 - DNA, 601 bp, Human
gggcaccttggagactgccccactccaaccagtccgtaggaattggcgaacagcccaggcctgcagggctcctatttttcaaactttttttttttcttcacaaagccgtagaagcagccgccctgcagcctgcagggaaatcaacatctgcctggagcacccttctgccagccccgcccctggcccgagtgaccagggcaaatggcaggacttaagaaccagagattctctgaactggcagcagccctggatggaggggtaggcatggggacctcatctgttctccaagctgggagacagstgtcaccatctgcgttttctagaggaggagtccagggccgaggattccaggtgtgagcttaagtgctcattaggggaataaggactggggaggctgagtgggcccctgtcaggaagaacaaagcccaattccatctcctgtactttcatcgccgttctgaaagcatctggcagcgcaccagccaaggaggaggtgtgcagaaaatgccaacagcatcttcatctgcagaggcccagagctctgagggaaggcactgacagtgcttgtcctgagcttacctcccatcccaggaatgtccta

SEQ ID NO: 30756 - DNA, 601 bp, Human
ggccctgggggttactgctgtgaacaggacaggcagagtcactgcatcatgaagcttatattctggggagaaggatagacatcaacaaggaaaaaaatcatggagttgtaggtagagacactcggcaaggtagaggggcattgtctgatgtcgggtgggcagggaagactgctctgagggggacacacaggcagcgcccacctgaagtgagagagtgagcccgttgaagttttgagcgagtcgagttcccaggcaagtgtactcccaggggccaagtcccagtggctggaaggagtttcgygtgcctgaggcagagggagcagaatgaccgagggggtgcatggtgagacctgaggtccaagagttaggcagggaccagctcacaaaggctttgtgggctaggatatggaattaggagtttcctctttggagtgtgataggaggtccctgcagggttggggagtatgggggctgctgggaggctgtccagatgagcccgatagaggctgatgtgggaatcgcatagacaaggggatgagactagacttgggttcaatcccagctccagcatcagaagctggaagagtgggggctactcctt

SEQ ID NO: 30757 - DNA, 601 bp, Human
ggtcatctgtgctcagcttctgctctttttttctcctcacacacttgaccaccatcagcaccaagatgaccacagccaggaagcccccgacggaggcacccacaatcacggccaccgtggagtcccgctcagggggctctggaaaggaagcagagccactgagcaccagggctgggaaaggggcctcccccatcaccccactacccgtggcatgcgtggaaccatcctgactttactctcctccacagacaggactttagcaaagccgaaaagcaatccagtgactgaccctgaagcgccsccacctccaaatcccaggacacccaaagcccccagaggagctagtgtgatgaagtatttaagagcatgaactttaagatcaaacagacccaaatttgagtcctaattgtacaacttacgaattgcgtgaccttaagtaacttatcctctctaacctcagttttctaacatgtaaaatgggcttaataatagtacctccctcaaaggttttcatgaggatgagataatgcataaacagagcttagccctatgactgagacatagaggtgcccaataaatgaaagctgccatcatcaccatc

SEQ ID NO: 30758 - DNA, 601 bp, Human
aagcacaccaagagcgagcaggcagggtcactgtacagggcggagaggggaggagacgggacacgggaggctgcagggccggccacccactacttggcgccatcatccgggttgccttcaccgtccgtcttgccctcctcctcggtcttcaggtcatctgtgctcagcttctgctctttttttctcctcacacacttgaccaccatcagcaccaagatgaccacagccaggaagcccccgacggaggcacccacaatcacggccaccgtggagtcccgctcagggggctctggaaaggaakcagagccactgagcaccagggctgggaaaggggcctcccccatcaccccactacccgtggcatgcgtggaaccatcctgactttactctcctccacagacaggactttagcaaagccgaaaagcaatccagtgactgaccctgaagcgccgccacctccaaatcccaggacacccaaagcccccagaggagctagtgtgatgaagtatttaagagcatgaactttaagatcaaacagacccaaatttgagtcctaattgtacaacttacgaattgcgtgaccttaagtaacttatcctct

SEQ ID NO: 30759 - DNA, 601 bp, Human
acagcggccccctcctctacccctgcccacccactcccttctctctggggaccctcacatgtgcctcctgcctccccccagggactggcaggtgggagccctttctctcctctccccagggcccacacgtcccagagcatggcaggtttctcggatggaagagagtgggtcactcttggtgcagggtgggagatacgaagtcgggggttcaggaggccccaggtgggccctggggtcctaggtcacgggaagcacaccaagagcgagcaggcagggtcactgtacagggcggagaggggargagacgggacacgggaggctgcagggccggccacccactacttggcgccatcatccgggttgccttcaccgtccgtcttgccctcctcctcggtcttcaggtcatctgtgctcagcttctgctctttttttctcctcacacacttgaccaccatcagcaccaagatgaccacagccaggaagcccccgacggaggcacccacaatcacggccaccgtggagtcccgctcagggggctctggaaaggaagcagagccactgagcaccagggctgggaaaggggcctcccccatcaccccac

SEQ ID NO: 30760 - DNA, 601 bp, Human
aaatcttaaaagtcctaggatattcactaaaatgcaaagttcttataaataatttctaaatatttcaagatgctaatccagagcagttcctggcatttcctgaccaggctcttttcacctccccctcatccacagagggcatgcagtatctactcgcactatgctccttgcctgatctctaggaagccttctcaaatctcaaggctgggacttgcttttgctctcacaacatggtaagcttccttctggcctggcagaatcgcatctagtaaaatactttacttctgtgtctgtttccctkccgtgtgcacctcaaaggctcgactacatcttactcatcttcgtaccctccagatttcatcttgcccagtcaaatctatccacagtatatcttttaacattgttatgcagtggtatcctagcttggatcctggaacaaataaaagacattgatagaaaaacaagtgaaatccaaatacaatctgtaatttaatagttgtgtgccatttaaaatttcttagtcatgaaaaatgtgtcatggttatacaagatgttaatattaggggaagctgggtgaaaggtatgtagaacctatgctatc

SEQ ID NO: 30761 - DNA, 601 bp, Human
tttacaatgcagagaatgagttacagcgctggagttagaagcaatgtgtccttactctcaattcaaggctcgattaacttagttgatacatgaaggccaagttcaaatcctttctctgtgacaaaatataaagagcactgcatcaggaattgagaaacccatttcttacttacgcactaactatccataacaattcctagcttcacctttttattcacccataaaactggtgataataccatttgtcctatttcacaaggcactgtaaggttcaaatgaactgatattccaaaaactttamggctaaataaatgtaaagtattatttaaaaaaatacctttcacataatttgcgatggcttcttttgtgtccctctctgggtcaatgctgatgaaaagtggagttagatctggcagagttgtaatgctatctgaaagagagttccaattagtccgtattcacaccctaagggaaaagacaaagaaaaccagcaataacaggagagtataggacgtgctggacagctaggtgttttggaagcagatggacatcttaacattcaggtgaagaggaagaggacggggaaggggatggagaaggg

SEQ ID NO: 30762 - DNA, 601 bp, Human
tcatggaatactacccagccatattaaagaatgaaatcctgtcatttgtggcaatggagatgagcctggaggatactattaatatgttaaatgaaaaaagtcaggcacagaaagataaatactgcatattcatacgtggaaactaaaaaagttgatctcacagaagtagagagaagaactgtggatactagaggctggaaagggttggggaggatagggactctgtaccccataaatatgtacaactgttatgtgtcaattaaacaacagttactttgtcatagtaaatgttttatttatytttaagacagagtctagctctgttgcccaggctgaagatcagtggcgtgatgtcagctcactgctacctccgcctgccaggttcacgcgaattctcctgcctcagcctcccgaatatctgggattataggtgtgcaccaccgtgcctggctaatttttgtatttttagtagagacggggcttcaccatgttggccaggctggtctcaaactcctgacctcaggtgatccacccactttggtctcccaaagtgctgggattacaggcccaccatgcccggcctgttacagtaaatgtttta

SEQ ID NO: 30763 - DNA, 601 bp, Human
gtatattgaagaggcgtctgcattcctatgtttaccacagcactaatcacaatagccaagatatgaaatccaacagtactcatcaacaggtgaatggataaagaaaatgcagtatacatacgtcatggaatactacccagccatattaaagaatgaaatcctgtcatttgtggcaatggagatgagcctggaggatactattaatatgttaaatgaaaaaagtcaggcacagaaagataaatactgcatattcatacgtggaaactaaaaaagttgatctcacagaagtagagagaagaaytgtggatactagaggctggaaagggttggggaggatagggactctgtaccccataaatatgtacaactgttatgtgtcaattaaacaacagttactttgtcatagtaaatgttttatttatctttaagacagagtctagctctgttgcccaggctgaagatcagtggcgtgatgtcagctcactgctacctccgcctgccaggttcacgcgaattctcctgcctcagcctcccgaatatctgggattataggtgtgcaccaccgtgcctggctaatttttgtatttttagtagagacggg

SEQ ID NO: 30764 - DNA, 601 bp, Human
ttatcatatacaaaaatcaaatataaatgtaggaaagacaaatggaagatctgcaactataaaattagtagaagaaaacataggggaaacacttcaggacattagtctgggaaaaaatttgatagataaggcctcaagagcacaggcaacaaaagcaaaaataggcaaatggggttatatcaaaataaaaagcttctgcacagcacaggaaacaataaacagaatgaagagacaacctggagaatgggagaaaatatgtgcaaactattcatcagactagggagttaatatccagaatgtmctcaatcatctcaacaccaaaaagacaaataacatttttaaaaagggcaaatgatctaaatagacatttctcaatagaaggcatacagatggccaacaagtatatgaaaaaatgctcaacatcaccaatcacaagggaaatgcaaatcaaaaccacaattaggtatctcatcccaatttgaatgactatcaccaaaaatacaaaaaaataacaaatgctgacaatgattcagaacaaagatacctcacacacaccattgatggaaatgtaaattagtataaccattgtggatagcagtat

SEQ ID NO: 30765 - DNA, 601 bp, Human
aacactttcttaagggatggtcccagtccgccagcatccgagtcacctggggtatctgtcatggaagcaggtctctgcatcatactgcagattcagtgaattcagctctgggtctggggaactgcacttcagcaagcgtcccacccacctgcccgctggagcctgtgggtctctttcctgagaactgtgtgcagccatctatgtacccactcatcacccatgaaaaagatcacgcttgtctgaacagcaaaactgagtatgtttactttacacaaagtacaatccagtatatgcagaaagstactcagcatcacactcgtgatcaatatcctcttatttccatttggtatgtcactgaaaacctggcacaccacttagctaaaaatcacataaaagaacccctagagaaatcaaactgatgttttttttcccccaaacaatagatttcctcttcattagtcaaatctgatagtgatattcattaataaggaaaactaaagttttcaagcatcaactctgaatggcagagaccctaatctgactgttattagccaccaagaactcagaagagcaaagaactcaagaagaggcaagcaagagc

SEQ ID NO: 30766 - DNA, 601 bp, Human
agagattttgggttgacctaatggctcagaattcgattttttttaatttaacattttaacaatgaaaagatgctttattttttttatgattgttctaggtgattttaaggtcttagcaaaccaacatcaacatttcactataacgaagcgtcactatgactgcgacggctgttttttaacatatttcaacatatgacagtaaatgggcagaaaaaacataaaacactattcctacaactccccaaaagtctgagctatgatgggttcccaattttcttgaaaagaactcaaaatccaggamccacttttttaaaaaagctcaagctgatgccacatggcaagaagaacctcagaatcccagttacttccttgaggccaccttttgtgccaaggaaccctcactctgctgatcagaagtgacttccaggctatattaagcaaaaaagggaaacaaaaggtatacatagtatgcttttatgtaagaaaaatttggatcttgatacagcatgaaactacatatactgaaaatcacaaagttccccatggaattatgtcccctttctggggttggggaaggggtcaatataatgctttgatagat

SEQ ID NO: 30767 - DNA, 601 bp, Human
ggtatgtttaagctatcaaattattgcaagccacaaggtcttaataaggatcacagttggctgggcgaggtggctcacgcctgtaatcccagcactttgggaggctgaggtgggaggatcacaaggtcaggagatcaaaaccatcctggccaacatggcgaaactccgtctctgctaaaaatacaaaaaattagctgggcatggtggcacgtgcctgtaatcccagctactcgggaggctgaggcaggagaatcgcttcaatcagggagtcggaggttgtagtgagctgagacagcaccaytgcactccagcctgggcgacagagtgagactccatctcaaaaataaataaataaataaataaataaataaataaggatcacagtcgctggcagaacatggcccacaggatccagcctcctcaggaaggtgtccaggccttgaaccgccatcagcccccaaggctggacgtggtcagaggaaggggcgcccatcatccatgcggacccacctgcatcacaaactccctgcggcgcgggaggcctcgctctgtgaggagcgtgtactctggctccttctccttttttgcctgctggatctgg

SEQ ID NO: 30768 - DNA, 601 bp, Human
tggtaaagagcaatgtcataaaccttcaaggagatgtaatgaagaaaaacttctcccagcacccaccaccccaggactctttcttccaaatttcagtgcaacacacccacattcccaccagtgcacccagcagtagtgctggtgtgcagacattacattcatttttttaagcattaagataaacaacttaatctttgatatgtagcctttacagatttctgtggtatgtttaagctatcaaattattgcaagccacaaggtcttaataaggatcacagttggctgggcgaggtggctcacrcctgtaatcccagcactttgggaggctgaggtgggaggatcacaaggtcaggagatcaaaaccatcctggccaacatggcgaaactccgtctctgctaaaaatacaaaaaattagctgggcatggtggcacgtgcctgtaatcccagctactcgggaggctgaggcaggagaatcgcttcaatcagggagtcggaggttgtagtgagctgagacagcaccactgcactccagcctgggcgacagagtgagactccatctcaaaaataaataaataaataaataaataaataaataaggat

SEQ ID NO: 30769 - DNA, 601 bp, Human
tttgctgaactggatagtaataaaccattatgtgttgtctgattttataacactatcgttggtaactgtcacactgaaatatgtatgaaatttacaataaagtgtatattatttataaattgtactacacatcctttctgtcagtaaaatttataaaacacacatatatgtcagtataatttataacacacatcctttgtgtcagtaaaatttataacacacatgtatataacacccatgtatatatctataacatacatattcagctcattccaccaaaccaccctccccgaagaagagytggttgttaaacatgttccagcacatcactacttacaacccccttccaagttgattgtaataacaggcacctggctgctaaaaccaaaagcccaggtcacaagactcagagagtcaaagaaaccattccctggcctgggactaaattccaacctggccatctaccagccatttcatcttgggcaaactactgatcctctcagcaaactgcaacttccttttgtggaatgaaaggatcattcttttcctaccttctgactgcataggtaaaatatacgaggtcaactttctaagttataaa

SEQ ID NO: 30770 - DNA, 601 bp, Human
tactaaaaatacaaaaagtagctgggcgtgatggtgggcacccgtgaatcccagctactcgggaggctgaggcaggagaatcacttgaacctgggaggcagaggttgcagtgagccgagatcacaccactgccctgcagcctggacaacagagcaagttgactccattcccctctaccccaaaaaaaatgtatctcaaccagtattcatgctacaaccaaaatctcaaatctacagtatgtatttgtcagtgacatgagcaacacctttgctgaactggatagtaataaaccattatgtgytgtctgattttataacactatcgttggtaactgtcacactgaaatatgtatgaaatttacaataaagtgtatattatttataaattgtactacacatcctttctgtcagtaaaatttataaaacacacatatatgtcagtataatttataacacacatcctttgtgtcagtaaaatttataacacacatgtatataacacccatgtatatatctataacatacatattcagctcattccaccaaaccaccctccccgaagaagagttggttgttaaacatgttccagcacatcactactt

SEQ ID NO: 30771 - DNA, 601 bp, Human
aaccagccgggcgtggtggctcacgcctgtaatcccagcactttgggaggctgaggtgggtggatcacctgaggtcaggagttcgagaccagtctggccaacatggtgaaaccccatctctactaaaaatacaaaaagtagctgggcgtgatggtgggcacccgtgaatcccagctactcgggaggctgaggcaggagaatcacttgaacctgggaggcagaggttgcagtgagccgagatcacaccactgccctgcagcctggacaacagagcaagttgactccattcccctctaccccmaaaaaaatgtatctcaaccagtattcatgctacaaccaaaatctcaaatctacagtatgtatttgtcagtgacatgagcaacacctttgctgaactggatagtaataaaccattatgtgttgtctgattttataacactatcgttggtaactgtcacactgaaatatgtatgaaatttacaataaagtgtatattatttataaattgtactacacatcctttctgtcagtaaaatttataaaacacacatatatgtcagtataatttataacacacatcctttgtgtcagtaaaatttat

SEQ ID NO: 30772 - DNA, 601 bp, Human
aaatgtaagagaattaaagtactgttaaaaatgaaaagaaattggcaaacatcaggaagtacaatactaaaagccccagtttatgataacaaaagttttcccagggtatgccagtaagtaaaatacgcaaggagagtgtgtgtacttatctctgtggggggaaaggaagaaaatgagggaagaaatatatgtctatatttgtataaagaaacatacaggaaagatacaggagaaactagtaaaaatgtgatctatgggggaggcggtggggagaataggagggatgggatgggggctgtcygaggggaagattgtaccttgtaaaataatgcagagttctgaccatgtgaaggtatgaccaactcaaaaaggtttttttgtttttttttgggacggagtcttgctctgtcgcccaggctggagtgcagtggcgctatgtcggctcactgcaacctccgcctcccaggttttaagcagttctctgcctcggcctcccaagtagctgggattacaggtgcctgccaccacacctggctaatttttgtatttttagtagagacagggtttcaccatcttggccaggctggtcttaaacacctga

SEQ ID NO: 30773 - DNA, 601 bp, Human
gctgagtaggaagcatttgattttctctggtgcttttagctctggggccggtcaaaggcctctctctggcatggctgtccagggtttgtcccaatgtgtctgagtgagccagcttgagaaggggtcgtgccgtttcttctttcacacaggggaaaaaaaagaccaaacacggaggtgcccagggtgtggatctgctggtgtcccgggagaaccagctggctgggcagcccttcttccccacaggcagctgctattgcgtagggaccgccaggtcaccgagtggccatcacaacaaaccccmgcacagtccagcccggccacagccgcctccttgtgtttctgttgtcttccctgctgctgcccacatcctttacccaccgtgtctctcggcccactggaggtatcagaaattccaaattttcaaagcagtttcagtattttcagtatatatgttgggattttataatggttcatggccagaaaaggttcagcacctcccacacctttaaggaagaaaaatgaaaatgacactagttttgaaatgtaagagaattaaagtactgttaaaaatgaaaagaaattggcaaacatcaggaagtac

SEQ ID NO: 30774 - DNA, 601 bp, Human
aaagcagtggtgatggtgtgggtactgcaggaggtggtggggccgtggcacactagaaaagttgggtcacgctgagtaggaagcatttgattttctctggtgcttttagctctggggccggtcaaaggcctctctctggcatggctgtccagggtttgtcccaatgtgtctgagtgagccagcttgagaaggggtcgtgccgtttcttctttcacacaggggaaaaaaaagaccaaacacggaggtgcccagggtgtggatctgctggtgtcccgggagaaccagctggctgggcagcccytcttccccacaggcagctgctattgcgtagggaccgccaggtcaccgagtggccatcacaacaaaccccagcacagtccagcccggccacagccgcctccttgtgtttctgttgtcttccctgctgctgcccacatcctttacccaccgtgtctctcggcccactggaggtatcagaaattccaaattttcaaagcagtttcagtattttcagtatatatgttgggattttataatggttcatggccagaaaaggttcagcacctcccacacctttaaggaagaaaaatgaaaatgacac

SEQ ID NO: 30775 - DNA, 601 bp, Human
tttttgtttttgagatgaagtctcactctgttgcccaagctggagtgcagtggcgcgatctcagctcactgaaacctccacctcctgacctcgtgatccacccgccttgacctcccaaagtgctgggacaacaggtgtgagccaccgcgcctgggatctttattaactttttaaaattaaaaatatatatatatatatatttatatatattttgagatggagtttcactcttgtcgcccaaactggagtgcaatggtgccgtgatctcggctcactgcaacctccgcctcctgggttcaarcgattctcctgcctcagcctccggagtaactgggagtacaggcatgcgccaccacgcctggctgatttttgtctttttagtaggggcggggtttcaccatgttggccaggctggtctcaaactcctgacctcaggtgatccacccacctctgtctcccaaagtgctgggattacaggagtgtgccactgcgcctgaccagctttataaagtttatagggacagtgtcaccactttacagaagagggactgaggctctgaggaggaagttccttgccagggtccgagtgtcgccaccctga

SEQ ID NO: 30776 - DNA, 601 bp, Human
atctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaaggccttcttcagctccaaggccaaggttgggaggaggggtgtgtgtcagttgggaggggctgcatgggtgtatggggtaatggggggacggagcataactcattgattcattcagcacctatttgttaaacacctactawgtgcctgactctgatctagcacagtggtcaatatacacacagaaatgcctgccctttggcagggagtgatggctcatgcctgtagtcccagcactttgggaggctgaggcgggaggatcactttgggccaggagtttgagaccagcttgggcaacatagtcagaccacatcattacaagaaattttaaaaatcagtcagacgtggtggcacacacttgtagtcccagctacttggaatgctgaggtgggaggatcacttgagcccagcaggtcaaggctgcactgagctgaaatcacctt

SEQ ID NO: 30777 - DNA, 601 bp, Human
cagaccacatcattacaagaaattttaaaaatcagtcagacgtggtggcacacacttgtagtcccagctacttggaatgctgaggtgggaggatcacttgagcccagcaggtcaaggctgcactgagctgaaatcaccttactgcactccatcctaggcaacagggcaagactgtctcaaaaaaaaaaaaaaaaaaaaaaaaaaaaagccggtgctggcatggtggctcacgcctgtaatcccagcactttgggaggcagaggcaggcagatcacttgaggccaggagttcaataccagcytggccaacatggtgaaaccatgtctctactaaaaatacaaaaattagtcggatctggtggtgggtgcctgtaatcccagctactcaggaggctaaggcaggagaattgctggaacctgggaggtggaggttgcagtgagctgagatggcaccactgcactccagcctgggagacagaccaagatttcatctcaaaaaaaaaaaaaaaaattacagccaggcgcagtggctcacgtttgtactcccagcactttgggaagccaaggtgggcagatcacctgaggtcaggagtttgagacca

SEQ ID NO: 30778 - DNA, 601 bp, Human
aaaaaaaaaaaaagccggtgctggcatggtggctcacgcctgtaatcccagcactttgggaggcagaggcaggcagatcacttgaggccaggagttcaataccagcctggccaacatggtgaaaccatgtctctactaaaaatacaaaaattagtcggatctggtggtgggtgcctgtaatcccagctactcaggaggctaaggcaggagaattgctggaacctgggaggtggaggttgcagtgagctgagatggcaccactgcactccagcctgggagacagaccaagatttcatctcaaaaaaaaaaaaaaaaattacagccaggcgcagtggctcacgtttgtactcccagcactttgggaagccaaggtgggcagatcacctgaggtcaggagtttgagaccatcctgaccaacatggagaaaacctgtctctactaaaaatacaaagttagctgggcgtggtggcacatgcctgtaatcccagctacttgggaggctgaggcaggagaatcgcttgaacccaggaggcggaggttgtggtgagccgagatcgcgccattgcactccagcctgggcaacaaaagcaaaactccgtct

SEQ ID NO: 30779 - DNA, 601 bp, Human
aatagtattacaatatactttaattatatttaatatttatatgtttaacatataataacataatacaatataatataatacataaaatgtctgatgggataaatttacattggggggagagggctggagatagagttagaggtgggtgtggggctgcaattataaataaggaggtcaagggggcccccagtgagtaaaaacccgggaggtgatggtgggagccacagaggtttctagaggaagagcatttcaggcaagagggaaaagcaggtgcaaaggccctgaggtgggtgtatctgargtgcaagagggaggtcggtgtggccggagccaagtgagcaagtggggaaaggagtggagatgaggtccgggtggggaggcaacaggggccaaaatgtgcagggccgcgtgggcccggtgcggacttgagctctgaccgagtgacgaggcagcgcggcagggatcgcagcagaggaggagcccgagcgggcttaggcttcaccggcgccctctggcggtcagatggggaccgactgtcgagagagcagaagccgggaagcccgagaggcggcgctggccggggtccaggggaggggacggt

SEQ ID NO: 30780 - DNA, 601 bp, Human
cgagtgacgaggcagcgcggcagggatcgcagcagaggaggagcccgagcgggcttaggcttcaccggcgccctctggcggtcagatggggaccgactgtcgagagagcagaagccgggaagcccgagaggcggcgctggccggggtccaggggaggggacggtggctggactagggtggtggtcacggaggtattttgaaggtgagaccgggaggatttgctgacagactggatgtgggtgtgagagaaggggatgagtcaagggtgactccaaggtttcggcggaagcaactgtcaggrtggggcaactgggaaggggaggagggaggggagcaggcgggggaggaagacacgggctctgcggcggcccatcccacgtccagcagaggctgccggtgggcacagaaatgcacccatcgggatctgaggggagagacttgggctgacacgtccatttgcaattccttggcacatatattctgtaattaatcgaagctccaggactgggtgatatcgccaaggaattgagcgtggacagagcagagagggggggctgcaatcaggaagtccccaagaccaccctcaggctcaacgacttag

SEQ ID NO: 30781 - DNA, 601 bp, Human
atcgcagcagaggaggagcccgagcgggcttaggcttcaccggcgccctctggcggtcagatggggaccgactgtcgagagagcagaagccgggaagcccgagaggcggcgctggccggggtccaggggaggggacggtggctggactagggtggtggtcacggaggtattttgaaggtgagaccgggaggatttgctgacagactggatgtgggtgtgagagaaggggatgagtcaagggtgactccaaggtttcggcggaagcaactgtcagggtggggcaactgggaaggggaggagrgaggggagcaggcgggggaggaagacacgggctctgcggcggcccatcccacgtccagcagaggctgccggtgggcacagaaatgcacccatcgggatctgaggggagagacttgggctgacacgtccatttgcaattccttggcacatatattctgtaattaatcgaagctccaggactgggtgatatcgccaaggaattgagcgtggacagagcagagagggggggctgcaatcaggaagtccccaagaccaccctcaggctcaacgacttagcaaaactcatagtgttcagcaaagc

SEQ ID NO: 30782 - DNA, 601 bp, Human
ggaggtggagcttgcagtgagccaagatcgtgccactgcactccagcctgggcgacagagtgagactccgtctcaaaaaaaataaaaaataaaaagagataaggaaataaatgcagaaagagagatggagtcagagagagacagggagagacaaggaaacaggaggagacaggcccctggtactaagaaaggcagcgccctttggccacgtgttcctttctctgctgctgtcagagaccctggctttggagggaaatccaggtgtgtggaggcggactggatggacagatagacaaaggcmccccaagatgggcaaccaggggagaagcaggttggaagagccccagaacttggtggaaatgtgggggctctgggggagggcatccagctctgggggctggacctgggggtttgtggggcacagctagttagacccatgagccccagtggggctgggggaaccccgccactcagccctcaccccacttgtccctctgcccacagtgcagtttggctcctggttcgaccacattaagggctggcttcggatgaagggcaaagacaacttcctatttatcacctacgaggagctgcagcaggt

SEQ ID NO: 30783 - DNA, 601 bp, Human
agataaggaaataaatgcagaaagagagatggagtcagagagagacagggagagacaaggaaacaggaggagacaggcccctggtactaagaaaggcagcgccctttggccacgtgttcctttctctgctgctgtcagagaccctggctttggagggaaatccaggtgtgtggaggcggactggatggacagatagacaaaggccccccaagatgggcaaccaggggagaagcaggttggaagagccccagaacttggtggaaatgtgggggctctgggggagggcatccagctctggggrctggacctgggggtttgtggggcacagctagttagacccatgagccccagtggggctgggggaaccccgccactcagccctcaccccacttgtccctctgcccacagtgcagtttggctcctggttcgaccacattaagggctggcttcggatgaagggcaaagacaacttcctatttatcacctacgaggagctgcagcaggtgagtccccacctcctccaggtgcagcgtcccccccataccctctgctcacaccccacactctccccttcccgagggtctcaggacccctccgcttc

SEQ ID NO: 30784 - DNA, 601 bp, Human
ggagtgcaatggcatgatctcggctcaccgcaacctccaactcccacgttcaagcaattctcctgcctcagcctcccaagcagctgggattacaggcatgcgccaccacgcccggctaattttgcatttttagtagagacggggtttctccatgttggtcaggctggtcttgaactcctgacctcaggtgatccacccacctcggcctcccaaagtttttatatttggaccagttatatatttatataactggtcggccccgccaactagtttttattttaagatggtaattttggctggkcacggtggctcacgcctgtaatcccaacactttgggaggccgaggtaggcagatcacctgagctcaggagttccagaccagccttgccaacatggtgaaaccccgtctctgctaaaaatacaaaaaaattaggcggccatggtggcgggcgcctgtagccccagctactcgggaggctgaggcaggagaatcgcttgaacctgggagctggaggttgcggtgagccaagatcgcaccattgcactccagctgggttatagagcaagactctgtctccagaaaaacaaaaacaaaaacaaa

SEQ ID NO: 30785 - DNA, 601 bp, Human
aaaaaattaggcggccatggtggcgggcgcctgtagccccagctactcgggaggctgaggcaggagaatcgcttgaacctgggagctggaggttgcggtgagccaagatcgcaccattgcactccagctgggttatagagcaagactctgtctccagaaaaacaaaaacaaaaacaaaaaggtaattttatatggttttcccaaatgttgttattatccctattttatcgacgaggaaactggaggtttgtaacttaagagagggttgataatttgcccagggcacatggctcttgcctgyagactccatgtttattttttcccaacctggtaactttcttttaatggaaagctccagaagaggtgtcggtgctactcctccccctcttttccagcaagcattcttctccaaacccagaactgggccacagagcctaacagcttctgggctgcccctgggtgtgaggcgccgcccacatgttagaatttctgggacacgtcagtggttcaagaaggtaaagagatggaaggttatgaaaccaggagtgacctggaaaatcggagccatggggttggcggagctgaccagagggctgaccat

SEQ ID NO: 30786 - DNA, 601 bp, Human
atggctcttgcctgcagactccatgtttattttttcccaacctggtaactttcttttaatggaaagctccagaagaggtgtcggtgctactcctccccctcttttccagcaagcattcttctccaaacccagaactgggccacagagcctaacagcttctgggctgcccctgggtgtgaggcgccgcccacatgttagaatttctgggacacgtcagtggttcaagaaggtaaagagatggaaggttatgaaaccaggagtgacctggaaaatcggagccatggggttggcggagctgacyagagggctgaccatgctgggtgctgcatatcagaaggtagtgatggccgggcatggtggctcatgcctgtaatcccagcactttgggaggccgaggcaggcagatcacttgaggtcaggagttcgagatcagcctggccaacgtggtgaaatcctgtctctattaaaaatacaaaaattagccaggcatggtggtgcatgcctataatcccagctactttggaggctgaggcaggagaatcactggaacccaggaggtggaggttgcagtaagctgagatagcaccactgcactccagcc

SEQ ID NO: 30787 - DNA, 601 bp, Human
ctgagatagcaccactgcactccagcctgggtgacagagccaggcttagtctcattgtaatcccagcactttgggaggccgaagtgagcagatcacccgagggtgggagttcgagactaccctgaccaacatggagaaaccctgtctttactaaaaatacaaaattagccaggcgtggtggcacatgcctgtaatcccagctactcgggaagctgaggcaggagaatcgcttgaacccgggaggcagaggttgcggtgagacgagatcatgccattgcactccagcctggacaaaaagagygaaactccgtctaaaaaaaaaaggcagaggggcacggggaggactaagggctccagggacctgagctcctctctggctgtgtggccttggacaagtgtctctccctctctgggcctctgtttaccaattgagataatgacacttcccttgcaaagctgatggtgggatcggcacaaatgtatggggggcttggatcagagcttggtacatagtagacactcggaaaggaaggtgatatttgagctgtagccgtggcaatgggcccttctggaagccccatgccaaggcccagagggagga

SEQ ID NO: 30788 - DNA, 601 bp, Human
actgcactccagcctgggtgacagagccaggcttagtctcattgtaatcccagcactttgggaggccgaagtgagcagatcacccgagggtgggagttcgagactaccctgaccaacatggagaaaccctgtctttactaaaaatacaaaattagccaggcgtggtggcacatgcctgtaatcccagctactcgggaagctgaggcaggagaatcgcttgaacccgggaggcagaggttgcggtgagacgagatcatgccattgcactccagcctggacaaaaagagtgaaactccgtctaaaaaaaaaaggcagaggggcacggggaggactaagggctccagggacctgagctcctctctggctgtgtggccttggacaagtgtctctccctctctgggcctctgtttaccaattgagataatgacacttcccttgcaaagctgatggtgggatcggcacaaatgtatggggggcttggatcagagcttggtacatagtagacactcggaaaggaaggtgatatttgagctgtagccgtggcaatgggcccttctggaagccccatgccaaggcccagagggaggaatgtgtagggaat

SEQ ID NO: 30789 - DNA, 601 bp, Human
aggttgcggtgagacgagatcatgccattgcactccagcctggacaaaaagagtgaaactccgtctaaaaaaaaaaggcagaggggcacggggaggactaagggctccagggacctgagctcctctctggctgtgtggccttggacaagtgtctctccctctctgggcctctgtttaccaattgagataatgacacttcccttgcaaagctgatggtgggatcggcacaaatgtatggggggcttggatcagagcttggtacatagtagacactcggaaaggaaggtgatatttgagctgyagccgtggcaatgggcccttctggaagccccatgccaaggcccagagggaggaatgtgtagggaatggtgagtcccagaaggagagggtgggaaaggtattggaagagctgtgaccagaccacatctgttttttgggtttttttttgttgtttttttttttttttttgagatggagtctcactctgccacccaggctgtagtatagtggtgagatctcggctcactgcaacctccacctcccagttcaaacgattctcctgcctcagtctcccgagcacctgggattacaggtgcccgcc

SEQ ID NO: 30790 - DNA, 601 bp, Human
ctacagggacacagaggaggggatatggcaaggggaggcaggtggggagggacagggctcatgacggacaggttttgggggtgaggggtacccagagagggaggccaggctcctgggtggatggtggggccatcctgcaatgggggcctgggggaggagcaggtttgagatgtagaccagccaatgcctgtctctaacctgaaggagggtgattccaggtaaggtgatgcactgacctctgcccccggatgtgacctctgccccccactgtgacctctgcccccggctgtgacctctgccsccggctgtgacctctgccccctgctgtgacctctgccccaagcccacctattccctcccacctagagaaccctccaaagacagaaactgcaaaaacccttagaggcgatatagcccaacccctcagtttggagttggggaaactgaggcaaagaggcagcgtccctcaggcagccccaggttaggacccagacatgcggatcccaggttccacgctccttccttggccgagtgccctccctccgctgacccctctcccctgcctgcaggacttacagggctccgtggagcgcatctgtgg

SEQ ID NO: 30791 - DNA, 601 bp, Human
gcactgacctctgcccccggatgtgacctctgccccccactgtgacctctgcccccggctgtgacctctgcccccggctgtgacctctgccccctgctgtgacctctgccccaagcccacctattccctcccacctagagaaccctccaaagacagaaactgcaaaaacccttagaggcgatatagcccaacccctcagtttggagttggggaaactgaggcaaagaggcagcgtccctcaggcagccccaggttaggacccagacatgcggatcccaggttccacgctccttccttggcygagtgccctccctccgctgacccctctcccctgcctgcaggacttacagggctccgtggagcgcatctgtgggttcctgggccgtccgctgggcaaggaggcactgggctccgtcgtggcacactcaaccttcagcgccatgaaggccaacaccatgtccaactacacgctgctgcctcccagcctgctggaccaccgtcgcggggccttcctccggaaaggtgcgggggttctggggttcagagcccactaggccactgcccggctgtgtgacctgggagagttacttaacctctctgg

SEQ ID NO: 30792 - DNA, 601 bp, Human
acactgagcccacccagatacttcagggtcctctccccatctccagatctttagcttaatcctatctgcaaaatcccttttgccacataaggtcacatattcacaggttccaaggattaggacgtggatatggagggagtctttattcagcccaccccagggaacccctccccacaacctcattaagggtgctgggtaacatggggcacgtgcacttgccaaaaggcaaactacggtcctctgaatgccatgagccccaggtttccaggtgaggggtgatgcccctgtgatagccccacartgagaaaactgaggcttgggaggggtgccgtggctcacacctgtaatcccagcactttgggaggccgaggcaggtggaccacctgaggtcaggagtttgagaccagcctggccaacatggttaaacgccatctctactaaaaatataaaaattagccgggcgtggtggtgcgtgcctgtaatcccagttactcgggaggctgaggcaggagaatcgcttgaatcggaggttgcagtgagccgtgatcacaccactgcactccagcctgggcgacagagcgagactccatctcaaaaagaa

SEQ ID NO: 30793 - DNA, 601 bp, Human
ctggccaacatggttaaacgccatctctactaaaaatataaaaattagccgggcgtggtggtgcgtgcctgtaatcccagttactcgggaggctgaggcaggagaatcgcttgaatcggaggttgcagtgagccgtgatcacaccactgcactccagcctgggcgacagagcgagactccatctcaaaaagaaaaaaaatggaaaactgaggcttggagggttcctgaggctcgcttgctgcgccaatcagcaaattgtttgcaagccctgagcacagagcctgcagaagggggtcccttycatgtccaagcagtaatggctgcagcatggagcgttgtgggggcattgagacaggaggccttgttctagcaggggaggtttgggactggtcgcagaggaggtgacacaagctgtaaggtgggcaggaattcagggttggaggcagaggttctgggcagagacttaaagggtccgggataaaggggaggactggcaggaatcctgcagtagcagaggcagtgagggcggaggtgagaacggcgccaggtgacaggccaagactctgccaccataggacacaaagggggcaatgtggagggt

SEQ ID NO: 30794 - DNA, 601 bp, Human
aagactctgccaccataggacacaaagggggcaatgtggagggtagggaggacggtgtttctggcaaagggaacacctcgccaaaggccgggaaggggaaggaggttgctggaatgttggaggtaggggcgcagtgctccccagaggctcctcaccccctggtgccccctcttctccaggggtctgtggcgactggaagaaccacttcacggtggcccagagcgaagccttcgatcgtgcctaccgcaagcagatgcgggggatgccgaccttcccctgggatgaagacccggaggaggayggcagcccagatcctgagcccagccctgagcctgagcccaagcccagccttgagcccaacaccagcctggagcgtgagcccagacccaactccagccccagccccagccccggccaggcctctgagaccccgcacccacgaccctcataataaacacgtcgattctgtccaggttccttgatgcgctgtggcagggcaggcagcggggcgtggagaatcctcaccacaccaaggcttccagaggccggggtccccgactcagagtcccgcccagaggcaaaggtgctgcaggaacccagc

SEQ ID NO: 30795 - DNA, 601 bp, Human
gggttaagggccagtctgtggagtctgtggctgagtttagggaccaatctatggcaagggtcatgggtcagtctggggcagggtcaggaagtccctctgggttataggttagtgtgtggcttagaccagcatccagacaaggacagggggtcaagggccagcccattgaccagcatcagggaaatctggccaggattcgggatcagtatgcaactcgaataggagtcagtatatgactaggtccagggtcaccctagaggcagggacacggtcagtgtttgaccttagatgaggtctttakctggggcaggaactcaagccctagcatggaaagtcctcggccctactgcaggcagggtatattttttctaaagcaaattcatctaagagctgcagattctggtgctggagatcaggggaggagaggagggtggggacaggaagctcctagcaagaaagttagtcacccctgcttctgcaaataggctttgaggggtaggagtcatggctctgttcctaacctgctgtgtgacagatcacttaacccgtctgtcctgtttccccaaatgtaaaatgagacaagaaaaccttccagctctaa

SEQ ID NO: 30796 - DNA, 601 bp, Human
tagtagagacggtgtttcaccatattggccaggctggtctcaaacttctgacctcatgatccttccacctcggcttcctaaagtgctgagattacaggcatgagccactgcgcctggccctttttcatttttcagagacagtgtcttgccctgttgcccaggctggagtgcagtggtgcaattgtggctcactgtagtcttgacttcccaggctcaagtgaccctcccgcctcagcctctgtagtaactgggactatcagtgtgcaccaccatgcctggctaattttttaatttttttgtrgagatggggtctttctatgttgcccaggctggtcttgaattcctgactcaagagatcctcccaccttggcctcccaaagtatagggattagaggtgtgagccacagcctccagcctgccctctgggttctaattccacctcctttgatgtttctctgacagctctggggagcccgttgttatgtcccgttactggtgctgggcccacccctggccagtgggtagctccaggcctctcctgtcccctcccttgcacaggcgcatgttccctgcctgccgagtgtcagtcactggcctggac

SEQ ID NO: 30797 - DNA, 601 bp, Human
aggattccagagagaggctgagagtggagatggggcagaaagatgagctaggtgagactgtgccctggccttgccactgggaaggagtttccactgatactaaacacaataggaaagcatggacaaatttgagcagggacaaaattccagctctgccactttctagttatttaattttctggccttcagtttcttcatctataaaatgggtataatgatggcccctacctgacagggtccctgggagggtgaaatgcctggcaccgggtaagtactgttaccatcaccatggccatcaccctcatcatcatcaccaccactgttccccagggagcgagacgcccgtgtgaagaggaaactgcggggcccagagccagcagccacagaggcctatgggagcggaggtgagtgtagtcccgatggcgatggggccaggcctgagacagggatcctccctagcccaacctctcccttccctctccccagacacaccaggtggtccctgcgactccaccctgggtggagacattcgtgaatcagatccagaacaggccccagcccccggggaagccaccgctgccccggcacctctgtgtggtgg

SEQ ID NO: 30798 - DNA, 601 bp, Human
gtcagggggctccgggtacccagcggctccaccggcggtaccctttgccccgcactttctccaagggggccccttccctctaccatacaccgcgcctgggggctatctggatgtgggctccaaacccatgtactgaaccactgctgggcccctctgcctccatcacaaacctcccgctcccttcccccagccctggagccccctcacctccaccggccccatcccccacaccaaatggccgccttgggcctgcccacccaccccctcaacttcacaccttgatttcactcccacccccctstggcttcaaagcctaaccaaggctgctgggagtccagctggggccggcttccccttcccggctctcacctccgtgtgaatggaaggggctctgcctggccaaatggggccacagaccagcatccccacttaccaggcctccccatgggctctggaggggctcaatccccacccccccacacacactggtgcaggccacaccagtctgttgttctgggaccagagtatttttgttaataaaactcaaaagccatccatgctcaggaaacattgggctcctgtgtttggccctgggcggggc

SEQ ID NO: 30799 - DNA, 601 bp, Human
ttcagtgtacaagggtgcatggactcttcctgaaagaaattactagaaataggattctgtatgataagagattaatctactgaagatcttaagaatgggaaagatgtgatatgaaagaaatggtggtaagcagtaaaccagtaagactcaggatgaatgtcaaaataattgtaattttctgaaacaaccagaaaatcttaattattaatagaagttacaagaaaatgatctggacttaaaagtccaggaggttaagatagtataaaaagtatatatatgcaaactctgttaaaaaaaaaaagtaaaagatatgttctgcctttaaaaaattggtggacctattggccgggcatggctcatgcctgtaatcccagcactttgggaagccaaggtaggtggatcacttgaggttaggggttcgagaccagcctgagcaacatggtgaaaccccgtctctattaagatacaaaaattagccaggtgtggtggcacatgcctgtaatcccagctacttgggaggctcaggcaggagaatcgcttgaacccgggaggcggaggttgcagtgagccaacatcataccactgtactccagcctgggca

SEQ ID NO: 30800 - DNA, 601 bp, Human
agcaacatggtgaaaccccgtctctattaagatacaaaaattagccaggtgtggtggcacatgcctgtaatcccagctacttgggaggctcaggcaggagaatcgcttgaacccgggaggcggaggttgcagtgagccaacatcataccactgtactccagcctgggcaacaagagtgaaaatccatctcaaaaaaaaaaaaaattggtggagagatatatactgaaatgtgagttgtttagaagtgatgaagatgtatgtggttttttttttcgcttgttttgatattttgttgtttttkttgttgttgtttttcttgctatgagcatgtactggccttggaacaagaagacaagccaaacattaaaaaaaatatgatttttaaggagatgttaataggtattgttacaggttattggtattagtgacctgatgtgataagtggggaaggtcctatgatattggcggcagttggccttgtaatgatggctgaagaatacaggagtaagtgggtgctgacagagctggtgtgcataaaaggaggcctagtgggagaagactgattcacttgttctgggtttgagccctgtaaactgctgta

SEQ ID NO: 30801 - DNA, 601 bp, Human
gactgtggctggtttaaaatagattggaacttaactttaactgttaaagcgaatcaataagtcagctccatggtggtataaatttcaaagcgttctcacttgtataatctaatttgcttttcatcactgtgaggtagaaaggataagaacaattattctcatatagatgaagctgaaggtcaaagatattcacatgatctgcagctaacccattctattcaggattgtttagcagcttgatgtttacatttgaaaacaggcatgacagaaatgtattcagaattgtgaaggttatttactwtttaaacattatatgaaattgtctttcgtataggcctggttttttaaaattaaactaatgaactcttatgtcattttctcacttgagaaaaatgtctaaccaccttcttatttaatgtagttttggcccctaatgacgttttcttttctcagttctatttgttgatatttgtggcatcagaagtagatgagctaattgtcagagtcatcccaaggtggattttggcatagcagtgcttcatgtttaaactgaaagggggttatcttttactttttcttgcatgtggtttggaaaaatatt

SEQ ID NO: 30802 - DNA, 601 bp, Human
gctcaactattcatgtgaagtaatccaatatagataatacagtggatcaagatttgctttttaattttaattgacatctagaatccagtgataaaggggaagacaaaacctttcctcgtcctgttggcctttcttgaccataccatttacacaagtcctgaacctgtcaggtgttttcagaatttgtgtttgtgattcctttttcttttttattacttgtctttgcaatttccagattagtctcctgaaattaactcttaagtgtacttttaagtctgtggtgtggccctctacaaggctktcataaaatgtaataaattagtatctacactaaacaacataattagaattgattatacatagtgcgaaagagctctatgatttaaataaggatttctgacagatctgtttctaactagcagcctccttataaacacaaacagttatttatagttatactgctaactactttacaggaggtggggagggtagagcaagaggaagaaaggacccgtttgagaaacttaagaagaagagcttctgatcgctttaaagatttaacgtttggatttataagcatttcacatcagggaaccaaaga

SEQ ID NO: 30803 - DNA, 601 bp, Human
gggcagttagttattgagagtactcatgatatagaaaagatatataaacttgctcaaaattttgagaatagggctcagatagctgtttccttttaatctcttcctgaccagtaggatgtttcaatatggactattgaccttattaatggggagagtaaaaataacttgtcagtgttctgagttgccaagggctaaatagatgaatcttctggcaaactcaaagagataaattgtttcttcaaccaccctggtaactgtacggacacttttctgcctatcatgctggtgcctgaggcccagygtcaggtcagatgctgaagaaggaaggaagcctgtcagcagggagtcagaatgagtggggactgcaagcagtgaccttagactgtgctgctgccactttcttagcttccgttaatacctttatgcccatgattcctactttttttttttttgagatggaatctcgctctgtagccaggctggagtacagtggtgcaatctcggctcactgcagcctctgcctcctgggttcaagtggttctcctgcctcagcttctcgagtagctgggactacaggcgtgcaccaccatgcccagctaat

SEQ ID NO: 30804 - DNA, 601 bp, Human
gtccacaagttatatttagttgatatttctcttatgtgtcttaaaatttaggtccccccttcatcttttttctcctctcgcagcttatttgttgaagaaattggattgtttatcctgaagggcctatcacattctggattttgctgattgcatttccatagtgtctcttaacttgttcttctatcttttctgaaaactggtagttagatttagaagctaaacctaattggagttttattggttttctcaaaatacatactaaggatattatatacatcctattgcatcatatgtggaggtrtatagtgtttgattaagacggggcagtgaggtatatgatgaatgtaggtagcgattatcagtggcacctgacaatgtaatacctcttaagttaaaaacaaaacaggccgggcacagtggctcacgcctgtaatcccagcactttgggaagccaaggtgggtggatcacgaggtcaagagttcaagaccagcctggctggccaagatgatgaaaccccatctctactaaaaatacaaaaaaattagccaggcatgatggcaggtgcctataatcccagctacttgggaagctaaggcagag

SEQ ID NO: 30805 - DNA, 601 bp, Human
tcaagaccagcctggctggccaagatgatgaaaccccatctctactaaaaatacaaaaaaattagccaggcatgatggcaggtgcctataatcccagctacttgggaagctaaggcagagaattgcttgaacctgggaggtggaggttgcagtcagagctgagatcgcaccactgcactccagcctgggcgacacagggagactctgtctcaaaaaaaaaacaacaacaaaacaaaacaaaacaaaaaatagtaatcagtctgaccaaatccttagttctcattttcgtttctgcctttawcaccatttatttcctcccccaactcttaaaacaaccttttctttatttactgtgtttgatgaccctagactttccttgttccttcttacttcttcatagttgtctttgttttctcaactcttactcttctcactggttcatatgaaggtactgattttataagtggtaatttcttccttaagaacatagccacattcatggtttcaaactctaccatgttggcaactctcaaatctccatttgaaagcttaaacctcacccagggtctggattttgtcacattccaagttacaaacacag

SEQ ID NO: 30806 - DNA, 601 bp, Human
aaaaaaaaacaaaaacaaaaacagtaggtggcctaactggagatatttaaaacaaattttttagatgagaacattttatctttcagttcaaaatttcaggtagagctaggaatctggaaatttgtttagagattctctagtcgttgtaacaaaactgtgattttttttgagttcttaaaagtagcattcaatcttatgatttttgaggatctcagtttcagaattcaggtccaactgaatatatttttatgtgtagtatcaaatgaaatgtgaaagtgctttgtaaacatcaacatgctakgtaactgttatctggccatctaataattatatttgaccttgagataaggagactgcatgagatagttttacagttgaaaaattaaatactaagttttagttatgacatttgtatgctgtagtttttgtgcatgtgggatttcagatgccagtatatctctctgctctagcagttgtccacttgcaacccaatggctcccccactccccactttacatacagcataagtgctagttcacatcttagctccatctttgtagttattattattattgattgtaacagttttattgagttataa

SEQ ID NO: 30807 - DNA, 601 bp, Human
atatatttttatgtgtagtatcaaatgaaatgtgaaagtgctttgtaaacatcaacatgctaggtaactgttatctggccatctaataattatatttgaccttgagataaggagactgcatgagatagttttacagttgaaaaattaaatactaagttttagttatgacatttgtatgctgtagtttttgtgcatgtgggatttcagatgccagtatatctctctgctctagcagttgtccacttgcaacccaatggctcccccactccccactttacatacagcataagtgctagttcacatcttagctccatctttgtagttattattattattgattgtaacagttttattgagttataattcacatcataaagttcacccacttaaagtgtaaaattcagtggtttttagaatactcagagttgtacagccagcaaacactacagtcaattttagaatatcttcactccaaagagaaaccctgtagccactagcagtcactcccctttcctcccaaactccttagccctaggcaacaactgctcctttttgtctgtagatttgcttattctgcacattttatataaatgaatcatac

SEQ ID NO: 30808 - DNA, 601 bp, Human
acagataccattgatattgctccaaaccacagagtgggaacaaaaaggtatacttttgaacaactatatttaatatcttctgaaatcaccttttttcccttctctttcatatatacatatcattgctgaaactcagcttaaacttgcactttattagattgccaacaggtaagaagatctcatggtcttgcctgctctgaagccagagttacctgacttaaaaagatgcctgctgatgaaaggttgcccttccagaaaatatcattaggcatgttaattataataacagtagtaactaacrtttatagggcacctactatgtgccaatcgtctaataggtcttttacgtatattacctcatttaatcccttctcaaatactgtgcagtagctagccctgctattttcatatttcagttcctaaaaatatgcctttcttgctttcttagaacttttgcacatgctgtctcctggagcatactttaccctactgtttctcagcctcatacccacctttcccgtaggaagttttttctagtcctcaaaaatcttaggagtccctgccagggactgtcatagcacactgaactgggaccgttgag

SEQ ID NO: 30809 - DNA, 601 bp, Human
gtgtggatatttaatatttttcttgagtctaatatttgttatgtaatattgtgtacatatgtctatgtataaagaaatgtctgaaaggaggttcatccaaatatggcagtaaggggatgattttcaaagttctttttgcaaattttttttaggtacatggcccctgaagttctcgatgattccataaatatgaaacattttgaatccttcaaacgtgctgacatctatgcaatgggcttagtattctgggaaattgctcgacgatgttccattggtggtaaattgctctcctctcccccartagtttgtcatgagcagaagttgttcaagaattgtcttctttttttaattgaatgaaattatgtacagtccattatctgaaacaggatgtcaccgagtgccagagaaaacaaaggcgatgaaacctttgggaggggacagtgccatggtgtgcacatgcacagctctagcctagtgtattctcttcctgtttccatttgaatctggagactcatcagaacccaaccccttgttatattggaatatagttctttagaatggacagctgcttgagaggctcacctaggaagctgtttctagc

SEQ ID NO: 30810 - DNA, 601 bp, Human
tgcacagctctagcctagtgtattctcttcctgtttccatttgaatctggagactcatcagaacccaaccccttgttatattggaatatagttctttagaatggacagctgcttgagaggctcacctaggaagctgtttctagcatgtacctgggtgtcaaacttattttttttctttgagattgtggttattttctccaacttgatagttacaattacatacacagaatacaattatgttaccattgtgttgtattctagagttagtttgttttaacttctagctttttagatggagtayttttaatgtttactcaggaaacagtctcttaggcttggggacctagacttggctgagacctagtgccttaggtttttgaagcagtgagggacagagtatttctctgtattgtagtaaataggatatattattgacagatgcaagtagagaaagggacttggcaccttaaacttgcctcataagattcaagtctcactgatagggtatatatatccctgtgcaagtgagagcctgtgcacttacagaatagaatctcatttgctgcacaatagggttctaggggaaaatgtcaatctggtc

SEQ ID NO: 30811 - DNA, 601 bp, Human
acctgggtgtcaaacttattttttttctttgagattgtggttattttctccaacttgatagttacaattacatacacagaatacaattatgttaccattgtgttgtattctagagttagtttgttttaacttctagctttttagatggagtatttttaatgtttactcaggaaacagtctcttaggcttggggacctagacttggctgagacctagtgccttaggtttttgaagcagtgagggacagagtatttctctgtattgtagtaaataggatatattattgacagatgcaagtagrgaaagggacttggcaccttaaacttgcctcataagattcaagtctcactgatagggtatatatatccctgtgcaagtgagagcctgtgcacttacagaatagaatctcatttgctgcacaatagggttctaggggaaaatgtcaatctggtcatcacagctcatagtttactgtcatttcaaataggctttattgatctcatggcaatacttagtttcaaggtgtgggtggattatcaactcagggaagtggcttgtggatacagatgtggatgagatagagaaagctgtaatctctgtt

SEQ ID NO: 30812 - DNA, 601 bp, Human
gcagtgagggacagagtatttctctgtattgtagtaaataggatatattattgacagatgcaagtagagaaagggacttggcaccttaaacttgcctcataagattcaagtctcactgatagggtatatatatccctgtgcaagtgagagcctgtgcacttacagaatagaatctcatttgctgcacaatagggttctaggggaaaatgtcaatctggtcatcacagctcatagtttactgtcatttcaaataggctttattgatctcatggcaatacttagtttcaaggtgtgggtggawtatcaactcagggaagtggcttgtggatacagatgtggatgagatagagaaagctgtaatctctgttccacatacctactttagtaatgaaacactgtaataggtctctcaggtgatcttttaatgccttggcattagctgaataaattcatcaaaatttaattttttttaaactgatacaggaattcatgaagattaccaactgccttattatgatcttgtaccttctgacccatcagttgaagaaatgagaaaagttgtttgtgaacagaagttaaggccaaatatcccaaacagatg

SEQ ID NO: 30813 - DNA, 601 bp, Human
actttaagaattttctttttcatagcagtcaaaccaatgtttaaaaacagaataatttggttttcatattcaattgtaagcacattgaaagggccatggaacatttgcagtggcctttagtgtatcagaacatagtttagatctgccgggcgaactaaggcacatatttttaaatgaatgcctcccttcagccggggcaacccagaacactagacagttaccggacatgaatgaggagccctgtattctagaccagcctggctaccatttcaagggtctgactctgaacaaatccctttarttctctggactttaatatccctttgcaaggtgaggaactcagataaggtgattacaaaggtgtttcaaatgattttccgttttattcatctgattgcccagataaccgttaaccaggaatttagggaaaatgcttttttccagcagtatctgagctgctcaacttcagctctaacaaaaagttttagaaacgtttttgtaattgtaaatttaaagattcgtaagatgaattttatttaacctctccttaattgctagctgttactattacaatattggtgaagcagagcatattcctcca

SEQ ID NO: 30814 - DNA, 601 bp, Human
aggcacatatttttaaatgaatgcctcccttcagccggggcaacccagaacactagacagttaccggacatgaatgaggagccctgtattctagaccagcctggctaccatttcaagggtctgactctgaacaaatccctttagttctctggactttaatatccctttgcaaggtgaggaactcagataaggtgattacaaaggtgtttcaaatgattttccgttttattcatctgattgcccagataaccgttaaccaggaatttagggaaaatgcttttttccagcagtatctgagctkctcaacttcagctctaacaaaaagttttagaaacgtttttgtaattgtaaatttaaagattcgtaagatgaattttatttaacctctccttaattgctagctgttactattacaatattggtgaagcagagcatattcctccaggtttgaagatttgtagcttaaaaaggctataaaaagctgttcagttcagtagttgattttacgtcttaaactattgtaggactcagcagaacctctgataagcaagagagcttgctacctccaacaaaatcacatctccaggcccaaataaataaa

SEQ ID NO: 30815 - DNA, 601 bp, Human
acaagtgtatatgtcatttaaaaagaaaatttacacgtaaaaattcttatccagaccaatggaaaatggtgcatgcattaatttttttttttatattttcttgtaggccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcarttgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatg

SEQ ID NO: 30816 - DNA, 601 bp, Human
caagggaatgaacaaaagggcatgaaaagaccccattagggcactaatggatttaatttttttattgctctttaaagaaaacttttcctcttcctagatatataaaaagagctcaacctagacatcactctacagtcttttttctttcctgttcattgaagcattttaacaggttgttcagataagcccttctcccagaaacttgttcctatccccagcatgaaatcctgaagagctggtgaatgtcaggccctgaatgagctcagccaatctgccctccggtttacagcaggcaacgcasgaagaatctcacaaagttcccctgaaatggaagggggaacaggaagcaagcaaagggagtctttacatttctttttaaagtgatgtctaaaaatattataagagaagtgcatgcccattgaagaaaatacagaaaatcaaaaaggagaaactatcacccataatcccaatactaagagataaaccccatgacatatgagcatatttcatgccaaatattattttctatacagtcctcatctttgagcacgtttcaactgtttattgaaggcctatgctgtgccaggcactgtgtactcag

SEQ ID NO: 30817 - DNA, 601 bp, Human
aatattgtataaaattaccttcaggctatgtatatatgaaacataaatgaatttcgtgttttggcttgggtcccatcctcaagatatctcattacatttatgcaaatattccaaaatctgaaaaattctgaaatctaaaacacttctggtctcaagcatttcagataagggatgctcaaccagtatcatattccaaagacttagtataacaagatagaatgcaaaatagctcattgatgatttttatattgattaaatgttgacatgatcacatttggcatatgttatgtgaaataaaatrtcctttttattttttgtgggtttttttctttttttgagacagggtttcactcctgctgctcaggatgcaatgcaatggcgtgatctcagctcactgcaacctccacctcctgggcttaagcaatcctcccacctcagcctcccaagtagctggagctacaggcacgtaccaccatgcctggcatatttttgtagagatggggtctcgccatgtggcccaggctggtctggaactcctgggctcaagcaatccacctgcttccgcctcccaaagtgctaggattacaggcttgagccactg

SEQ ID NO: 30818 - DNA, 601 bp, Human
aatggtacctacttcagagggactattcttgtgagggtgagatcatttagtatttatgatgaaccctcaacacagtgttgggcaaatagcagtatactcactggatgttaactatcgttgttaatcgggtccaaggtcttcagtgagactataagcacttctaaagtgccattaagagtcatatcactcaggacaggggtcaagagtccccaagccccccctcctccccaggtttgatgattcatgagaactcacaggacacaacacgcagtcatactcacagctaagatggattacaccraaaggacacaaaacaagatcagcaaaggggaccgggcacggtggctcacgcctgtaatcccagcactttgggaggctgaggtgggtggatcacttgaggtcaggagtttgaaaccagcctggccaacatggtgaaaccccatctctactaaaaatacaaaaaaattagctgggcatggtggtgggtgcttgtaatcccagctacttgggaggctgaagcaggagaattgcttgaacccaggaggcggaggttgcagtgagccgagatcatgccactgcactccagcctgggtgacagagc

SEQ ID NO: 30819 - DNA, 601 bp, Human
tgctaaaaatcagagggcatggccgggcacagtggctcacgcccgtaatcccagcactttgggaggctgaggtgggtggctcatgagggtcaggagatggagaccatcctggccaacatggtaaaaccctgtctctactaaaaacacaaaaattagctgggcatggtcgtgcgcacctgtagtcccagctagtcaggagagtgaggcaggagaatcgcttgaacctgggagacagaggttgcagtgagccgagatcgcgccactgcactccagcctagggacagactgagactccatctcaaaaaaaaaaaaaaaaaatcacagggcagcacaggcttccaagtccatttactagctgtgtgacctcaggcaacttatataagtgcaatttcctaagctgaaaaatgagactaatcatccctacctcatgggatgggagctcagaaccaacatcctcttctaaagctctctcttgcaggacccagattctatccatctctttcaagcaaccagagcagaacctcgaattggggaaggtgaaggaagggacacagcacactacagcccctgttgctaggttcacccttgggaaagcaggctg

SEQ ID NO: 30820 - DNA, 601 bp, Human
cagaaacagtcacctttctgcatcagaaaaccaattcagataaagtgatgaattgagatttttcacaaaagtatcgatctttcttttggtctagagtggaaacttatataaaaatggctacttctattgtattttttattaggaaactctcattgaaaaggctatctgtaccaaggacactaagacttctgaggctgtgattctgtcccgtgaaacgtcacttatgatccctaacacctgcaactctagctgtcttacttaataactaagcctgggttcctccttggcttctagagaatawgaatgttacagaggtttctttgttatatccaaagaagatgactggtattccatcttctcccgaatgcacagagaagaaattcttctcatgtctctttaggattctttattgaaagactgagaggttttgccttatttaagaaacatcctttcacctgctttagttttcttcctaggccctatcaccacccgccagattatatgtttgacttctgcctccccacactggaatattaggggcaggagagcaagggctttgaatttatcactgccatatcatccagaacagtgtctgccacat

SEQ ID NO: 30821 - DNA, 601 bp, Human
tgcagtgagccgagatcgcgccactgcactccagcctgggcgacagagtgagactctgtctcaaaaaaaaaaaaaaaaaaaaagattggatcatgagtacagagccctcttgaatggattaatctattcacggattaatagattaatgggttatcttacactggtggctttatgagaaaagggagagagacctgacctagcatgctcaactccctcaccatgtgacaccctgtaccacctggggactctgaagagtccccactagcaagaaagccctcagcagatgcaccccttcaacccyggacttctcagctgccctaactgcaaaaaataaattacttttctttggaaattcaaaaaataaaataaaatcaccaaggaacatgcgttcaagtcgttcagtgaatggtctttgagccctctgtagtctgttctctatccagccacaagagtgagtctgtgaaacctaaatcagttcttgccactcccctgctcagaaccttccagtggcttcccattgcatgcagaatgaaatccaaacccttatcatggcccacaaggctttctctcatctcctacccatctccctctggcctggttg

SEQ ID NO: 30822 - DNA, 601 bp, Human
aaccccgtgctctctgaaacgtgtgctgtgtccactaagggttaaatggattaagggcgatgcaagatgtgctttgttaaacagatgcttgaaggtagcatactcattaagagtcatcaccattccctaatctcaagtacccagggacacaaacactgcggaaggcggcagggccctctgcctaggaaaaccagagacctttgttcacatgtttatctgctgaccttccctccactattgtcctatgaccctgccaaatccccctctccgagaaacacccaagaatgatcaataaatactaaaaaaaaaaaaaaaggcaggacccacacctggcttctcccatttactgccacttttgcagcagcagggcctcagttccttcaggcaggggcccagccctgggcagcctctaaaccctccgctctgtcttgccaccaagaggactgtgaccctcacccattgcccttctaccccctcaacaactcgtaacctatagaccctccagactataaagaccaccaactgcagaaagcctgatgcagcggagcccaagggaaaaggggcacaggccctcctgagccatggggcctgcatgccaggc

SEQ ID NO: 30823 - DNA, 601 bp, Human
tgatttcaggctctatggctcgaggcatttccctggatgaaataacacttcaaaaagacttaaggccacttgtgtctctctcttgggccacagactttcagtaattccaagagcaaagctccttatacaaggacacagacagtacgggagccttggaagccagggctggctgccccttgccccagcttggctctgggcaaaccagccaggcaccaaaagcgacttccctgacatggagttggcagcagttcaagcaggaccttaatcaccaaggagactgagcacccttcaggagccagcrtgtgaatctcaatgtccacatgaagatgtggtagatggggctgcagcgacctcgggcagggaaaccactgaacaccgggctccagccaaatgcagcataattttgtggaagtctagaaatgctgactgtccttgggaactgctcaatattgggaaaatgttatcagctccgcacactgccagctctccccaaagagacatgagagcctccaaccggaagaggcagggcggtggggaacagctctcaggaggaggcagcccagggcaagggaaagttgctgagtcggctgaaagtctgaat

SEQ ID NO: 30824 - DNA, 601 bp, Human
aatgaaggctcttgtatttacttttaaagaactctgctgggaaagggatattgcatggatatggaatgaagtgctaggataaaaaggttttatttgctgggaggttttgagaattaatgactatccacagtggaattgaaattaacctcaaaattgcttttttggaaaaaaaagtttttaatgcaagttttatctttatatacctgtgcagctgtctcaaaaaagttcactttataaacatttcctactaaccaaataaacatcccctttggaggaaattcgggcaaagacctcctaaacytacgaggctgtggccttcacaaccaaaaagcttcaaggccagcatgttactacttttgagggtcttaatttcctgttttttagactgctgagaattttgaggcgttggaattgtctgtctcctttcacagtactactaatacttgttctttcccctactgttcctgtctactcccacccattccgttgtgtctcatattagactagtctgggtctttacatccttgtgaaatgcccctagtggagtgatatcccaagaacacaagcatacttagaagatgggaagagcacaaattcttta

SEQ ID NO: 30825 - DNA, 601 bp, Human
caggaaacattaacttccttgtttctccatattgactctttaatttgacttactacatttgctatattttacctatagatagattttggttgtagggttgtgttgtgtttcgtttctttttgaagattttttttttttttaaatttacattgtaggtcatagaccacaactgtttagtgcctttttggcctttttccctttaataatatgtctacaggtcaccagtcaattcctccaaaggttgaatttttaacaaaccttctttgcttcctggataactgggattagaatttagttgatstagccgatgcctgttggaggtgaagaagtcgggccagtctaacctctagaatactagcttttgcctttcacttctgcaatttgggaggaggttaaactgttgtgaggccttcacatggccaattgggtgctggtaagacttgtttttgtaactagctaagaatgcttaattctagacagctgtggggtgggaattagaaatgtcaagcatgttagaaataaaaccagagcagggtttttcctcccttctattcagttttgaaagaggccctaatgcctgattggttttgcttttgagccc

SEQ ID NO: 30826 - DNA, 601 bp, Human
gatgtagccgatgcctgttggaggtgaagaagtcgggccagtctaacctctagaatactagcttttgcctttcacttctgcaatttgggaggaggttaaactgttgtgaggccttcacatggccaattgggtgctggtaagacttgtttttgtaactagctaagaatgcttaattctagacagctgtggggtgggaattagaaatgtcaagcatgttagaaataaaaccagagcagggtttttcctcccttctattcagttttgaaagaggccctaatgcctgattggttttgcttttgarcccaggttggagggaaatgcatgggttttcttaattaagataatttcttaaaaaggtgttatatcacttaagccactttattgttattttgatgctgcttaacttgcacagtaaaaacatgtttaaaacttttcttgtagacttaaatgtataagatggtagtctaatgagctggggtatgtttgcttttgttcactcttaatggattgtgctaacagtttatacaaatgctagaaacggaggtgtcatttagccgtcattagccatgaacaaacctgaccttttattccatcgtgtgtg

SEQ ID NO: 30827 - DNA, 601 bp, Human
gttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaakatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggt

SEQ ID NO: 30828 - DNA, 601 bp, Human
tggccctcaggctccctgccatgcttctaggggctttctttgtttttcaggtagcagatctgggtgccactgtagcccctgaggggcaatggagcaggcagccgcaggccctgcctgtggatctatggagttggccataaggacattccctcaagggtgggcaagaaaccataggggttaatatggcctccctgagtgtgatttctactctgtgaggaggactggaagagctgtcagagaaggctcccaatccctgaatatggatggatgggggatttggggaagaacaggacccacgcarttccctcagctttctctccttttgacctgggtatgtgctcccatggtcccaccaggaactgggtgcttggggcctagaaccaggagccagtggccttttccaccctgggcttcttcctgtaacaccatggctcagcaccagccatccttggaccggttagccagttcttcagatttggggttcagatcctgcctctgctacccactagctatgtgaccgtgggcagctcttaacctctctgaatctctgtaactcagatgtaagatgtgggaaagatcttaatgtagcatttaccctgtg

SEQ ID NO: 30829 - DNA, 601 bp, Human
accaggagccagtggccttttccaccctgggcttcttcctgtaacaccatggctcagcaccagccatccttggaccggttagccagttcttcagatttggggttcagatcctgcctctgctacccactagctatgtgaccgtgggcagctcttaacctctctgaatctctgtaactcagatgtaagatgtgggaaagatcttaatgtagcatttaccctgtgcttgactccattctaagtggcccatgtgtattgcatattcaatctgcatgactatggggttggtgctgtcatccctatyatacaaaagagatagctgaggcacagagaggtgaaagaaccagcccaggatcacacaacagcgctcatgaaacgtggatcccagggcatggcacacagtaggtgcccagagaacagtggtcatatgatgataattaacatctcatcccacatttggggaaacagagacttgaatggggttgggagtacccaagccctcacagtcaggtaggggccgtgccactgggaacacacaggcttcttggcagggatcagagcccaccaccctcttctagttccaagagttcagttcaacccacct

SEQ ID NO: 30830 - DNA, 601 bp, Human
accggttagccagttcttcagatttggggttcagatcctgcctctgctacccactagctatgtgaccgtgggcagctcttaacctctctgaatctctgtaactcagatgtaagatgtgggaaagatcttaatgtagcatttaccctgtgcttgactccattctaagtggcccatgtgtattgcatattcaatctgcatgactatggggttggtgctgtcatccctatcatacaaaagagatagctgaggcacagagaggtgaaagaaccagcccaggatcacacaacagcgctcatgaaaygtggatcccagggcatggcacacagtaggtgcccagagaacagtggtcatatgatgataattaacatctcatcccacatttggggaaacagagacttgaatggggttgggagtacccaagccctcacagtcaggtaggggccgtgccactgggaacacacaggcttcttggcagggatcagagcccaccaccctcttctagttccaagagttcagttcaacccacctaagctgacaacccaccatgcaccaggttctacaagggacagggaggctgacagtggctgttcagtaggggagg

SEQ ID NO: 30831 - DNA, 601 bp, Human
aaacgtggatcccagggcatggcacacagtaggtgcccagagaacagtggtcatatgatgataattaacatctcatcccacatttggggaaacagagacttgaatggggttgggagtacccaagccctcacagtcaggtaggggccgtgccactgggaacacacaggcttcttggcagggatcagagcccaccaccctcttctagttccaagagttcagttcaacccacctaagctgacaacccaccatgcaccaggttctacaagggacagggaggctgacagtggctgttcagtagggsaggagcggagcagcagggtctgaagcctgggcctatgatttggggcaggggcaagggtaggatgatgtgcagtttccccctctctgcttatagtcacctcttttacagcatggaaggtggtgagttgttcagcaggattcaggagcgtggcgaccaggctttcactgagagaggtatgtgcatgtagctggaccagcaggaggattcagggtgagaggtatggaccagagcgttgtgtgtgatgctaggcaagaccctgttcctctcagtcttcccatctgaataagaaagggtgagact

SEQ ID NO: 30832 - DNA, 601 bp, Human
tcagttcaacccacctaagctgacaacccaccatgcaccaggttctacaagggacagggaggctgacagtggctgttcagtaggggaggagcggagcagcagggtctgaagcctgggcctatgatttggggcaggggcaagggtaggatgatgtgcagtttccccctctctgcttatagtcacctcttttacagcatggaaggtggtgagttgttcagcaggattcaggagcgtggcgaccaggctttcactgagagaggtatgtgcatgtagctggaccagcaggaggattcagggtgaraggtatggaccagagcgttgtgtgtgatgctaggcaagaccctgttcctctcagtcttcccatctgaataagaaagggtgagactcagtgtccatccccacaagggactctctgagtctgagacactttgtcgaacttggactctctatggctttgggatggaggcctcaaagcctcttgatgctgtctcgcagttgagctggggagaggtagctcaggactgaggaaagaagtttagatgggttgggggtatcctcggaggaaactggggtgtctggggtggcgtagacatcccgggat

SEQ ID NO: 30833 - DNA, 601 bp, Human
actccacaatccctgatggcatccaggacccactggatggaggccatgttccctagtcacattcaaagcctctgctctgtgtcccagactgcttttctcagcctcttctctagtttcagcatactcattctgttctcaccaggtgggtccccttgcttctttcaaacactgagtaatccaaatagtaataagaataactgactgcctgcctaaagccagcgggccctgacaagcaatctcatttcattctcacccagccttgtgagataagtgccattacccattttacagatgaggaaarcaaggctcagaaaaagattaagtgacttgcccaggggctgtgtagttgctgcactgggattcattcattcatttgtttacttgttcagcaagaaattttgtgtggatgcaatgtgccaggcctcaggcaggggctgcctgatgctgttggttttttttgttttgttttattttgttctgtttttttgagacagagtctcactctgtcacctaggctggagtgcagtggcgcaatctcggctcactgcagcttccgcctcccaggtttaagcgattctcctgcctcagcctcccaagtagc

SEQ ID NO: 30834 - DNA, 601 bp, Human
gccattacccattttacagatgaggaaagcaaggctcagaaaaagattaagtgacttgcccaggggctgtgtagttgctgcactgggattcattcattcatttgtttacttgttcagcaagaaattttgtgtggatgcaatgtgccaggcctcaggcaggggctgcctgatgctgttggttttttttgttttgttttattttgttctgtttttttgagacagagtctcactctgtcacctaggctggagtgcagtggcgcaatctcggctcactgcagcttccgcctcccaggtttaagcrattctcctgcctcagcctcccaagtagctgggactacaggcgcacaccaccacacctggctaatttttgtatttttcgtagagatggggtttcaccatgttagccaggttggtcttgaactcctgaccttaggtaatccgcccgcctcggcctcgaaaagtgctgggattacaggcgtgagccattccacctggccctgttgcggcttttgtgaagtcacagccatagctttgacagatcaggccccctgataccagcattttaagggaaagaagccatttgctgagccctggaggaagg

SEQ ID NO: 30835 - DNA, 601 bp, Human
cttttttttcccgaagagagaaaagccttctgcagaggagattcccttgaatagactaaaactgcttctctgtttttatcacaattgagaaggtcagatcttctcaaatggaacctgagaaatagcatccattggttctaaaccaccaccccatccttctaccaacaccccatccttctaccccggctctgcttgggggtctcttctgcccctctccatgggcctacatcctacctaccattcattaaaaaccagtttcagggacagacctccctactgccctcatctgccaggcccctgrctactcctgggacacaggaagattgcccctgtgcagctcctggggtctggggtctgagcaaccagggccttctcccctgagcaacctcagatggggctgtccttctagccctgtaggattcactctgggctgggtatgggacatgtgcttggcaatactgacttatgagcagcctgccttcccccagcacccttgctctagcatttcatggcaatgtcaccaactcaggatcagaagttcctgctccgaggctttctatggcacttggtcattcacagccttggctgagcacctgccttg

SEQ ID NO: 30836 - DNA, 601 bp, Human
gagaaatagcatccattggttctaaaccaccaccccatccttctaccaacaccccatccttctaccccggctctgcttgggggtctcttctgcccctctccatgggcctacatcctacctaccattcattaaaaaccagtttcagggacagacctccctactgccctcatctgccaggcccctggctactcctgggacacaggaagattgcccctgtgcagctcctggggtctggggtctgagcaaccagggccttctcccctgagcaacctcagatggggctgtccttctagccctgtargattcactctgggctgggtatgggacatgtgcttggcaatactgacttatgagcagcctgccttcccccagcacccttgctctagcatttcatggcaatgtcaccaactcaggatcagaagttcctgctccgaggctttctatggcacttggtcattcacagccttggctgagcacctgccttgcttccccttttgtgaatgaaggtagcaccttgggtttctctatatttggcccatgttagtgggcaaggcccgggtctttttataaatggacctggctccttctgcactgggatgga

SEQ ID NO: 30837 - DNA, 601 bp, Human
ggtgcctccagtttctaatccacgggcgtggggctccttccagcaatcgatggtagtgccacagaccccactccacacggcccgagtgctgcaggaggacaaagaccactgggacgaagtcaaggtgggtgggctctgcctcagtctcaatacaggtgccaggatttgggcaaaagggacttcaggggggtggctacccagggtctggggtctttggcccctttctatacctggagcacagggtgtcagtgactgtcgcagtggtccaaccatggcactccaaggattgggcctcactacrccattcagtgtggtgctcctggctcacttcctcaatgaaacggggctttggtaccaagcttggatgatgacctctcttataaccaacaacatttgggagggtggtcagcctggtttagacccagcagaggccacgtttgaacatatggagtagcagctccagtggcacaatctccaggccccagtgcgctggttgcccagcgagatggcattctctgcaggtcttgtggttctgtggtggaactggtttagttcactatcccacttacccttggtgtggtccgagggagtaactctcctt

SEQ ID NO: 30838 - DNA, 601 bp, Human
acctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggyagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgcctt

SEQ ID NO: 30839 - DNA, 601 bp, Human
ctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccrgtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtga

SEQ ID NO: 30840 - DNA, 601 bp, Human
gccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcmtctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagta

SEQ ID NO: 30841 - DNA, 601 bp, Human
gatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcmtggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcattttctcttggctcctgggtttactctttgtctacaggggtggacaaaggtggcccaagggcagcttctcagacccactagtgatttcaccccagctgga

SEQ ID NO: 30842 - DNA, 601 bp, Human
aactgaggcactccttctcacttgtgggccccaatgcagtcaggaaagcaaatgaacacccacaccagtctcttttgttccaggaaattaaagtagacttcttggttcagtcacggttgctactgttgctactctcttacacatctattctgcaggaccactgggaaaagactctaagtgtgggcacccaggaggggccttgtcaccccaaccaatcaatacaggatgactttgtgtcaggattaaagccaaggacacatgggcacactaaaattaatacattacacaactgcacaaaagrcattgtgtgaccggggtcttcccgctgcaaggccaggaaagcagctgaaccaaaggatgcttaggggtggggagggggctgctacaaaaagggaagcgctaaggaaagtttgggagaaaagaaagtatcagtttgatcaggagcgggcactcagagagcaaggctgctgctttctgtgagattttacaacgtagggttcctggcactgtcttccctaaggggccctgttctctgggaccttccccagcactctgggtgtaaggggcagccctggtgtacagccactcacccctgacattt

SEQ ID NO: 30843 - DNA, 601 bp, Human
cgctcagcaaggcatgagttgcacaagagttgggtatcagctgtgaaaccaagaatagtcacccatacacagcacccctcactgcaagccccaagcccatatacatcaagaatggggatccagagcaggtcagtcatatctggacaactccccttctcagctcctttcatctttgcctaatgtttattcatttaacaagcacctaccaaatacccactggatatctgaggacacagagagtggactcagacaccctcctactctaaagctgttccctttaatgaattaagagttcagttcsttctgccagaggatttctgtagctaccacccctagaatctgcctatctcctcctcctgtcttcctccatttccacttcccaagcaaaaacatggcagcatcccaccctccaaacaaagcacagagtccagcagacctggtgggcaaagaacatgttattcacaatatcatcatcaatcacggacgtatcatccaccaaggtagagacctttcgccgggaccggcgctcttcgatccatttgaacaggaagataaatccatatacagggctgggggaagtaaggggcagagccagatcagc

SEQ ID NO: 30844 - DNA, 601 bp, Human
ggaggcattccaggaatcggaaggaacacagacgaactttcttaaaaggctggtgggggcagaaaagagctctggagccccaaagagatggactgtgctggccttgcatggtaattagtggacactaggaagcaacatggcctgagaggaaaagtcctgacagagaaggttctgacatggtctgacttaaggaaactctcctccctccctaggcctgtgtcctttccccgcaactgcatctaaaaacaatggccttacacaatttatttaagagtcaaatgtaacataaacaatcatttgmaaaagaaacagcctaatagtacccaatatcatgtggtagcattcccagtggccctcagggtcagatctgcccagttggctgtgagccaggatgaaggcactgcagcctacctcagggctgaaacccttggtgaagtccttcatgcgactcagggtgggtcccaggtccacgctgctgcagttcaggagcacgctcagcaaggcatgagttgcacaagagttgggtatcagctgtgaaaccaagaatagtcacccatacacagcacccctcactgcaagccccaagcccatatacatcaag

SEQ ID NO: 30845 - DNA, 601 bp, Human
ttctcagggaggtggcgtggctcgggcctggggaaaaacagagtcagggcccaaaaaatgatactccccctactcccaccccacatcagctcccacagctcccacacacctggcatggctattatgggccttggccaactccggggcattgccaatcgcatatcctttgctctacggggaagaaaataaggccgtatcagaataatttctcctcaggtaggactatgggtggaaggcaaagcttcagagagcagcctggaggcattccaggaatcggaaggaacacagacgaactttcttwaaaggctggtgggggcagaaaagagctctggagccccaaagagatggactgtgctggccttgcatggtaattagtggacactaggaagcaacatggcctgagaggaaaagtcctgacagagaaggttctgacatggtctgacttaaggaaactctcctccctccctaggcctgtgtcctttccccgcaactgcatctaaaaacaatggccttacacaatttatttaagagtcaaatgtaacataaacaatcatttgaaaaagaaacagcctaatagtacccaatatcatgtggtagcatt

SEQ ID NO: 30846 - DNA, 601 bp, Human
tggagagcagtcttgaacagcctggctagaacaaggaagacagttcacaggccactgaacagttcccacatgctctgctcaggccatgggatcccagcagcctgctcaccccaaccccactgggacaccctactcccaacccagcccagtgctgggtccctgagtttggcactctcctaagaggaatgaagagagaagacctggcttccttacaacagggacaggctggtggctggggctagagcagcagggcccagagcccagggcccacccaggcccccagctaggaccctgtagttgrgaccgtggcatgatacaaggacctgggcccaccaggacagctcctaggagagaaagcatagtcaggtaggaacttatgtcaacatggtggcatgttgggttggagcccagaaaaatagatgtctctgataggtaaaatatatattctgctgcccaggcagaagggccaggtcctgctgctccacagccggctgtggaggaagctgcagtacctcgctgtgccccaactccagatgctgcctcctgagcactatggggctgatctgccgtgtcaggcctcagggcacgatggaaggaatgt

SEQ ID NO: 30847 - DNA, 601 bp, Human
ctaattttgagaggaaagtagaattctaactgtaaaataaaggttcttggctactctgatacatatatcatctaaaagtgtaactgaccctgacagtggccctgtctcctaggaccccctcctttctcatagaatccagtacactggagagatggtagagatggtacctgatctgctgctgatgtgatcgctccttccaaaatgtccagattccgattcattaatgccaaagcctcctcacgagacactggtgttagggtggcattgggcaatatcgctgcatgctcataaacagctgcartgaaagtgtcctggcagctggctcttgagacatagaaaagcaaaattgccacgtaagctggcaactgagtagtcatgctgaagtccaatgagtgctgaaaaacagagcatgtcctggtatttatagaaagaagacacgtggtgtccagaacttagtaccttaaactacggaagttaattaagaaaacgctatgatttcatagcattgttacataacaaaagaccctaccttattgcagtaatttgtgaagattaactcaagaactctatgtacattagttcgctagggctgcctaacaaa

SEQ ID NO: 30848 - DNA, 601 bp, Human
aaaagaatatatatttatagatatatgtaatacacatttatccatgacttttatcacacttcatgtattcctggtctacacctaatcgatcaatagcttttaaaataatatttgtgtaaaccacaatttatactgtatgattaacttcaaactgaaaccttcactaaacttaaggactcacaatgcattacatatacttttatcttgtaattagaatgaagtgtgaagtatataatgcatgctggcaaggaattgaaaacttaaatttgttttcagattataaatttattcgaaaacctgyaaagccttaatagcacatgagtacatgaaggccactaatactctgaaaatagcacctagtccctgacccatttatcctccatcctccatctgtaccagaaaaggggaacaaagatgttgaatttatggccagttcctcaaaggtctgctgcttcttgataatgagcaaattgttcttttcttaactttgttcttacttttagggaagtccttgctctaattttgagaggaaagtagaattctaactgtaaaataaaggttcttggctactctgatacatatatcatctaaaagtgtaact

SEQ ID NO: 30849 - DNA, 601 bp, Human
aacatgattcctgcttctcagaaaaagaggagccacaaactggttacttgaactgtcccatgcctacaagtactgcctgagctaacctgggcaccttccaattagagagtcaccttaaaaagctctgtgaccttcaaggaaatagttggactaaggatgaaaaagaacatcagaactcctgataaccttttaaatattagtatatataagaatatagggcagtcacggtagctcatgcctgtaatcccagcactttgggagcccaaggcaggtggatcacctgaggtcaggagttcaagtmcagcgtgggcaacatggcaaaatcccatctctacaaaaaatacaaaacttagctgggcacggtggcatgcatctgtggtcccagctactctggagactgtagtgggagaatcacctgagcccgggaagtcaaggctgcagtgagacgtgatcacaccactatactccatcctgggtgacagagtgagaccttaactcaacaacacaaaagaatatatatttatagatatatgtaatacacatttatccatgacttttatcacacttcatgtattcctggtctacacctaatcgatcaata

SEQ ID NO: 30850 - DNA, 601 bp, Human
ggaatcttataagacataaaatagattacttctgtttgccaagtagacttaactgttttccttggcaaggaactttgtttgttccattctcctcaagacagagtctatgtggtaagcagtttttcattctagccttgacccattgccagggtatgcctttaaaaggacaaagtccaaaaggcaacattaggcaacataatgcatgcggcactttctgactgctacacactcctgaaaacacactcctgtgttcttatatgtacacggaaccccttaagcctctttataggagctttccacrctttatcattactttctatgctttgcccctactcgatttctaaagtgtgcttatcattatcaataacatatttttctccttgcccactttatttcattaggcattaactaattggattatttgcaaattaattttaccttatggtagcgtgccaccagttttccttgagaatcaaataccacatcagtgttgtattggtaacggccatcagggggacactgaggatcactggtatcgcatggcttcttgtccccaatatttgccacaacatagatagagttgttcttggccaggcagctg

SEQ ID NO: 30851 - DNA, 601 bp, Human
atgggtatctttatctataaagacccactggaatcttataagacataaaatagattacttctgtttgccaagtagacttaactgttttccttggcaaggaactttgtttgttccattctcctcaagacagagtctatgtggtaagcagtttttcattctagccttgacccattgccagggtatgcctttaaaaggacaaagtccaaaaggcaacattaggcaacataatgcatgcggcactttctgactgctacacactcctgaaaacacactcctgtgttcttatatgtacacggaaccycttaagcctctttataggagctttccacgctttatcattactttctatgctttgcccctactcgatttctaaagtgtgcttatcattatcaataacatatttttctccttgcccactttatttcattaggcattaactaattggattatttgcaaattaattttaccttatggtagcgtgccaccagttttccttgagaatcaaataccacatcagtgttgtattggtaacggccatcagggggacactgaggatcactggtatcgcatggcttcttgtccccaatatttgccacaacat

SEQ ID NO: 30852 - DNA, 601 bp, Human
ttcacccatgaaaaggttttgctgcaataaacagaagataaagagaaaaaaattattttaggaagttgatctggacatcacagtgtgggaaaaagtacaagctcacatcttagtgccaatttcatctatgatcagtgttttcatgggaaatgagtttgctttagagaatcagaggccattctagctaaactgggcctttagttcagtctccacattacaaatatgtacatgggtatctttatctataaagacccactggaatcttataagacataaaatagattacttctgtttgccaagtagacttaactgttttccttggcaaggaactttgtttgttccattctcctcaagacagagtctatgtggtaagcagtttttcattctagccttgacccattgccagggtatgcctttaaaaggacaaagtccaaaaggcaacattaggcaacataatgcatgcggcactttctgactgctacacactcctgaaaacacactcctgtgttcttatatgtacacggaaccccttaagcctctttataggagctttccacgctttatcattactttctatgctttgcccctactcgatttctaa

SEQ ID NO: 30853 - DNA, 601 bp, Human
ggtaacagcaggatcatggaagagtatatcaaagcatgtgaaaatgccaaaacttccaaaggtggtattgaaagtcacaatctcaggctccttgggtacattgaattgattttcacccatgaaaaggttttgctgcaataaacagaagataaagagaaaaaaattattttaggaagttgatctggacatcacagtgtgggaaaaagtacaagctcacatcttagtgccaatttcatctatgatcagtgttttcatgggaaatgagtttgctttagagaatcagaggccattctagctaaaytgggcctttagttcagtctccacattacaaatatgtacatgggtatctttatctataaagacccactggaatcttataagacataaaatagattacttctgtttgccaagtagacttaactgttttccttggcaaggaactttgtttgttccattctcctcaagacagagtctatgtggtaagcagtttttcattctagccttgacccattgccagggtatgcctttaaaaggacaaagtccaaaaggcaacattaggcaacataatgcatgcggcactttctgactgctacacactcct

SEQ ID NO: 30854 - DNA, 601 bp, Human
taaaatgggttttcaatgaactcctgttataatgatctgtaatttgaatatttatttttaatactgctactgcaagtaaatgtcctgccttttcccaatcagcttaaaattgaactgacatctaaggtttcaaggtttagcaaataggcagggcacggtggctcatgcctataatctcaacactttgggaggctgaggtgggcggatcacctgagctcggggagtttgagaccaccctggccaatatggtgaaactctgtctctactaaaatacaacaacaacaaaaaaattagccaggcrtggtggcactcgcctgtagtcccagctacttgggaggctgaggcgtgagaattgcttggccgaggaggcagagcttgcagtgagctgatgcaccactgcactccagcttgggctacagagtgagactctgtctcaaaaaaaaaaaaaaaagatttagcaaataaatttagcctgtatttgtaggcttcccagctaaagttgaatttcaaataaacaacaaaatttttagcatacataaatccccaaaagtgtgatatgcttatactaaaaaatcattcattatttatctaaactgtatat

SEQ ID NO: 30855 - DNA, 601 bp, Human
acttagtgtcaaactctttataaagcaagataggcatttgtgaacatataaggaaaatggcttaatttgttcaggcaggaaataaaatgggttttcaatgaactcctgttataatgatctgtaatttgaatatttatttttaatactgctactgcaagtaaatgtcctgccttttcccaatcagcttaaaattgaactgacatctaaggtttcaaggtttagcaaataggcagggcacggtggctcatgcctataatctcaacactttgggaggctgaggtgggcggatcacctgagctcsgggagtttgagaccaccctggccaatatggtgaaactctgtctctactaaaatacaacaacaacaaaaaaattagccaggcgtggtggcactcgcctgtagtcccagctacttgggaggctgaggcgtgagaattgcttggccgaggaggcagagcttgcagtgagctgatgcaccactgcactccagcttgggctacagagtgagactctgtctcaaaaaaaaaaaaaaaagatttagcaaataaatttagcctgtatttgtaggcttcccagctaaagttgaatttcaaataaacaac

SEQ ID NO: 30856 - DNA, 601 bp, Human
ccatgttggacaggggtcacaaactcctgatctcagatgatctgcccgccttgacctcccaaagtgctgggattacaggccactgcactggacctgattcctctcatattttatgtattttttccttttgtagctctttctcttagacctacaaaggcaatcaaggctctctcgtttgttgagaaacacacacacacacatacacacatacacacacatttctcctgaccatgagtctctgttaaaccattgtcttgcttctcttcttcttgtctcagataagatttcttggggaaaaaartgcattcacttccctttgacttttcaacccaatataatctgcccatcatcctatcattatgagctcagaaaattctgccaaaattatactcaaaaatgctaataatggtcaacgtattgtgttaatacacctcatgatttctttcctccaagagtctctacttccttggcatctaccagatgttctctttttaaattttcctttatttcttaattgtatttgcaggtttcttgtcctctgtcctttcctgccccaaataccgaagctcccaaaggttctactttgtcaatagttctttac

SEQ ID NO: 30857 - DNA, 601 bp, Human
tacaacagaacaaaggagcaaataaaggtagaaggagaaaaacagagaacctaaaacaaggaaatagctaagagagcattcctaggatgacagtaaaggaaatctcaatatgacaactgtgcagaatgactagagggaaaccagtgcagagaaaggttattatttttagctcaagataaacttatgaaaatgatattgtggaaaaattattctgagatgctgttggaagatatggggttttaacaaaaagtcaaagaaaattaatgaaatttaaaaaaataaggcaattaataactttagsaaaaacaaagaaaaactataaaagcaaaactctgagtgatgtttgcaatgacatactgatataaacaaaattatgcatatttgctataaaatgcttggaaaatctgtgtggcaagataggggtttatttcacttttacctctctttgtgtctcttcccttggtttggaggtagcttttggtgataatcgagatttttcaagcataatatatcatcacagttagactatgaaaaattataaatataatattataccaaaattccttatcttcaatacaaaaatccaaaatcttctgaaaat

SEQ ID NO: 30858 - DNA, 601 bp, Human
gttcagattagagcaatgtgactagacagcgttgactacaacagaacaaaggagcaaataaaggtagaaggagaaaaacagagaacctaaaacaaggaaatagctaagagagcattcctaggatgacagtaaaggaaatctcaatatgacaactgtgcagaatgactagagggaaaccagtgcagagaaaggttattatttttagctcaagataaacttatgaaaatgatattgtggaaaaattattctgagatgctgttggaagatatggggttttaacaaaaagtcaaagaaaattaaygaaatttaaaaaaataaggcaattaataactttagcaaaaacaaagaaaaactataaaagcaaaactctgagtgatgtttgcaatgacatactgatataaacaaaattatgcatatttgctataaaatgcttggaaaatctgtgtggcaagataggggtttatttcacttttacctctctttgtgtctcttcccttggtttggaggtagcttttggtgataatcgagatttttcaagcataatatatcatcacagttagactatgaaaaattataaatataatattataccaaaattcct

SEQ ID NO: 30859 - DNA, 601 bp, Human
aacacaggacaagactcccagttaaatgtgaagttcagatacacaacaaataattttttagtataagtatgtcttaaatattgaatgggacatacttacactttttaaaaaaaatgtttatctgggctgggagcagtggctcccacctgtaatcccagcactttgggaggccgaggcaggcggatcacttgaggtcaggagttcgagaccagcctggccaacatggggaaaccccatctgtaccaaaaatataaaaaattagctgggagtggtggcatgaacctgtaatcccagctactcrggaggctgaggcaggagaattgcttgaacccgggaggcagaggttgcagtgagcggaaatcatgccactgcactccagccttggcaacagaaagagactctctcaaaaaaaacaaagtttatctgaacttcaaatttacctggagatcctgtatttttatttcctaaattaggcaactgattcaagaaggaaattagaagaatcttgaaacctgggagacctgaccatcccaagaggaagtctccaaagacacttacctccgatttccccgcagcaaaaggtccagctagatcattctat

SEQ ID NO: 30860 - DNA, 601 bp, Human
ccatctgtacagcatattccaagtcaccttcatctcttgcttgactaaagcagcagccgctaactggtcttattgtttccactttgcaggtggaaagtaatcacttcagtgcaagtgtattaagatgggatagaagtaactttcaggtaaaggtagaatgaacatatgcttcaattttatttcctacaatccttcaaaagaacactattttttttaacccacaaaggtaggaaaataggaggatagaccacaacacagttttaaaaactaggatgttgatacaaaaagtagtaattgattyagcagacccaagaaaaccaggtcctaaactagcagtagaaagagccaagaatccctatctacactgcaaagcactcaaattaatcactgggactgctctatacctagagctaggagtaaagttgtggcagtcaaaggaaaataaatgagcagaaagttgtgaaggatgccttggatactaagtcctccaaaaaaccagataactgatcctcccctactccagtaaataacggagaatgtttccagagagggtaaagtggatggtctttagatgaaagtttaagagacatagttgaagggg

SEQ ID NO: 30861 - DNA, 601 bp, Human
ttaagtttttcttccactatagtacgtagctatttgaatataaaatctaagtatgtgagtcatctcaccatgcagatgaaaagtttccaaaaggagatccatattcatttaatgccatctgtacagcatattccaagtcaccttcatctcttgcttgactaaagcagcagccgctaactggtcttattgtttccactttgcaggtggaaagtaatcacttcagtgcaagtgtattaagatgggatagaagtaactttcaggtaaaggtagaatgaacatatgcttcaattttatttcctamaatccttcaaaagaacactattttttttaacccacaaaggtaggaaaataggaggatagaccacaacacagttttaaaaactaggatgttgatacaaaaagtagtaattgattcagcagacccaagaaaaccaggtcctaaactagcagtagaaagagccaagaatccctatctacactgcaaagcactcaaattaatcactgggactgctctatacctagagctaggagtaaagttgtggcagtcaaaggaaaataaatgagcagaaagttgtgaaggatgccttggatactaagtcct

SEQ ID NO: 30862 - DNA, 601 bp, Human
gtaaagatatacaattttcatttgttaatgacaataaagctaggataaattttaaagataaaaaatagaataaaataattaaataaactgctagatgctcttaaaaaaaaaacatgagaaagtcaactgaaatactctcttgatctagaaaaatgcctatgccactttatttggtaaaataatgttacttcttcattagagtcatccagtttatcactgaataattaatacaactaataataaaaataaagggctttaagccccagtgcctcctgcaattcactgtcaaaaagattagccmtgtaaaagcaatcagatccttggcctatagccatgaacagctatatcttcattgttctcaagttactaatgattttaattatcaagaatttaaaatgtgtttaaaggtttaatttaggcacctgtgtaaatcatatcttattgcctgtttcacacaataaaagagcttcagagttgtaatgagccctagagttgacctagaggcaacccctgtaatctggaaaagtcatatcctctatactgcgcaagaactgaaacacttctccattaagtttttcttccactatagtacgtagctatt

SEQ ID NO: 30863 - DNA, 601 bp, Human
cttttcttaaatacacaattaaaagatatgattaagcacttacaggatgtgaaatatttaaaggtaatacacaataatcgggttaccaaaaggacgccttccaatttttctttctattcattttgatgttttgttcttttcaaaacattttctctcattacattcattactaaaggccttactttaaatacatcatgctacattttgttctcctcttcaaatgccaatgttttaacaatttgaattctctggcctgggaaaaagaaaagttatccacttacaaggtatacgtattgacaayatggatgttacagtccaaacaacagcacaaaatcaaccatgtacatgtaacatagtgaaatgagtccacgttttctacacgctacaggataggaagagctggctcttaaggcccagggctcacatgattatgcacttgtcaagcagcttctcagtggtgttgggcatctgggatttcttctcgggctcctggaggccggtggtgggctttttcttgtaattcagcagcatgtggaacagctcctgcacattcacatcggtcttggctgaaatctccatgaaggcgcaattccactccatc

SEQ ID NO: 30864 - DNA, 601 bp, Human
atcacttttgtttttttgagacagggtctcactctgtcatccaggctggagtgcagtggtgtaatcacagctcactgcagcctcgacttctcaggctcaagaggtcctcctatctcagcctcttgagtagctgggactacaggcatgcatcaccacgcctggctaattttttatatttttagtagagatggggtctcgtcctgttgcccaagctgatcttgaactcctaagctgaagtgatctccccacgcatcaccacacctggctaattttttctatttttagtagagatggggtctcrctatgttgcccaggctgatcttgaactcctaagctgaagggatcttcccaccttggccacccgaagtgctggtattacaggcgtgaaccaccgtgcccagcctgattgttttacaatcttcaccctcatagcactccttattccctttccctgctttatttttttcctttacacttactatcatttcacaaattttacttattacttacggttggtatctcctcattggaatgtaagctctctgaggcggcaaaattttgtctatttgttccctgctgtatccccagggcttaaaacagg

SEQ ID NO: 30865 - DNA, 601 bp, Human
agccacatggccactttcttcaagtcttgactcgactgccaccttttcggtgcagcttctctgatcacttttgtttttttgagacagggtctcactctgtcatccaggctggagtgcagtggtgtaatcacagctcactgcagcctcgacttctcaggctcaagaggtcctcctatctcagcctcttgagtagctgggactacaggcatgcatcaccacgcctggctaattttttatatttttagtagagatggggtctcgtcctgttgcccaagctgatcttgaactcctaagctgaagygatctccccacgcatcaccacacctggctaattttttctatttttagtagagatggggtctcgctatgttgcccaggctgatcttgaactcctaagctgaagggatcttcccaccttggccacccgaagtgctggtattacaggcgtgaaccaccgtgcccagcctgattgttttacaatcttcaccctcatagcactccttattccctttccctgctttatttttttcctttacacttactatcatttcacaaattttacttattacttacggttggtatctcctcattggaatgtaag

SEQ ID NO: 30866 - DNA, 601 bp, Human
ccacatgttaaatcttcttccagcagctagagtttagcctccttgaagggaagggcaatgtgaatgctccttctgaatgccccacagacctgagcacatggtaggctctaaagtaggtatccttttaataaaccttggagtcatccagattcctctttctttcacttcaaatctgtcagcaaatcttctcatctccaccttcaaaatacacccagaatctgaatgcttctcaccgctttggctgctaccacctcagacaggccaccatgatctctcatctgggtaactgcaatagcttcctaactagtctcccagtttttgcttttgctcttgcccccattctctttcatctagtctcaatatagcagccagtgtgattctatgaaacattaatcagatcacatcactcctttgctcaaaatcctccagtggtttctcagttccctcaaagtaaaagccagtcttcatgacagccaaagtgtctgacacccggctttgttctcaggtcatataacccactaccctcacccacacgtgctctactccaacaacaccagcctccctgccagtctcccaatatgcaggcacacacccacctcaa

SEQ ID NO: 30867 - DNA, 601 bp, Human
acgatggttagcttcccagagcaccaatgtgcaggagtggaggagggatgagaactaaggggtaagaagcagcctcccaaagaaaatagactggcctcacctggctgacataggtgagtgtgctggtcctcctcggtcagccccaggcaccaggcatggtaggcaaaggcaaagaggtcttcaggcttggcaggtcttgctgtggctcggcttagccgtgagagccactcttggcactgcttaaaagtggagaagtggcacctgccaggcaagaagccacaggcctaggtgaggcaaagtrcagttgtgccatggggctatcagggccaaaaacacagccacaggaaggctgtgaggagagaaggctgcaaagcaagaggtaaagcagtggggacccagggtggggggacgagggacactggccaacacccaacagaagttgtctcttgtgataattctcttcccaagaactcctgtgtttgaggcatacttatcctctcgaatggggcgctactgtttctcgtatcaaatctaaatgctaccatgtggccctgaacgtctgcactccttgtccctaccctaatggaccagtgttatctcc

SEQ ID NO: 30868 - DNA, 601 bp, Human
ccagagcacgcagtcagagaagaatctaaacacacagcaggaaggagtccctgagtcagccagccacccaacctcttgctggccctctggcactccctctcagaaggcagaacatgcaactagagacccctcataccccacagcttctgacaaggcagggaccccagcaccccgtgtgttgtcatcttcccagactctcactggggactccctgggagccaatgaagccaaggagggggcctgctccctggggggttagcatcatccacaccttaccaaagtcagcatcacacgcctcgcyggtatcattattcccggtgctgagggagcccccagtggcccttgtccccgggtccagggcacaggctttagcaatggacgtgaccaggtactcatcatcagcattgcgccagccccaccagctgatctctggctggctgcagcgggcgatggcagccccattgcgcaagtgtctgacaaaacagaagaaaccgtaatgcccttggcattcgaagcctccagaggcctacctcagggggttagaccaaagtctctagagccagcaggggctaccaactcatccaggccataacagcaacca

SEQ ID NO: 30869 - DNA, 601 bp, Human
gtgtggatttacctatgtagagataaacatttggaaagacacgtaccaaatgttagcagtggacacctgtggggacaaggatcataagggaagattttcattttctacttttatattgactatttttttaaaacaagaaataggtattactctcataaattaaccaacatcatctcacttctccccaaacattgagccagaagatacctaattttatgtctcccttttaaattctggcctttttctgagggagtaatataaggccatcctcctgctgggaacccatttccctgagagtcakatgtttctggaagctaatgctggacacaacaaaggttgctactaatatagcaagctccccatgccctgtaccagtgaacaaaaatcaagaccattcccacaaaccttcctaaaacagtcctttctgttttgttctctcccctgcttgggtatatcatacagagtgatagcagctcctccaggaaagaaagtatccaaccttatcttcagaggaccttgaaaacacacagagtgcactccaggctagctacaagtcttggccaagtttttcctgcaaatgactcaagaagttgcttttaaa

SEQ ID NO: 30870 - DNA, 601 bp, Human
atttctttgctgtagcccacaaaacctagtacagtaatacgcaacttgtaggtattaaagaaacatttgttgaattgataaatcagatactaagttaatgaaatgattattaaatgggtcacagagcttattaaaaatttgattaaaagttatggcccctctcccaggaaaagtaaacctatgaacctgtagccaaattctgcatagtttggggaaggaaaaaaaaaatcactgaaatcctgaaacctatcacggtcccctcacaatgacttagttcaaaagaccctaaaaccaataattkgggatgctgggctttttgttttcctttataatattcaaccaataacatatgttatattttaactttaaaaactttcagccaggctgggcatggtggctcacacctgtaattccagtgttttgggaggccaaggcaggaagatcactcgacgccaggaatttaagactaacctgggcaacagacccgtctctacaaaaaataaaaattggcacatgcctaatgagctaattagctacctgggaggctgaaacagaaggattacctgaggtcaggagtttgaggttactataattgtgccac

SEQ ID NO: 30871 - DNA, 601 bp, Human
actgcactccagctgggcaatggagcgagaaaaccctacctctcatgtatccacttgctttggacccctctccactaaccttgttactgagctcacaactccctttatttcattcatttgtccagttttttttttttttgagacagtctcactctgttgcccgggctggagtgcagtggcgcgatctctgctcactgcaaactccgccttcccaggttcataccattctcctgcctcagcctccagagtagctgggactacaggcgcctgccaccacgcccggctaattttttttttttttgtatttttagtagagacggggtttcaccgtgttagccaggatggtcttgatctcctgacctcatgatccgcccgcctcggcctcccaaagtgctgggattacaagcatgagccaccacgcccagccatttgtccagttttaagtaaatttttactttagtaaatttatttaaatttacttattacgtgccaggttctaagccagatacacagaacacaaaaagacccacagttcttgtctggtccttcatgaaaatttcctgagtaaaacagccaccaagtgacccttttaaaaaacaca

SEQ ID NO: 30872 - DNA, 601 bp, Human
aatttaatcctttctctttgccagggactcttcccctcatatctgaactactacagcagtgctggctggtctctgtgcctccagctaccctgtactcactgattagttctccaaggatcccactgtcagcagaccacagtaacttcctacaatgacttcctattgacaactgaatcaaaataaactcttcactgtaatgtttaaagccttcaatgccctcaatgacctgtcctatatttccactattccttaaaatagccccttctcaacccctgccagccacagaacttctttttttttwaaaaaaaaaaaaactacctctcacccaggtgcagtggctcacacctataatcccagcactttgggaggccaaggtgagcggatcacttgaggtcaggagttcgagaccagcttggccaacatggcgaaaccccgtctctactaaaaatacaaaaattagccaggtgtagtggcacacacctgtaatcccagttactcgggaggctgaggcagaagaatcacttgaacccggtgggcggagtgagctgagaagatcatgtgactgcactccagctgggcaatggagcgagaaaaccctacc

SEQ ID NO: 30873 - DNA, 601 bp, Human
ccaaatttgggtggatttctgacttgtcgaggatcttcggttgacattttactcatgttatgctcagccttagcagcatcagatggtttagataaattcctaagggattcccgaatttcttgtaacatttgccggctactgacagtatagttactggcaggaaaggtcttaggcctcatttgtctatatccttctggcttttcactcctcttcatgaaaacatctatatatgtagcccacacgaaggacttctttatttgatagatccagagctttcttctgagcaaaagtgaaaatgatscttcaaggaagtccccaggactgttaaaattctttacaatataaataattaactctgtaaaagaaagaaagaaaggaaagctataaagtggttaatacagcagtaccatgtattagaggaaaagtccattgatataggggttaagagattcaggttatagttctgactccattaaggattactccgggttcaggacaagttacttaatctctccatgcctacttcctagcctataacctagatttacctcaaatcgtagctatgatgatttaaaaaaaaaaaaaaaagttccttagtaag

SEQ ID NO: 30874 - DNA, 601 bp, Human
ctctttgctaggcttactgattgactcgtatggaggaacagatgggttttggtgcagcagatgttttgggtagggtggtggtggtccttgatagtttggagcttcagcaacaggtggcatcacagtcacatttgaagcggttccctcaggaaaaggactgggttgaacagtttgaattggctgtggtatccaagaagggtgtgtaggtgctaaagcagtctgtagctctggttttaatacacgcatacttttcacaggctgttgaataggagctggtgtaattgcagtgactgttgtagcrgaaggctgagaattagcagagtgacttgctctatttcctaatgggttattaaaagaatttgacctcactggtatgttaggttgccatgtagggatttcatgcccactgctcggggatgactgggctggagcagaagatgactgaggccaatttgtttgcagtccaggtacactaatgttatatagttccatgttatgactatttctgtttggcaccatcatagactgaggaatacttccatttgtatatgacgaaggagcagcagatccccctgtttgtaaagcagaagggctttgtcca

SEQ ID NO: 30875 - DNA, 601 bp, Human
atcttcatccgactgctgctctgagccttgtgaattaatgtattcatattcaataggcttcggataattatatgggtagccattgtcatcaaaaaaccttcggaaggtaaattcatagaatgcatgttcaggatgctttccatttttataccatccattgagagtgtcatttacattttcttcctcgttatcatcactccataatttatcaggatcaacaggatcaaaatttgatgtatctgttgggtgtgtgattttaggaatgtatgaagcagactgctgtctcaggtcactggagaartcaattgttttaaaaaatggatgagcttttatttcatcagcaccattcttgcctaagcgatcttcgggtcctcggcaaagtttaataataagatcagaagcttcaggactgagtttagcttgtggtggaatgtgaagagatgtttgccagttgataacctttaaagattttttaaaattagggggaagagataaattagaaaaataaagatttccttcaagttttataccaaaagtctcactgggctatttttgtattttaaataaattacatgatattttgctggaaaataattttttc

SEQ ID NO: 30876 - DNA, 601 bp, Human
aaattggaagcagcatcaaaaataccaatatggaaaaaaagctagtagtgctttggcttcttttaaagccagtaattcttgagaaataaatgcaagaagattaaatagattaaatattccatggggcggggggtggggggggaagataaatgcattatttttccttctgacaaacatattaatattttttcaaccctgtattccttagtttcaggatgtgaattatacagattatcattagcctaggaacactcaccaacacgatggcttaatttctctagcttattttctaccaaaaacraggttatgaggggaaaaaagagctctgtaaaatagggggtatgtttcatatttggttaaagcaagataaaactaaaactgtctttcaaaaaaatttcaaaaactcttgtattttaaaattatttagcatatatacaaatagataccaggtttctccttttaaacaaagcactacttattttaagtactttaagtaccaagaactgactataatattcagttcataatttactttccttataacaatttttttctaaatactgatttaaacggctggaataaattaacattttaaaaggat

SEQ ID NO: 30877 - DNA, 601 bp, Human
gtgatccacctgcctcggctttccaaagtgctgggattacaggcgtgagccaccgcgcccggccgcaacttttttcttttttgagatggtgtctcgctctgttgcccaggctggagtgcagtggtgtgatctcagctcactgcaacctccgcctcctgggttcaagcaattctcgtgcctcagcctcccaagtactgaggattacaagtgcaaaacactgtgcctggctaatttttctattttcagtagagatggggtttcgccatgttggccagcctggtcttgaactcctgacctcaastgatccacccaccttgacctctcaaagtgcttacaggtgtgagccactgtgcccggccatcagcaactttttgatgttgcttcttagacagtgactatatcctcacatcctcacaaaaggaggttgactgcactccttaagggaatctacagaatcctaagagtgtgcagacagcagatgtttaatacatgtgtgttaaactgaaggctgtcatggctggcaaataaggctttttttcttcagtgccttttgtttcttgccaatcctcaatgctctgaaaaccctgttagtcagggctag

SEQ ID NO: 30878 - DNA, 601 bp, Human
catacttaggctgttgtagtccacctacctggtgcgaaagcaaacacagcgaaacattctcctgtggaagcaactgcagtgactatggaacgtcttttgccaaaatattgtgataggatggttacagttgggagaaaactaaagcagtatcccagacctgtgaaagaaaagtcaaaaaagccaatgagacccacatactgcttgagactggaaggatgcattaaaagatctgggatttttggttttgctttttgaatcttaagttctaggagccaagtaattcattctggacaaaggtgaygttgcaaagaaaaatgggtttcattaacggtctggataaacttcagtggttgtttgggatactaaaaatataactttttttttttttatctttgcaacactttttttcaaatttatataattcacaatggatgaaactattattgcatgaaattttatataagatttgtatctagaaagaaataagtcatttcatatgtgcagaaatacaggaaaaatttaaagtctgcaaatcttaacaactgtgtgtgtatctatcatctatgaggaatatatggcctccttttattgttcatttcat

SEQ ID NO: 30879 - DNA, 601 bp, Human
tctcgatctcctgacctcctgatctgcctgcctcggcctctcaaagtactgggattacaggcatgagccactgcacctggcctttttttgtgtgttttaagtagagacaggtttttgccatgttggccaggctggtctcgatcacctgacctcaggtgatccgcccacctcagcctcccaaagtgctgggattacaggtgtaagccaccgtgctcagttacagattttgttttgagatgatctacacacagataagaatgctgtgtttattagcataatctaaatccacattgaatgtagstcttttgaaaaacgagaggacataacaggtgaataattgcaaattactagattattctggaatgcatgtgtcaagaaagccctaccactgcatatgtgcccagttaggaattgaaacctattattaaggtggtctgaatacctaaagtgggggttagggaggacagatcctaaaaatgagctggagaagagacgtaaataacgtctcattacacatacactgaaagtcatccatactgttggcaaaagttagcgtagcaagaatacctgagtgacgtctctcatccacattcatacttag

SEQ ID NO: 30880 - DNA, 601 bp, Human
tatttatttactttttgagacagagtctcactctgtcaccaggctggagtgcagtggcctgatctcagctcaccgcaacctccacctcccgggttcaagcgattctcctgcctcagcctcctgagtagctgggactataggcgtgcgccaccacgaccagccaatttttgtatttttagtagagacagggtttcactgtgttggccaggatggtctcgatctcctgacctcctgatctgcctgcctcggcctctcaaagtactgggattacaggcatgagccactgcacctggcctttttktgtgtgttttaagtagagacaggtttttgccatgttggccaggctggtctcgatcacctgacctcaggtgatccgcccacctcagcctcccaaagtgctgggattacaggtgtaagccaccgtgctcagttacagattttgttttgagatgatctacacacagataagaatgctgtgtttattagcataatctaaatccacattgaatgtaggtcttttgaaaaacgagaggacataacaggtgaataattgcaaattactagattattctggaatgcatgtgtcaagaaagccctacca

SEQ ID NO: 30881 - DNA, 601 bp, Human
aagaggaggctgtatctccagccaatgcgctccttcagagccatgattgcttgaataggcaggagtgaagaagaaataatataaggtcaataatggactcaagacccaggagaagccatcaagaagaaatatggatccagattttgttataagttctgtggaaatttattatactcagcagtatgaatgtactcaatctttatttatttactttttgagacagagtctcactctgtcaccaggctggagtgcagtggcctgatctcagctcaccgcaacctccacctcccgggttcaagcaattctcctgcctcagcctcctgagtagctgggactataggcgtgcgccaccacgaccagccaatttttgtatttttagtagagacagggtttcactgtgttggccaggatggtctcgatctcctgacctcctgatctgcctgcctcggcctctcaaagtactgggattacaggcatgagccactgcacctggcctttttttgtgtgttttaagtagagacaggtttttgccatgttggccaggctggtctcgatcacctgacctcaggtgatccgcccacctcagcctcccaaagtgctg

SEQ ID NO: 30882 - DNA, 601 bp, Human
aatgatgtacaaggaaggtgcaaagaatcccagtgttgcaaagagaccaaataaatgcataaccaaataaaacttttctctttcaaaaatggagaagtctaatagcggggctttcttttcgcttggcctggggctggtcttcaccaggacctgctgcatgtcggccttcggctccagttccaggttagtgtgagtaggcacatttttaggtgaggtagttagttctactcctgagtcaatggagtctattgaggttcgtgttttctcattttcaagcatatactgcgcttctttccgattktcctggatgactattttcggtgacgctggtcctctgataaagatgggtctgagcagtgctccgaagatgacaatgtttaactgtagtaggcccacgaagaggaggctgtatctccagccaatgcgctccttcagagccatgattgcttgaataggcaggagtgaagaagaaataatataaggtcaataatggactcaagacccaggagaagccatcaagaagaaatatggatccagattttgttataagttctgtggaaatttattatactcagcagtatgaatgtactcaatctttatt

SEQ ID NO: 30883 - DNA, 601 bp, Human
ggtgccacctgccctgccccgtcctgtccctcctatccctcctgtccctcctgtccttcctgccacctcctgccaggctggctctgggaagtgggtgaaaggagatgccaaggccaacacgtgggcctctggccacctcccaggggtggtgcccctctgtgacacctggtacttgggtatgaggaagggatggcttagctgcccagagaaggtggcaggtgggccaggagagacggacagcctgctgaccaccaggctccattctgtcccctccccaggcagcagccacattggcagtgargccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcaggtgagcggcctagggaggggccgatgagaaagtcctaggggttgcggggaagccacaacctccctggccttctgat

SEQ ID NO: 30884 - DNA, 601 bp, Human
tggtgcccctctgtgacacctggtacttgggtatgaggaagggatggcttagctgcccagagaaggtggcaggtgggccaggagagacggacagcctgctgaccaccaggctccattctgtcccctccccaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaaytgcaatgggagttccaggccagcaacagcgagacctcttggttcccctccatcctcacggctgtgctccacatggcaggtgagcggcctagggaggggccgatgagaaagtcctaggggttgcggggaagccacaacctccctggccttctgattccctctctctgaggccacaggctttgcctcctgggtgaattcctaaggtttcaccagatttcaccaggggcccctggctggaatccagctggactgggctggagccggggagagagtggggaggtgcctgggttgcaaagccagg

SEQ ID NO: 30885 - DNA, 601 bp, Human
ctactccctccacttgccaccagcagcctgcctattattccaggtcctgccctcaaactgggagggaggtgaggctcggagaaagcgccaccctcctgggtgagctctgaatctgccacatggcctctggcctgcagggttggggcagggagtgggaatcccagagggctgcttctcacacaggcagagcagggttcctgggccaggggctaggaaccgggcacccggcggggaacctactccccagctgacttgcggctcaccacccccagcaggcatctcagcatctccatcagcatgrgattcctggctggccatctctctcatgtacacatacacgtgtatgagcccgtgctcattcagagtactgtagacattttattttatgtttatttatttatttgcttatttttgagacagagtctcactctgtcacctgggctggagtgcagtggcatgatcacagcctattgcagccttaacctctcaagctcaagcgatcctgccacctcagcctcccgagtagctgggaccacaggtgtgcaccaccacacccagctaattttttttttttttagatggagtctcgctctgttgccca

SEQ ID NO: 30886 - DNA, 601 bp, Human
gcatctcagcatctccatcagcatgagattcctggctggccatctctctcatgtacacatacacgtgtatgagcccgtgctcattcagagtactgtagacattttattttatgtttatttatttatttgcttatttttgagacagagtctcactctgtcacctgggctggagtgcagtggcatgatcacagcctattgcagccttaacctctcaagctcaagcgatcctgccacctcagcctcccgagtagctgggaccacaggtgtgcaccaccacacccagctaattttttttttttttagatggagtctcgctctgttgcccaggctggagtgcagtggtgcaatctcagctcgctgtaacctccgcctcccaggttcaagcgattctcctgcctcagcctcctgagtagctgggactacaggtgcgcaccaccatgcctggctaattttttgtatttttagtagagacggggtttcaccgtgttagccaggatggtctcgatctcctgacctcatgatctgctggccttggcctcccaaagtgctgggattacaggtgtgagccaccacgcccagaccatacccagctaattttttt

SEQ ID NO: 30887 - DNA, 601 bp, Human
cttatttttgagacagagtctcactctgtcacctgggctggagtgcagtggcatgatcacagcctattgcagccttaacctctcaagctcaagcgatcctgccacctcagcctcccgagtagctgggaccacaggtgtgcaccaccacacccagctaattttttttttttttagatggagtctcgctctgttgcccaggctggagtgcagtggtgcaatctcagctcgctgtaacctccgcctcccaggttcaagcgattctcctgcctcagcctcctgagtagctgggactacaggtgcrcaccaccatgcctggctaattttttgtatttttagtagagacggggtttcaccgtgttagccaggatggtctcgatctcctgacctcatgatctgctggccttggcctcccaaagtgctgggattacaggtgtgagccaccacgcccagaccatacccagctaatttttttactttttgtagagacggggtctcactatgttgctcaggctggtctcaaactcctgggctcaagtgatctacctgcctgggcctctcaaaatgctgggattacagacatgagccacggcacttgaccaca

SEQ ID NO: 30888 - DNA, 601 bp, Human
gaccacaggtgtgcaccaccacacccagctaattttttttttttttagatggagtctcgctctgttgcccaggctggagtgcagtggtgcaatctcagctcgctgtaacctccgcctcccaggttcaagcgattctcctgcctcagcctcctgagtagctgggactacaggtgcgcaccaccatgcctggctaattttttgtatttttagtagagacggggtttcaccgtgttagccaggatggtctcgatctcctgacctcatgatctgctggccttggcctcccaaagtgctgggattrcaggtgtgagccaccacgcccagaccatacccagctaatttttttactttttgtagagacggggtctcactatgttgctcaggctggtctcaaactcctgggctcaagtgatctacctgcctgggcctctcaaaatgctgggattacagacatgagccacggcacttgaccacagtattgtagaaatttttaaacacgatgaatcatggatactttcactgatcctttcaagtgcccctgcccctacctacgccttttagaggtaaggaaagcaagcaggcacagaacacaagacctgcc

SEQ ID NO: 30889 - DNA, 601 bp, Human
acaggtgcgcaccaccatgcctggctaattttttgtatttttagtagagacggggtttcaccgtgttagccaggatggtctcgatctcctgacctcatgatctgctggccttggcctcccaaagtgctgggattacaggtgtgagccaccacgcccagaccatacccagctaatttttttactttttgtagagacggggtctcactatgttgctcaggctggtctcaaactcctgggctcaagtgatctacctgcctgggcctctcaaaatgctgggattacagacatgagccacggcacytgaccacagtattgtagaaatttttaaacacgatgaatcatggatactttcactgatcctttcaagtgcccctgcccctacctacgccttttagaggtaaggaaagcaagcaggcacagaacacaagacctgcccaaggctgaagagtgagttcacggcagaggaaacaccctgtgtcccgcccggccacaccaccctcagctatgcagctctggcctgcagcccagtccccacccccacccctgtgactaagggctttccccaatgtcaacttccctaagtcaggccagagtctctggc

SEQ ID NO: 30890 - DNA, 601 bp, Human
gcgattctcctgcctcagcctccctagtagctgggaattacaggcatgcgccaccacacccggctaatttttgtatttttagtagagatggggttttaccatgttagccaggctggtctcgaactcctgacttcaggcgatccacctgcctcggcctcccaaagtgctgggattacaggcgtgagccaccacgcatggccactccatcacttttttttttttttttttttttttgagatgtagtttcactctgtcgcccaggatggagcgcatcgggttctgcctcccaggttcaagcgaytctcctgcctcagcctcccaagtagctgggattacaggcacgcaccaccatgcctggctaatttttgtatttttagtagagatggggtttcaccatgttggtcaggctggtctcgaactcctgaccttaagtgatccacccacctcggcctcccaaagtactgggattacaggcgtgagccaccacacccagcctactctgtcacttttatactcacactggctcacaccacacatcccccctccaccgcagacacacacaagcatctcatgcgcacacacttccctgtccctttagttg

SEQ ID NO: 30891 - DNA, 601 bp, Human
cagctcttttctatttttttggggtgtggattggtgagaaagcagctgggagccaggcaaggaacaggcccccctccacattgagccaaacctctaggtgcagactttggtggtgctggaggtggtgtgggaggggagaacctaccctgcctgattgtctgcagaggccagtgcaaggaggcgcagaggggcccagggttcccctcagctgtagggctgggaaggtggtgggagggtgggagggatctagccagtcttcctgaggatgttgggtgtggggatggggcaggtaaaacaggawctgaaggtgcacactgtaatctagatgtcctggaacactgccccgactcctcccaccaacagacccccagcgaagtgggggaggtaaactcatgaaccaatcctgtttcacccggatagaatgagcagcctcaggtctgtgtagttcagggtcttgctccacctttcagggaatcctcatcagggtcaaacatcgcccattctgaatccttactttgtaggggaaaaaattgaggcacggagagggatcaggctttgctcaggccacatggccagtccatggcaggtgggtatcagaatc

SEQ ID NO: 30892 - DNA, 601 bp, Human
tggggtgtggattggtgagaaagcagctgggagccaggcaaggaacaggcccccctccacattgagccaaacctctaggtgcagactttggtggtgctggaggtggtgtgggaggggagaacctaccctgcctgattgtctgcagaggccagtgcaaggaggcgcagaggggcccagggttcccctcagctgtagggctgggaaggtggtgggagggtgggagggatctagccagtcttcctgaggatgttgggtgtggggatggggcaggtaaaacaggatctgaaggtgcacactgtartctagatgtcctggaacactgccccgactcctcccaccaacagacccccagcgaagtgggggaggtaaactcatgaaccaatcctgtttcacccggatagaatgagcagcctcaggtctgtgtagttcagggtcttgctccacctttcagggaatcctcatcagggtcaaacatcgcccattctgaatccttactttgtaggggaaaaaattgaggcacggagagggatcaggctttgctcaggccacatggccagtccatggcaggtgggtatcagaatccaggcctgctcgtgccctt

SEQ ID NO: 30893 - DNA, 601 bp, Human
ctgggagccaggcaaggaacaggcccccctccacattgagccaaacctctaggtgcagactttggtggtgctggaggtggtgtgggaggggagaacctaccctgcctgattgtctgcagaggccagtgcaaggaggcgcagaggggcccagggttcccctcagctgtagggctgggaaggtggtgggagggtgggagggatctagccagtcttcctgaggatgttgggtgtggggatggggcaggtaaaacaggatctgaaggtgcacactgtaatctagatgtcctggaacactgccccractcctcccaccaacagacccccagcgaagtgggggaggtaaactcatgaaccaatcctgtttcacccggatagaatgagcagcctcaggtctgtgtagttcagggtcttgctccacctttcagggaatcctcatcagggtcaaacatcgcccattctgaatccttactttgtaggggaaaaaattgaggcacggagagggatcaggctttgctcaggccacatggccagtccatggcaggtgggtatcagaatccaggcctgctcgtgcccttgaaaccacctggctagttccagctgg

SEQ ID NO: 30894 - DNA, 601 bp, Human
tagggctgggaaggtggtgggagggtgggagggatctagccagtcttcctgaggatgttgggtgtggggatggggcaggtaaaacaggatctgaaggtgcacactgtaatctagatgtcctggaacactgccccgactcctcccaccaacagacccccagcgaagtgggggaggtaaactcatgaaccaatcctgtttcacccggatagaatgagcagcctcaggtctgtgtagttcagggtcttgctccacctttcagggaatcctcatcagggtcaaacatcgcccattctgaatcctyactttgtaggggaaaaaattgaggcacggagagggatcaggctttgctcaggccacatggccagtccatggcaggtgggtatcagaatccaggcctgctcgtgcccttgaaaccacctggctagttccagctggaactgccctctccagccactctcctctcccgccacctcctcattcagctgctacctgctggctgtcttctcccacagggcccctgtgcagcatcctggtgggacgcttcggctgccgagtgaccgtgatgctggggggcgtgctggccagcctgggcatggtggcc

SEQ ID NO: 30895 - DNA, 601 bp, Human
cgaagtgggggaggtaaactcatgaaccaatcctgtttcacccggatagaatgagcagcctcaggtctgtgtagttcagggtcttgctccacctttcagggaatcctcatcagggtcaaacatcgcccattctgaatccttactttgtaggggaaaaaattgaggcacggagagggatcaggctttgctcaggccacatggccagtccatggcaggtgggtatcagaatccaggcctgctcgtgcccttgaaaccacctggctagttccagctggaactgccctctccagccactctcctctcccgccacctcctcattcagctgctacctgctggctgtcttctcccacagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggtgactatcacttcatctccagaatttataggcacctgctagaaagtgccaggcacaagtggacagggcaggcaggcctcttaatcttctggaactgctggctgg

SEQ ID NO: 30896 - DNA, 601 bp, Human
tacctgctggctgtcttctcccacagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggtgactatcacttcatctccagaatttataggcacctgctagaaagtgccaggcacaagtggacagggcaggcaggcctcttaatcttctggaactgctggctgggtgcggtggctcacacctgttatccyagcactttgggaggctgaggcgggcagatcacctgaggtcaggggttcgagactagcccggccaacatggtgaaaccctgtctatactaaaaaaaatacaaaaattagccaggcttggtggcgggcccctgtagtcccagctactcgaggctgaggcaggagaatcgcccgggaagtggaggttgcagtgagccaagatcgcaccactgtactccagcctgggcaacagagcaagaccccatctcaaaaacacaaaaaacaaagtgctgggattacaggtgtgagcccatcatgcccagc

SEQ ID NO: 30897 - DNA, 601 bp, Human
ctgccgagtgaccgtgatgctggggggcgtgctggccagcctgggcatggtggccagctccttctctcacaacctcagccagctctacttcacagcaggattcatcacaggtgactatcacttcatctccagaatttataggcacctgctagaaagtgccaggcacaagtggacagggcaggcaggcctcttaatcttctggaactgctggctgggtgcggtggctcacacctgttatcctagcactttgggaggctgaggcgggcagatcacctgaggtcaggggttcgagactagcccrgccaacatggtgaaaccctgtctatactaaaaaaaatacaaaaattagccaggcttggtggcgggcccctgtagtcccagctactcgaggctgaggcaggagaatcgcccgggaagtggaggttgcagtgagccaagatcgcaccactgtactccagcctgggcaacagagcaagaccccatctcaaaaacacaaaaaacaaagtgctgggattacaggtgtgagcccatcatgcccagccctttcacggcattttgttttaaggggactggaggaacagactatacccagaagtggtta

SEQ ID NO: 30898 - DNA, 601 bp, Human
aaaaattagccaggcttggtggcgggcccctgtagtcccagctactcgaggctgaggcaggagaatcgcccgggaagtggaggttgcagtgagccaagatcgcaccactgtactccagcctgggcaacagagcaagaccccatctcaaaaacacaaaaaacaaagtgctgggattacaggtgtgagcccatcatgcccagccctttcacggcattttgttttaaggggactggaggaacagactatacccagaagtggttatgaggtcaagacaggctttttttgtttgtttgtttgtttttttttaatgggagaaataacgaaggagaaggatctaggaaagaagaaaaaaaggatgatgcaggagagaggggacttgctagaggggtgcctctgagtggagaggatgcagggcagaagggagggacagccactgggggaatgggcaagccattgtcactggctagcaggcatgtgggcagctgagcataaggatggggaggaggtgttggggggcacagaggaagacaccggtagtcacctagcagggcaggcaaggcatgattgagggagctgtagtggcgtcacaggcagcctgagg

SEQ ID NO: 30899 - DNA, 601 bp, Human
gaggctgaggcaggagaatcgcccgggaagtggaggttgcagtgagccaagatcgcaccactgtactccagcctgggcaacagagcaagaccccatctcaaaaacacaaaaaacaaagtgctgggattacaggtgtgagcccatcatgcccagccctttcacggcattttgttttaaggggactggaggaacagactatacccagaagtggttatgaggtcaagacaggctttttttgtttgtttgtttgtttgtttttaatgggagaaataacgaaggagaaggatctaggaaagaagaraaaaaggatgatgcaggagagaggggacttgctagaggggtgcctctgagtggagaggatgcagggcagaagggagggacagccactgggggaatgggcaagccattgtcactggctagcaggcatgtgggcagctgagcataaggatggggaggaggtgttggggggcacagaggaagacaccggtagtcacctagcagggcaggcaaggcatgattgagggagctgtagtggcgtcacaggcagcctgagggcccgcctgaggccacggtcacacatgattgagaactttttctccag

SEQ ID NO: 30900 - DNA, 601 bp, Human
gcccgggaagtggaggttgcagtgagccaagatcgcaccactgtactccagcctgggcaacagagcaagaccccatctcaaaaacacaaaaaacaaagtgctgggattacaggtgtgagcccatcatgcccagccctttcacggcattttgttttaaggggactggaggaacagactatacccagaagtggttatgaggtcaagacaggctttttttgtttgtttgtttgtttgtttttaatgggagaaataacgaaggagaaggatctaggaaagaagaaaaaaaggatgatgcaggagrgaggggacttgctagaggggtgcctctgagtggagaggatgcagggcagaagggagggacagccactgggggaatgggcaagccattgtcactggctagcaggcatgtgggcagctgagcataaggatggggaggaggtgttggggggcacagaggaagacaccggtagtcacctagcagggcaggcaaggcatgattgagggagctgtagtggcgtcacaggcagcctgagggcccgcctgaggccacggtcacacatgattgagaactttttctccagcatgctcaggtgtgcaggtg

SEQ ID NO: 30901 - DNA, 601 bp, Human
aggtgtgagcccatcatgcccagccctttcacggcattttgttttaaggggactggaggaacagactatacccagaagtggttatgaggtcaagacaggctttttttgtttgtttgtttgtttgtttttaatgggagaaataacgaaggagaaggatctaggaaagaagaaaaaaaggatgatgcaggagagaggggacttgctagaggggtgcctctgagtggagaggatgcagggcagaagggagggacagccactgggggaatgggcaagccattgtcactggctagcaggcatgtgrgcagctgagcataaggatggggaggaggtgttggggggcacagaggaagacaccggtagtcacctagcagggcaggcaaggcatgattgagggagctgtagtggcgtcacaggcagcctgagggcccgcctgaggccacggtcacacatgattgagaactttttctccagcatgctcaggtgtgcaggtgcagacactgagtgggtggggagcggggaaggcccctctggagaggtggcgtctgaactgagaggagagtggaaagtctggaggaagcagattccaagaaggaacagcagc

SEQ ID NO: 30902 - DNA, 601 bp, Human
ccagccctttcacggcattttgttttaaggggactggaggaacagactatacccagaagtggttatgaggtcaagacaggctttttttgtttgtttgtttgtttgtttttaatgggagaaataacgaaggagaaggatctaggaaagaagaaaaaaaggatgatgcaggagagaggggacttgctagaggggtgcctctgagtggagaggatgcagggcagaagggagggacagccactgggggaatgggcaagccattgtcactggctagcaggcatgtgggcagctgagcataaggatrgggaggaggtgttggggggcacagaggaagacaccggtagtcacctagcagggcaggcaaggcatgattgagggagctgtagtggcgtcacaggcagcctgagggcccgcctgaggccacggtcacacatgattgagaactttttctccagcatgctcaggtgtgcaggtgcagacactgagtgggtggggagcggggaaggcccctctggagaggtggcgtctgaactgagaggagagtggaaagtctggaggaagcagattccaagaaggaacagcagctacaaataacccgaggtag

SEQ ID NO: 30903 - DNA, 601 bp, Human
aagggagggacagccactgggggaatgggcaagccattgtcactggctagcaggcatgtgggcagctgagcataaggatggggaggaggtgttggggggcacagaggaagacaccggtagtcacctagcagggcaggcaaggcatgattgagggagctgtagtggcgtcacaggcagcctgagggcccgcctgaggccacggtcacacatgattgagaactttttctccagcatgctcaggtgtgcaggtgcagacactgagtgggtggggagcggggaaggcccctctggagaggtggcrtctgaactgagaggagagtggaaagtctggaggaagcagattccaagaaggaacagcagctacaaataacccgaggtaggggcagcttcatgtccagaggcagagaaagaagttcctgtgtcttgatcctaatgagtgacagggagcagcctgagatggcatctgagaggcgggctggagccggaccacagagagccttccagggcattgtggagactgtggattttttgtcaagtgtgatgggaagtctttggaaggtgttaagccaagagagacttaatccaatttggggtttgtttg

SEQ ID NO: 30904 - DNA, 601 bp, Human
tagtgtggtaaaaggggaacagtttagacagatctgggcccagtccagcatctccagaggttgtgctacagctggtttccaacctggcactcagagtatgaacagttaaaaacatgggtttggccgggcgcggtggctcatgcctgtaatcccagcactttgggaggccggggcgggcagatcatgaggtcaggagatcgagaccatcctggccaacatggtgaaaccccgtctctactaaaaatacaaaaaaattagttgggcgttgtgatgggcgcctgtagtcccagctactcgggargctgaggcaggagaatggcatgaacacaggaggcagagcttgcagtgagctgagattgcgccactgcactccaggctgggcaacaaagcaagactccgcctcaaaaagaaaaaaaaaaaagcatgggtttgtgaccaggtgcggtggctcacgcctgtaatcccagcactttgggaggctgaggcgggtggatcacgaggtcaggagatcgagaccaacatggctaacgtggtgaaaccccatctctactaaaaatacaaaaaaattagctgggtgtggtggcgggcacctgtaaatccc

SEQ ID NO: 30905 - DNA, 601 bp, Human
tcagagtatgaacagttaaaaacatgggtttggccgggcgcggtggctcatgcctgtaatcccagcactttgggaggccggggcgggcagatcatgaggtcaggagatcgagaccatcctggccaacatggtgaaaccccgtctctactaaaaatacaaaaaaattagttgggcgttgtgatgggcgcctgtagtcccagctactcgggaagctgaggcaggagaatggcatgaacacaggaggcagagcttgcagtgagctgagattgcgccactgcactccaggctgggcaacaaagcragactccgcctcaaaaagaaaaaaaaaaaagcatgggtttgtgaccaggtgcggtggctcacgcctgtaatcccagcactttgggaggctgaggcgggtggatcacgaggtcaggagatcgagaccaacatggctaacgtggtgaaaccccatctctactaaaaatacaaaaaaattagctgggtgtggtggcgggcacctgtaaatcccagctactcgggaggctgacaccagagaatcgtttgaacccaggaggcagaggttgcagtgagctgagatcacgccactgcactccagcct

SEQ ID NO: 30906 - DNA, 601 bp, Human
ctcctttttcctttttgttgagacaaggtcttgctctgtcactcaggctggagtgcagtggtgcaatcacagctcactgcagcctcaacctgccagactcaagtgatcttcccacctcagccccccaagtagctgggactgcaggcacatgccaccacacccagctaatttttatattttttatagaaatggggtttcaccatgttgctcaggctgctctcaaacccctaggctcaagtgatctgcctccctcagcctcccaaagtgctgggattacaggtgtgagccattgcgcctggcsacttcctttttcctatcagtaaagtggggataaatagaatctacctccaaggaaagagcttaggagagagtctggtgtgcagtcagcatcctgcagagtttcctgtaatgatcatcccagttctcctgcttcctgcctgtgggacccaggcaagtctttttccctttttgagccacagtgccatctgcaaaatgcggacgagagcacctgccctaatcatttattcacctctgccagcctctgggtgtgcatggggatcaaaaggtctccattcccagcctgaccaacatggtgaaaccc

SEQ ID NO: 30907 - DNA, 601 bp, Human
tttcctgtaatgatcatcccagttctcctgcttcctgcctgtgggacccaggcaagtctttttccctttttgagccacagtgccatctgcaaaatgcggacgagagcacctgccctaatcatttattcacctctgccagcctctgggtgtgcatggggatcaaaaggtctccattcccagcctgaccaacatggtgaaaccccatctctactaaaaatacaaaaaattagccgggtgtggtggtgtgcgtctataatcccagttacttgggaggctgaggcaggagaattgcttaaacccrggaggtggaggttacagtgaaccaagatcacaccactgcactccagcctgggcgacagagtgaaactccaactcgaaaaaaaataaaaggtccccatcccctgggggattaccttctagggcaggagtcaggagtgaaaacaaagagacacatcagcaaccatcctggtgatttatgatgcgagggaaaccaaatagggaagtagaggtgcacgtgagaggcagctgaagagtgtgagattctgagcaaatgagggcaggtttgtaaagccctcggtaccggggagcagtcagacaacac

SEQ ID NO: 30908 - DNA, 601 bp, Human
atcacaccactgcactccagcctgggcgacagagtgaaactccaactcgaaaaaaaataaaaggtccccatcccctgggggattaccttctagggcaggagtcaggagtgaaaacaaagagacacatcagcaaccatcctggtgatttatgatgcgagggaaaccaaatagggaagtagaggtgcacgtgagaggcagctgaagagtgtgagattctgagcaaatgagggcaggtttgtaaagccctcggtaccggggagcagtcagacaacacaaggcggcggttattagagtagatccrggaggttgagttcagcccaatggggactccgtccaagtgtggcgttggaaggcccagtttccaagggaattcttttttctttttttttttttgaggcagagtctcgctctgtcatccaggctggagtgcaatggtgtgatctcagctcactacaacctctgcctcccaggttcaagcaattttcctgcctcctcttccctagtagctgggattacaggcacgcgccacacgcccggctaatttttttttttgagacagagtctcgctctattgccaggctggagtgcagtggcgtgatct

SEQ ID NO: 30909 - DNA, 601 bp, Human
caggttcaagcaattttcctgcctcctcttccctagtagctgggattacaggcacgcgccacacgcccggctaatttttttttttgagacagagtctcgctctattgccaggctggagtgcagtggcgtgatctcagctcactgcaacctctgcctcctgggttcaagcaatcctcctgcctcagcctccagagtagctgggactacaggtgcgtgccaccacactcggctaatttttgtatttttagtagagatggggtttcactgtattggccaggctgttctcgaactcctgacctcrtgatctgccggcctcggcctcccagagtgctgggattacaggtgtgagccaccgctccctgccttagtttttgtatttttagtggagacagggtttcaccatgttggccaggctggtctcgaactcctgacctcgtgatccacctgcctcagcctcctaaagtgctgggattacaggcgtgagccactgtgcccatccaagggaattcttttttttttttttttaatggagtctcactctgttgcccagactggagtgcagtggtacgatcttggttcactgcaacctctgccatccagg

SEQ ID NO: 30910 - DNA, 601 bp, Human
ccttagtttttgtatttttagtggagacagggtttcaccatgttggccaggctggtctcgaactcctgacctcgtgatccacctgcctcagcctcctaaagtgctgggattacaggcgtgagccactgtgcccatccaagggaattcttttttttttttttttaatggagtctcactctgttgcccagactggagtgcagtggtacgatcttggttcactgcaacctctgccatccaggttcaagtgattctcctacctcagcctctcaagtagctgggattacaggcacctgcccccacrcctgtctaatttttgtagttttggtaggaacagggtttcaccatcttggccaggctggtcttgaactcctgaccttgtgatctacccacctcagcctcccaaagtgctgggattacaggcgtgagccaccgtgtcaggccccaagggaattctttaagcaaacaagtggggagagctcttcagaaggaggcataggtgagacctggagggtgggtgagcaaatatcccagactccactagttccctaccaccacatgcccttaagttctcttgcagcctgaggactcttcctgcccaggc

SEQ ID NO: 30911 - DNA, 601 bp, Human
ggagacagggtttcaccatgttggccaggctggtctcgaactcctgacctcgtgatccacctgcctcagcctcctaaagtgctgggattacaggcgtgagccactgtgcccatccaagggaattcttttttttttttttttaatggagtctcactctgttgcccagactggagtgcagtggtacgatcttggttcactgcaacctctgccatccaggttcaagtgattctcctacctcagcctctcaagtagctgggattacaggcacctgcccccacacctgtctaatttttgtagtttyggtaggaacagggtttcaccatcttggccaggctggtcttgaactcctgaccttgtgatctacccacctcagcctcccaaagtgctgggattacaggcgtgagccaccgtgtcaggccccaagggaattctttaagcaaacaagtggggagagctcttcagaaggaggcataggtgagacctggagggtgggtgagcaaatatcccagactccactagttccctaccaccacatgcccttaagttctcttgcagcctgaggactcttcctgcccaggccagaggaggttgtgtttcttcc

SEQ ID NO: 30912 - DNA, 601 bp, Human
agcctcctaaagtgctgggattacaggcgtgagccactgtgcccatccaagggaattcttttttttttttttttaatggagtctcactctgttgcccagactggagtgcagtggtacgatcttggttcactgcaacctctgccatccaggttcaagtgattctcctacctcagcctctcaagtagctgggattacaggcacctgcccccacacctgtctaatttttgtagttttggtaggaacagggtttcaccatcttggccaggctggtcttgaactcctgaccttgtgatctacccayctcagcctcccaaagtgctgggattacaggcgtgagccaccgtgtcaggccccaagggaattctttaagcaaacaagtggggagagctcttcagaaggaggcataggtgagacctggagggtgggtgagcaaatatcccagactccactagttccctaccaccacatgcccttaagttctcttgcagcctgaggactcttcctgcccaggccagaggaggttgtgtttcttcccctcctttcattcttcaagtatctgttgagtgtctactgggtgtcagccacaattcctagtacagca

SEQ ID NO: 30913 - DNA, 601 bp, Human
ctgggaagcaacggtcccctgagatcatgtatgtaaccagcgtctaagacccagggttcatctgtgtgaccagtgtctgagtcctgggatcactgagtgaacactgtctcagcccagcccaggagggggacctctagctccttcaccaggggcttgggtgaagagtagcccaggaagcccgggctgtccaggctctgcaagctgggactctgccaggagctgggactttggaggctggcctctgaagatgccctgagaaactctttttttttttttttttttttgaggcggagtttcactyttgttgcccaggctggagtgcagtggcaccatctcggctcactgcaacctctgcctcccaagttcaagggattctcctgcctctgccccccaagttcaagcgattctcctgcctctgccccccaagtagctgagattacaggcatgcgccaccactcccggctaattttgtcttttagtagagatggggtttctctatgttggtcaggctggtctccaacttccgacctcaggtgatctgcccacctcagcctcccaaagtgctgggattacaggcgtgagccaccgtgcccagccagag

SEQ ID NO: 30914 - DNA, 601 bp, Human
cttgggtaccagggtactcggggcccaggaacctgggtctgagccctgctcaggtttgtcccagccggctcagcgcagctggctgtgtgttgctgctcctacagctcaatgcactggaccttctcgtccagcctggatgcctctatcatttctctttgtctttctctggcctccataccgttctgaagagctcaccttcctctaggttcctcctgccctgctcttcccaagtgacccagccctcacctgtagggcagccaaggctggtggtgcagctgcccccagtgaaggtcattgggcmtcgcactgggcagtgcagaggtccaggctgaggagttgagtggcgcgcccatcctggcgcctgtgcagagaacgggaggggggcccctggcttggatcctagaatcggtgaagtctgagggcccccctgcagtctcagcaggacctgctctatcaaggggcttcctccttcctttccccaccctgtctccttggcggggaggattagtgccaggtgggggaagccagacatttgactgacgggagaggaaggcttgccaggcagcccgaagactgttgtgaaaatggggctgcttttgca

SEQ ID NO: 30915 - DNA, 601 bp, Human
gctggtggtgcagctgcccccagtgaaggtcattgggcctcgcactgggcagtgcagaggtccaggctgaggagttgagtggcgcgcccatcctggcgcctgtgcagagaacgggaggggggcccctggcttggatcctagaatcggtgaagtctgagggcccccctgcagtctcagcaggacctgctctatcaaggggcttcctccttcctttccccaccctgtctccttggcggggaggattagtgccaggtgggggaagccagacatttgactgacgggagaggaaggcttgccaggyagcccgaagactgttgtgaaaatggggctgcttttgcaagggaagctcttttactccccattcctgtcctccagaggccccccttttccctgccgtgttattggtgtcaaccctggggtaagtggctggctggactcacccctgctccccgtacacctgtgcctgtgactggcggtccaagctccccacacacacatcttgctggtgcctttccctgaagtcaccacccaggggctggctgtcatcagcccattcttgtcccagcagggtaccgagggaatgataaaacagaatgtgttt

SEQ ID NO: 30916 - DNA, 601 bp, Human
aaggtgtggccccacccccgacagctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcgggtgagccccacccagcaggtaccccctgcacagagtctrcagagggctgtcccggccataggaggcggctgccacccttcttcccatgtttcagatgaggaaatgaggtgcaggcgggtgaagggatggactcagggtcacatggctggcagcaggaaggatgggaccaggacagggcctgggaccccaaaataacccatgctgcccacaggcaggggagcgtggatgggattctagttccttctagtctaagggacccatggatggcactgggcatgtgccagcccccatgggttggcccgtgtttcagtggcctcttctgtgccacctccctggggc

SEQ ID NO: 30917 - DNA, 601 bp, Human
gccctggacgtgtacttcccgcagatcagcagcgtcaaggaccgcaagaaagccgtcctgtccgacatcggtgtctcgggtgagccccacccagcaggtaccccctgcacagagtctacagagggctgtcccggccataggaggcggctgccacccttcttcccatgtttcagatgaggaaatgaggtgcaggcgggtgaagggatggactcagggtcacatggctggcagcaggaaggatgggaccaggacagggcctgggaccccaaaataacccatgctgcccacaggcaggggagcrtggatgggattctagttccttctagtctaagggacccatggatggcactgggcatgtgccagcccccatgggttggcccgtgtttcagtggcctcttctgtgccacctccctggggcagcctcatgaggactaagcaaggcggtgactgggtgcccagtgcacagcaggggccctggagcctcagcctccccacgcctcccagccagaccttggcaggaccagggcctggacctgtggagccaacctgacctgctgccctttgcccttcagaagcagcctttggcagaggcaccctgacc

SEQ ID NO: 30918 - DNA, 601 bp, Human
cctgagcaggtctgggcttctctggggagaccttggcactcacaggagattgcgtggctatgaggctcccactgctgacgcccccaggctcggctctcagtgggcccctcgctaaacctggggctctgtggggtcgcagcacgttagaagtcgaagcccagacccacccagccaagctgccatccttgccccagcctcgtcctccttcccatacctcatttgtctggcagcctgagggttggggtcttcctgcctgcagagttgcaggcatcaggggtggaccgggggggcccacgtcagyggtgtggctggacatgggggtttggcagaggctgcagaaatgcggcctgagttgattaccttctttctctgtctctccctccatcctcccctctcactgcccgtggctctcctctgactggccctgaccctgccctgtctgtggcctcctcccccctgcatctggctggcttccctcttctcgcctgcatcttctcttggctcccctctctcttcccctaccccctttgcctgtccctttgggggtgggggagcatgggagatgcactcttgaatgtccctctgttcctcggcttcccca

SEQ ID NO: 30919 - DNA, 601 bp, Human
ctcctttttctccatcttcacctgggtgagtacagccaccgcgcaccagcccacactcgtcccctttccccactgagcccctggatgggtggcctttcgctagcctgggacccgctctgcctctgggagcccacactaccctcgctccctcttctgcctgcctgtctgcggcgctcacagtggtgctgcctccctcagcaaggaggctacagccctcgggggtagcatggtcactggagatggcagaccctcactgtggtgcagagcagccttcctgggggtcacggaccaccccccccccaaaccactctgggtaaatggtgtttattatcccctttcacagatgagaaagcagaggcctagacaggaaggtgaggcttacagggtttgaggctgggaagcagccctgcctaggagtcaggagacctgcttccgatcggggctgcctctgattttcctagcctctgtcttcccatccataaaatgagagggtaggatctgggggacacaggtgtcgacatcagatgcacatgggccaggcagggcctgagagccgtgagcaggccgggtgacacatgcgtgcctatcctaagtcctaaga

SEQ ID NO: 30920 - DNA, 601 bp, Human
agtggggccaggggaccaccaggtccctgggctctcagtagaactcccatcctccctctgcagcccaggccagcgggggcccaggcctctcctttgctcctgtcttgtggccccttaaactggttgcccaaatgaagctttgacttagtgagggcagagagctgaacacagagacagtatgagtgcctacagccagaggcatctccctagaaggatcagtaggggtcatctgctccagccctctgcctctgtacaggaaaccagcctggatagtagagccagggagctcggggagaaccgmgtctacagacattgctctcaaggttcattcagtcagttcctgtgggctggccagggctcaagtgtaccctcagggggctcttcacctcccctgcttcttcaggctccggcgtctgagcccccagcagccaggacctcatgctaacatagtgggaaaccccagagggctacaccttatcccttagcccaatttctttagacctagtctgcctttcccaaggtgctggcactttgctttaaatacccacctcccagaaagtgcttcccctcagaactttggtcaatgagtacaatcaaaagg

SEQ ID NO: 30921 - DNA, 601 bp, Human
ggccccttaaactggttgcccaaatgaagctttgacttagtgagggcagagagctgaacacagagacagtatgagtgcctacagccagaggcatctccctagaaggatcagtaggggtcatctgctccagccctctgcctctgtacaggaaaccagcctggatagtagagccagggagctcggggagaaccgcgtctacagacattgctctcaaggttcattcagtcagttcctgtgggctggccagggctcaagtgtaccctcagggggctcttcacctcccctgcttcttcaggctccrgcgtctgagcccccagcagccaggacctcatgctaacatagtgggaaaccccagagggctacaccttatcccttagcccaatttctttagacctagtctgcctttcccaaggtgctggcactttgctttaaatacccacctcccagaaagtgcttcccctcagaactttggtcaatgagtacaatcaaaaggtaatgccctagctgggcatggtggctcatgcctgtgatcccagcactttgggaggccaaggcaggcggatcacctgaggtcaggagtttgagaccagcctggccaaca

SEQ ID NO: 30922 - DNA, 601 bp, Human
gccccttaaactggttgcccaaatgaagctttgacttagtgagggcagagagctgaacacagagacagtatgagtgcctacagccagaggcatctccctagaaggatcagtaggggtcatctgctccagccctctgcctctgtacaggaaaccagcctggatagtagagccagggagctcggggagaaccgcgtctacagacattgctctcaaggttcattcagtcagttcctgtgggctggccagggctcaagtgtaccctcagggggctcttcacctcccctgcttcttcaggctccgrcgtctgagcccccagcagccaggacctcatgctaacatagtgggaaaccccagagggctacaccttatcccttagcccaatttctttagacctagtctgcctttcccaaggtgctggcactttgctttaaatacccacctcccagaaagtgcttcccctcagaactttggtcaatgagtacaatcaaaaggtaatgccctagctgggcatggtggctcatgcctgtgatcccagcactttgggaggccaaggcaggcggatcacctgaggtcaggagtttgagaccagcctggccaacat

SEQ ID NO: 30923 - DNA, 601 bp, Human
tccctagaaggatcagtaggggtcatctgctccagccctctgcctctgtacaggaaaccagcctggatagtagagccagggagctcggggagaaccgcgtctacagacattgctctcaaggttcattcagtcagttcctgtgggctggccagggctcaagtgtaccctcagggggctcttcacctcccctgcttcttcaggctccggcgtctgagcccccagcagccaggacctcatgctaacatagtgggaaaccccagagggctacaccttatcccttagcccaatttctttagacctrgtctgcctttcccaaggtgctggcactttgctttaaatacccacctcccagaaagtgcttcccctcagaactttggtcaatgagtacaatcaaaaggtaatgccctagctgggcatggtggctcatgcctgtgatcccagcactttgggaggccaaggcaggcggatcacctgaggtcaggagtttgagaccagcctggccaacatggcaaaaccccgtctctactaaaaatacaaaaattagcttggtgtggtggcgggtacctgtaatcccagctacttgggaggctgaggcaggaga

SEQ ID NO: 30924 - DNA, 601 bp, Human
ggggtcatctgctccagccctctgcctctgtacaggaaaccagcctggatagtagagccagggagctcggggagaaccgcgtctacagacattgctctcaaggttcattcagtcagttcctgtgggctggccagggctcaagtgtaccctcagggggctcttcacctcccctgcttcttcaggctccggcgtctgagcccccagcagccaggacctcatgctaacatagtgggaaaccccagagggctacaccttatcccttagcccaatttctttagacctagtctgcctttcccaaggygctggcactttgctttaaatacccacctcccagaaagtgcttcccctcagaactttggtcaatgagtacaatcaaaaggtaatgccctagctgggcatggtggctcatgcctgtgatcccagcactttgggaggccaaggcaggcggatcacctgaggtcaggagtttgagaccagcctggccaacatggcaaaaccccgtctctactaaaaatacaaaaattagcttggtgtggtggcgggtacctgtaatcccagctacttgggaggctgaggcaggagaatcacttgaacccaggag

SEQ ID NO: 30925 - DNA, 601 bp, Human
agggctcaagtgtaccctcagggggctcttcacctcccctgcttcttcaggctccggcgtctgagcccccagcagccaggacctcatgctaacatagtgggaaaccccagagggctacaccttatcccttagcccaatttctttagacctagtctgcctttcccaaggtgctggcactttgctttaaatacccacctcccagaaagtgcttcccctcagaactttggtcaatgagtacaatcaaaaggtaatgccctagctgggcatggtggctcatgcctgtgatcccagcactttgggwggccaaggcaggcggatcacctgaggtcaggagtttgagaccagcctggccaacatggcaaaaccccgtctctactaaaaatacaaaaattagcttggtgtggtggcgggtacctgtaatcccagctacttgggaggctgaggcaggagaatcacttgaacccaggaggcagatgttgcagtgagccaaggttgtgtcattgcaccccatcctgggtgacagagcgagactctgtctcaaaaaaaaaaagaaaaaaaaaaaggaaatgcccagtcactgggtttctggaactttgtggaa

SEQ ID NO: 30926 - DNA, 601 bp, Human
ttaaatacccacctcccagaaagtgcttcccctcagaactttggtcaatgagtacaatcaaaaggtaatgccctagctgggcatggtggctcatgcctgtgatcccagcactttgggaggccaaggcaggcggatcacctgaggtcaggagtttgagaccagcctggccaacatggcaaaaccccgtctctactaaaaatacaaaaattagcttggtgtggtggcgggtacctgtaatcccagctacttgggaggctgaggcaggagaatcacttgaacccaggaggcagatgttgcagtragccaaggttgtgtcattgcaccccatcctgggtgacagagcgagactctgtctcaaaaaaaaaaagaaaaaaaaaaaggaaatgcccagtcactgggtttctggaactttgtggaataaaacgctaggtatattcactctctacctcttcactaagtggctctttaggttgttggttgacttagtgcctcgtcaggggccagtgaaagggaaggaggtgagggcgccctgacctgggaaggggtaggaccccatgtttagggaagggttctagcagtaactctgccacgggcacttcct

SEQ ID NO: 30927 - DNA, 601 bp, Human
aatgccctagctgggcatggtggctcatgcctgtgatcccagcactttgggaggccaaggcaggcggatcacctgaggtcaggagtttgagaccagcctggccaacatggcaaaaccccgtctctactaaaaatacaaaaattagcttggtgtggtggcgggtacctgtaatcccagctacttgggaggctgaggcaggagaatcacttgaacccaggaggcagatgttgcagtgagccaaggttgtgtcattgcaccccatcctgggtgacagagcgagactctgtctcaaaaaaaaaaagaaaaaaaaaaaggaaatgcccagtcactgggtttctggaactttgtggaataaaacgctaggtatattcactctctacctcttcactaagtggctctttaggttgttggttgacttagtgcctcgtcaggggccagtgaaagggaaggaggtgagggcgccctgacctgggaaggggtaggaccccatgtttagggaagggttctagcagtaactctgccacgggcacttccttttctaggcctcaatcttcccagccctaaaacaggggtctggagagtatcagcacattcccatcac

SEQ ID NO: 30928 - DNA, 601 bp, Human
gggcatggtggctcatgcctgtgatcccagcactttgggaggccaaggcaggcggatcacctgaggtcaggagtttgagaccagcctggccaacatggcaaaaccccgtctctactaaaaatacaaaaattagcttggtgtggtggcgggtacctgtaatcccagctacttgggaggctgaggcaggagaatcacttgaacccaggaggcagatgttgcagtgagccaaggttgtgtcattgcaccccatcctgggtgacagagcgagactctgtctcaaaaaaaaaaagaaaaaaaaaaaggaaatgcccagtcactgggtttctggaactttgtggaataaaacgctaggtatattcactctctacctcttcactaagtggctctttaggttgttggttgacttagtgcctcgtcaggggccagtgaaagggaaggaggtgagggcgccctgacctgggaaggggtaggaccccatgtttagggaagggttctagcagtaactctgccacgggcacttccttttctaggcctcaatcttcccagccctaaaacaggggtctggagagtatcagcacattcccatcacaggcagattccc

SEQ ID NO: 30929 - DNA, 601 bp, Human
aaaattagcttggtgtggtggcgggtacctgtaatcccagctacttgggaggctgaggcaggagaatcacttgaacccaggaggcagatgttgcagtgagccaaggttgtgtcattgcaccccatcctgggtgacagagcgagactctgtctcaaaaaaaaaaagaaaaaaaaaaaggaaatgcccagtcactgggtttctggaactttgtggaataaaacgctaggtatattcactctctacctcttcactaagtggctctttaggttgttggttgacttagtgcctcgtcaggggccartgaaagggaaggaggtgagggcgccctgacctgggaaggggtaggaccccatgtttagggaagggttctagcagtaactctgccacgggcacttccttttctaggcctcaatcttcccagccctaaaacaggggtctggagagtatcagcacattcccatcacaggcagattccccgggccgggaaagtttctggagaaggcttttgcaataaacctctaagctgcttttctaatgacaagtttgatttacttaaactttgacttagctcagtgtggtcagtgtcattgtccttaataac

SEQ ID NO: 30930 - DNA, 601 bp, Human
tttctaggcctcaatcttcccagccctaaaacaggggtctggagagtatcagcacattcccatcacaggcagattccccgggccgggaaagtttctggagaaggcttttgcaataaacctctaagctgcttttctaatgacaagtttgatttacttaaactttgacttagctcagtgtggtcagtgtcattgtccttaataacaatgtaattgcttttattgaaaaataatttcctaaccatgcatgtgtgctgtagacaagtctttcccaatctgagatctgtgaaaaaaaaaaaaaaaacggggcggcttcaggctaggcgcggtcacattgaatagtcagggctctgccaagtcagatgatcctgaaacttgtttcactctatttaactcagtttctcacttagaattaggttcagcagcaggtgaccgaaatcccagataacagtgatttcaacaaagtccaaggctgtggaagtggtccagggctggcatactggctccagaggtcttcggtgacccaggcatctttccttttttttagagacagggtctcactctgttgcccaggctggatcatagctcactgcagcctcaaacc

SEQ ID NO: 30931 - DNA, 601 bp, Human
tgatttacttaaactttgacttagctcagtgtggtcagtgtcattgtccttaataacaatgtaattgcttttattgaaaaataatttcctaaccatgcatgtgtgctgtagacaagtctttcccaatctgagatctgtgaaaaaaaaaaaaaaaacggggcggcttcaggctaggcgcggtcacattgaatagtcagggctctgccaagtcagatgatcctgaaacttgtttcactctatttaactcagtttctcacttagaattaggttcagcagcaggtgaccgaaatcccagataacrgtgatttcaacaaagtccaaggctgtggaagtggtccagggctggcatactggctccagaggtcttcggtgacccaggcatctttccttttttttagagacagggtctcactctgttgcccaggctggatcatagctcactgcagcctcaaacccataggctcaggcaatcctcccacctcagcctcctgagtagctgggactacaggccagtaccactatgcccggctaatttggtttttgtggatttttttggtagagatggggtcttgctatgttgcccaagctggccttttttttt

SEQ ID NO: 30932 - DNA, 601 bp, Human
gcctctcaaagtgctgggattgcaagcatgagttgtcgcgcctggcctctcctgctttcaagaagaagatcagattgttattgtgcctgctgtttttcaagtgcctttaactcaacatagtcaatatgccagaggtgcatattttagcccaggctggtcttgatctcctggcctcaagcaatccttccaccttggcctatcaaagttgtgggattacaggcatgagccgcggtgcatggcccccaggcatctttcattcctacagacttggctcatggtctttgtggtcccttttggcaaytagagctccagccatcacatctgtgttccaggcatcaggtcagagggtgggacagagaacatgagggtaccccattggccaaaacgtagtcacatggccatgcctagctgcaagagagacaaaagaatgactcttaggagatgctaacagtcctttgtcccgctgagaagctttttttaagaaggctgttgtgagcctttgagccatcttaacactccataatggagatctagaacttttggtagcccagactgacctctgggattgggagacaggggcaggtgatttctggggtacttt

SEQ ID NO: 30933 - DNA, 601 bp, Human
tgttattgtgcctgctgtttttcaagtgcctttaactcaacatagtcaatatgccagaggtgcatattttagcccaggctggtcttgatctcctggcctcaagcaatccttccaccttggcctatcaaagttgtgggattacaggcatgagccgcggtgcatggcccccaggcatctttcattcctacagacttggctcatggtctttgtggtcccttttggcaattagagctccagccatcacatctgtgttccaggcatcaggtcagagggtgggacagagaacatgagggtaccccaytggccaaaacgtagtcacatggccatgcctagctgcaagagagacaaaagaatgactcttaggagatgctaacagtcctttgtcccgctgagaagctttttttaagaaggctgttgtgagcctttgagccatcttaacactccataatggagatctagaacttttggtagcccagactgacctctgggattgggagacaggggcaggtgatttctggggtactttctggctggatgatatggttctgggcatttccgggggtggctgcgagaacagccttccttctccacagccaagctt

SEQ ID NO: 30934 - DNA, 601 bp, Human
agggtgggacagagaacatgagggtaccccattggccaaaacgtagtcacatggccatgcctagctgcaagagagacaaaagaatgactcttaggagatgctaacagtcctttgtcccgctgagaagctttttttaagaaggctgttgtgagcctttgagccatcttaacactccataatggagatctagaacttttggtagcccagactgacctctgggattgggagacaggggcaggtgatttctggggtactttctggctggatgatatggttctgggcatttccgggggtggctgcragaacagccttccttctccacagccaagcttggtctcatgtttggtgctttgaggatctttaaccctctcctgcctgtgtcctgtgaactaaccaccactaacccagtgctcttgtctgtctctcccctaaccaccccctcccgcctgtccttgtcctcgccggcctttgtccccaggcgggccaggctgtgctggccttccagcggtaccagattggcgccgactcggccctcttctcccaggactacatggaccccagccaggactccagcatgccttacgcgccctacgtggagccc

SEQ ID NO: 30935 - DNA, 601 bp, Human
agaacagccttccttctccacagccaagcttggtctcatgtttggtgctttgaggatctttaaccctctcctgcctgtgtcctgtgaactaaccaccactaacccagtgctcttgtctgtctctcccctaaccaccccctcccgcctgtccttgtcctcgccggcctttgtccccaggcgggccaggctgtgctggccttccagcggtaccagattggcgccgactcggccctcttctcccaggactacatggaccccagccaggactccagcatgccttacgcgccctacgtggagcccactgggccggatcccgccggtatgggcggcacctaccagcagccggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttggggactgtctacgtatgtgcaagtatatcccagggcatgtgcc

SEQ ID NO: 30936 - DNA, 601 bp, Human
cggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttggggactgtctacgtatgtgcaagtatatcccagggcatgtgccccgcaggggcctagagggtgggggccaggggtatttgcattcrtacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagatccagataatgctgggaagtgtggctacaccgtggcttggtcatagggtgagtgtaaacacccacaggacactgggggctgtcaccctgctctggcagtcctgctaagagtgtcagggccgtctccattttatggttgagg

SEQ ID NO: 30937 - DNA, 601 bp, Human
ttgtcccactgaggtccagggtagctcggggcaggggtggggcagtccagtgttggggactgtctacgtatgtgcaagtatatcccagggcatgtgccccgcaggggcctagagggtgggggccaggggtatttgcattcatacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagayccagataatgctgggaagtgtggctacaccgtggcttggtcatagggtgagtgtaaacacccacaggacactgggggctgtcaccctgctctggcagtcctgctaagagtgtcagggccgtctccattttatggttgaggaaactgaggtctagagaggtcaagattacttgcccagaatcactcaggcagctagtgatagaggtggggccaagcccaggctgcccgactgcagaccacgtgctcttccctggccacccacctcctaccatccccacgcttggggcttccctgctcagtg

SEQ ID NO: 30938 - DNA, 601 bp, Human
tgtgccccgcaggggcctagagggtgggggccaggggtatttgcattcatacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagatccagataatgctgggaagtgtggctacaccgtggcttggtcatagggtgagtgtaaacacccacaggacactgggggctgtcaccctgctcyggcagtcctgctaagagtgtcagggccgtctccattttatggttgaggaaactgaggtctagagaggtcaagattacttgcccagaatcactcaggcagctagtgatagaggtggggccaagcccaggctgcccgactgcagaccacgtgctcttccctggccacccacctcctaccatccccacgcttggggcttccctgctcagtgttactgtcattctgggaggccttggggccctcagccccttgagacaccctgattctgctgcatgccaagggcctgttctgccccagctgttc

SEQ ID NO: 30939 - DNA, 601 bp, Human
gagtgagtggcaaagctggccctgacgcctgggtttcttggccccagctgcccagcaggtgcctcgattccctgcccttgtgacctcccaggaaacagaactgatctgggacactatgtcacctctcctctcatctggggtcagtcagggttcgggggctgcagcagccaagcgcatgagaggtgtttccttggccttccagaaggcccactgtggagccagcctccctatgggaggcagagcggcaaggacagggctttggaatcagccaggtcggctcctgggctgtggccgtggagaracactgcccccaggatgacacaggcaagagcccctgaggcatgggaggcccagggaagaccatgggctgtaggggagagtgtggcaggtgacccaaaggcccaaagagggccgtggggcctgaggaggtcataatctcttctgagtgggggcaggtcgattcttgcacaaggtgggctcttcactgagccataagggacagggaggtatgggagagcgctgggggcccatccccctgtccacccagtgtccactggcctgtccttcagggagcagagcagagcaggtggtggacgggccc

SEQ ID NO: 30940 - DNA, 601 bp, Human
ttggcccaagacccctttgattctctaaggagcacgaaagggggaatgcccctcccaggagtttatgggagaagggactgggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtgaagggcggtccccatcctgggccyccactctagacccccccaccacctggttaagtctcgagtgaatccagtggccccgtggcaccctcctttatgacatccatccatctgtggtgaaccaagtgaaggtggtgacttctggtgacatagtaataaagtgaagactcagaacccaccagcgattgcaagtgtgtcaccgtgtttctttgttcttcattctgcgtttggcttggatgctccatcccgtttgtctccttagacaggccatgtcttacttggttattattgtttgttaatttttcattacacaatgaacctatgaat

SEQ ID NO: 30941 - DNA, 601 bp, Human
tcgggtttgggctggaggtcgccatggggcgaggcagcggcaccttcgagcgtctcctaggtaacgcgtccccacccgacggctcggccttggtcagcccgcagcctccgcccggcgctgagtcagcgcggccccgagggcccgaggggcgcggaccggccgccctgcccgcctctccccggcccgctgtcctcccgggttcggagccgccgatcctggaccctcggcgcggccgtggggtcggcgtccgtcgggcgttggcaaatggggctctgcgagggtccgcgcagggcgccagggrcgctcggcgacctcgctcctccgcgggcccgggcattcggccgatttcctcttgaccgacgagcacccggccgagtgggccacaaggcctgagtcatgaaagtgggtgactcagtcggatgttaggctcgcacttgggcttctgacccaaaacactgggcctcgaagggtggagccggcagtgttctctctgggaccttcgagctctcttgggggctgcgggtcccagacccaccttttgttcccacactggcttcgggaagtgcctaatggtttaggaaggcgttttctcacgtttttg

SEQ ID NO: 30942 - DNA, 601 bp, Human
caaggagacttcaagtgagacaccttccttgccaagggaaccagcaagcagactgagtatctcagccacacaggtagttcagtgcttcagggatgaatccagaggttaactactgaatcagtatagaaagtggacgtggcttggcttgttagatcgtttctgtatccgggaaaggcgatgtgggcagagctggagctgcccccccagaggggccagttgttggagacagcagtgatgtggtatgatgacaggtatgctggcgagtcctccttggagccccgttctgcccttatttccaaarcacttggcttggagcaaggggcctggagtctacactgcaggcctctctagcccttgcccaagctaaggtcccattgaaaccgggagcatctgggcgaacggggactccaagggacgggtgatagggttctttgttgagaagcagccgagcctgatgtttaagagtgaatcagcctctgtctctggtgagctgtgtgactcacggcagtgccctcgcctctctgctgagtgtctttacctcgctcgcgggttgtgggagggcttggaccagcacctggtgtgctcttacgctgtttgctgc

SEQ ID NO: 30943 - DNA, 601 bp, Human
gagacaccttccttgccaagggaaccagcaagcagactgagtatctcagccacacaggtagttcagtgcttcagggatgaatccagaggttaactactgaatcagtatagaaagtggacgtggcttggcttgttagatcgtttctgtatccgggaaaggcgatgtgggcagagctggagctgcccccccagaggggccagttgttggagacagcagtgatgtggtatgatgacaggtatgctggcgagtcctccttggagccccgttctgcccttatttccaaagcacttggcttggagcraggggcctggagtctacactgcaggcctctctagcccttgcccaagctaaggtcccattgaaaccgggagcatctgggcgaacggggactccaagggacgggtgatagggttctttgttgagaagcagccgagcctgatgtttaagagtgaatcagcctctgtctctggtgagctgtgtgactcacggcagtgccctcgcctctctgctgagtgtctttacctcgctcgcgggttgtgggagggcttggaccagcacctggtgtgctcttacgctgtttgctgcttccctggggaggatg

SEQ ID NO: 30944 - DNA, 601 bp, Human
atcagtatagaaagtggacgtggcttggcttgttagatcgtttctgtatccgggaaaggcgatgtgggcagagctggagctgcccccccagaggggccagttgttggagacagcagtgatgtggtatgatgacaggtatgctggcgagtcctccttggagccccgttctgcccttatttccaaagcacttggcttggagcaaggggcctggagtctacactgcaggcctctctagcccttgcccaagctaaggtcccattgaaaccgggagcatctgggcgaacggggactccaagggacrggtgatagggttctttgttgagaagcagccgagcctgatgtttaagagtgaatcagcctctgtctctggtgagctgtgtgactcacggcagtgccctcgcctctctgctgagtgtctttacctcgctcgcgggttgtgggagggcttggaccagcacctggtgtgctcttacgctgtttgctgcttccctggggaggatggcacttccctgcccatcagcacgctcaggaggattctgtcatgctttttcatttggtccaaatgtctaaaggggaaggagagagtcccccccagctgctg

SEQ ID NO: 30945 - DNA, 601 bp, Human
caggcctctctagcccttgcccaagctaaggtcccattgaaaccgggagcatctgggcgaacggggactccaagggacgggtgatagggttctttgttgagaagcagccgagcctgatgtttaagagtgaatcagcctctgtctctggtgagctgtgtgactcacggcagtgccctcgcctctctgctgagtgtctttacctcgctcgcgggttgtgggagggcttggaccagcacctggtgtgctcttacgctgtttgctgcttccctggggaggatggcacttccctgcccatcagcaygctcaggaggattctgtcatgctttttcatttggtccaaatgtctaaaggggaaggagagagtcccccccagctgctgccaagctggggtgctgcacggggcgtccagcaggataacccctccctttcatggcattttctctctcagacaaggcgaccagccagctcctgttggagacagattgggagtccattttgcagatctgcgacctgatccgccaaggggacacacagtgagttagcggggcctgtgccctgatgcggaggagcagccgtgcactaagctgggctcgcttggtgc

SEQ ID NO: 30946 - DNA, 601 bp, Human
gcagatacctggttatgtttgtatttgcttcggggttctcaaagactaagatggcagacagacttttttttttaagacggggccttgctttgtcacccaggctgaagtgcagtggcgtgatctcagctcactgcagcccctgcctcccaagctcaaacgatcgtcccacctcaacctcctgagtagctgggactacaggcattcaccatcacgcccggctgattttttgtattttggtagagatgggtttttgccgtaatgcacaggctggtctcagactcctgggctcaagcaatcctcmtgccttggcctcccaaagcactgggattacaggcgtgagccactgcacctggcagcagatgagcttttctcatcttagttgctgagactatttttttcccgtttttctctgcttttatcaatgtttccttttcagagcaaaatatgctgtgaattccatcaagaagaaagtcaacgacaagaacccacacgtcgccttgtatgccctggaggtaagcagacccccgtgcctcagtggcccccagggtccctaccccctactagtcacgacagcatgagaagagtttgtcctgtggccttg

SEQ ID NO: 30947 - DNA, 601 bp, Human
gcctgtgtgaacagtgccacctaggagagggtcacgctgagggagagacaggagataggggagggagtgggcaccacttcttcagccggtcctgcgtgagtaaacaccagaaggcggatgtcattgctgtgcttggcagtgagacttggcgtcacggagcggtgctgtgcaggctgctgagtctcagatgtgggttccccactggcctgacgggcctgttgaagggctgctgtcccaccgggttccccaccggccactgacgggcctgtcgaagggctctgctgtcccaccgggttccccwccggccactgacgggcctgtcgaagggctctgctgtcccaccgggttccccaccggccactgacgggcctgtcgaagggctctgctgtcccacagggaggtgggtctgtccgggaggaggaggggccctgccctgaccactggcccaacccttcccttcctgggcatctgcaggtcatggaatctgtggtaaagaactgtggccagacagttcatgatgaggtggccaacaagcagaccatggaggagctgaaggacctgctgaaggtgggtgagacgggggcatgcgggtggccaccca

SEQ ID NO: 30948 - DNA, 601 bp, Human
actggcccaacccttcccttcctgggcatctgcaggtcatggaatctgtggtaaagaactgtggccagacagttcatgatgaggtggccaacaagcagaccatggaggagctgaaggacctgctgaaggtgggtgagacgggggcatgcgggtggccacccaggctggcacctttgcttctccgggtgtttactgggcactgatgacagaacagcaccaggtgtggcggaaaatgtgcaggtgcagatcggtggtccctgcactgcgcaagctcgcactcatgagtcggagagacagggcygtgagccccaatccagggaggtcagggtttagcaggagccggcctggggtgctgtgtctggaggaccaaggtgacagcgaccctggggcctgggggaagcttccgggaggcagggcttgggcacctgctgtcttagggaaggtgagtagatgccactgggtgggcagggcaggtggtggctatcgtgtgtgagagtggctgtggtccggagggcaggctggccacatcccacaggcaggggcctgggagggctctgagcgggggcttgtaagatcggatgtgtctggcggggataagagc

SEQ ID NO: 30949 - DNA, 601 bp, Human
gcactgcgcaagctcgcactcatgagtcggagagacagggccgtgagccccaatccagggaggtcagggtttagcaggagccggcctggggtgctgtgtctggaggaccaaggtgacagcgaccctggggcctgggggaagcttccgggaggcagggcttgggcacctgctgtcttagggaaggtgagtagatgccactgggtgggcagggcaggtggtggctatcgtgtgtgagagtggctgtggtccggagggcaggctggccacatcccacaggcaggggcctgggagggctctgagygggggcttgtaagatcggatgtgtctggcggggataagagctgttttggagagcgagggcttcatgctttcctgggcagaggaggaaaagccctccagatccccaggagattgtgccggggacatctgcagggattgtgctggggacacctgcagggactgtgatgtggactgtgatgcagtggggatgctgttgcaggtgtcaaggagaaagagtgtcccatgtagtcaggctgctccccttctgtcccgacctgtgggccagacctgggtctcataggagactccctggactcacaca

SEQ ID NO: 30950 - DNA, 601 bp, Human
aaggtgagtagatgccactgggtgggcagggcaggtggtggctatcgtgtgtgagagtggctgtggtccggagggcaggctggccacatcccacaggcaggggcctgggagggctctgagcgggggcttgtaagatcggatgtgtctggcggggataagagctgttttggagagcgagggcttcatgctttcctgggcagaggaggaaaagccctccagatccccaggagattgtgccggggacatctgcagggattgtgctggggacacctgcagggactgtgatgtggactgtgatgcrgtggggatgctgttgcaggtgtcaaggagaaagagtgtcccatgtagtcaggctgctccccttctgtcccgacctgtgggccagacctgggtctcataggagactccctggactcacacagctgagaacctgcccggggatcccggtggacagccaggcctctcaaaggccctcactggccactttggctggcttcctgtcccgtcctgtcctggctgagaggcggaaggtgccggagtctggccctgcccgaccctggtgctcctgagctccttcagtcaggctgcagatcctgagccg

SEQ ID NO: 30951 - DNA, 601 bp, Human
gtgtgtgagagtggctgtggtccggagggcaggctggccacatcccacaggcaggggcctgggagggctctgagcgggggcttgtaagatcggatgtgtctggcggggataagagctgttttggagagcgagggcttcatgctttcctgggcagaggaggaaaagccctccagatccccaggagattgtgccggggacatctgcagggattgtgctggggacacctgcagggactgtgatgtggactgtgatgcagtggggatgctgttgcaggtgtcaaggagaaagagtgtcccatgtrgtcaggctgctccccttctgtcccgacctgtgggccagacctgggtctcataggagactccctggactcacacagctgagaacctgcccggggatcccggtggacagccaggcctctcaaaggccctcactggccactttggctggcttcctgtcccgtcctgtcctggctgagaggcggaaggtgccggagtctggccctgcccgaccctggtgctcctgagctccttcagtcaggctgcagatcctgagccggttcgctcctctggggtgaggcagggctgtgaagggaaggcgccgc

SEQ ID NO: 30952 - DNA, 601 bp, Human
agggcaggctggccacatcccacaggcaggggcctgggagggctctgagcgggggcttgtaagatcggatgtgtctggcggggataagagctgttttggagagcgagggcttcatgctttcctgggcagaggaggaaaagccctccagatccccaggagattgtgccggggacatctgcagggattgtgctggggacacctgcagggactgtgatgtggactgtgatgcagtggggatgctgttgcaggtgtcaaggagaaagagtgtcccatgtagtcaggctgctccccttctgtcccracctgtgggccagacctgggtctcataggagactccctggactcacacagctgagaacctgcccggggatcccggtggacagccaggcctctcaaaggccctcactggccactttggctggcttcctgtcccgtcctgtcctggctgagaggcggaaggtgccggagtctggccctgcccgaccctggtgctcctgagctccttcagtcaggctgcagatcctgagccggttcgctcctctggggtgaggcagggctgtgaagggaaggcgccgctgaggatgcagaggggttctggaaa

SEQ ID NO: 30953 - DNA, 601 bp, Human
gctgttgcaggtgtcaaggagaaagagtgtcccatgtagtcaggctgctccccttctgtcccgacctgtgggccagacctgggtctcataggagactccctggactcacacagctgagaacctgcccggggatcccggtggacagccaggcctctcaaaggccctcactggccactttggctggcttcctgtcccgtcctgtcctggctgagaggcggaaggtgccggagtctggccctgcccgaccctggtgctcctgagctccttcagtcaggctgcagatcctgagccggttcgctcytctggggtgaggcagggctgtgaagggaaggcgccgctgaggatgcagaggggttctggaaaggagcttaggctgaggtgcaagtgccccggagcctgcttgcagcagcctctgatcgcacgccgtcctgcacgtcacaccgggacggcgtccccgagagggccgtagacgcgaggccaggctgcgctctaaccgggggagaggatggctgcagggggtctggagcccgctctgaatttggaggcatttctggagcggctgccccccgcgtctccccggctgtgactggaaggaggggcg

SEQ ID NO: 30954 - DNA, 601 bp, Human
tcctgtcccgtcctgtcctggctgagaggcggaaggtgccggagtctggccctgcccgaccctggtgctcctgagctccttcagtcaggctgcagatcctgagccggttcgctcctctggggtgaggcagggctgtgaagggaaggcgccgctgaggatgcagaggggttctggaaaggagcttaggctgaggtgcaagtgccccggagcctgcttgcagcagcctctgatcgcacgccgtcctgcacgtcacaccgggacggcgtccccgagagggccgtagacgcgaggccaggctgcrctctaaccgggggagaggatggctgcagggggtctggagcccgctctgaatttggaggcatttctggagcggctgccccccgcgtctccccggctgtgactggaaggaggggcgtggccagagccccgcagtacccctgtgttctcagccccaacaccacgctgccaccgtcaggcctgccgggtcctgcctgttggaggctgacgggaaccggggatcctggggtgggcaggtcccgtggggaaagggagagacagatggtcaggggcacagagacgcggcgttgtttggctccagcaa

SEQ ID NO: 30955 - DNA, 601 bp, Human
ggctgagaggcggaaggtgccggagtctggccctgcccgaccctggtgctcctgagctccttcagtcaggctgcagatcctgagccggttcgctcctctggggtgaggcagggctgtgaagggaaggcgccgctgaggatgcagaggggttctggaaaggagcttaggctgaggtgcaagtgccccggagcctgcttgcagcagcctctgatcgcacgccgtcctgcacgtcacaccgggacggcgtccccgagagggccgtagacgcgaggccaggctgcgctctaaccgggggagaggrtggctgcagggggtctggagcccgctctgaatttggaggcatttctggagcggctgccccccgcgtctccccggctgtgactggaaggaggggcgtggccagagccccgcagtacccctgtgttctcagccccaacaccacgctgccaccgtcaggcctgccgggtcctgcctgttggaggctgacgggaaccggggatcctggggtgggcaggtcccgtggggaaagggagagacagatggtcaggggcacagagacgcggcgttgtttggctccagcaagtagaggcaggcgtgaggt

SEQ ID NO: 30956 - DNA, 601 bp, Human
tggcgcctggagtgtcctgcgaccctcacccccttctccctgcctgcagagacaagtggaggtaaacgtccgtaacaagatcctgtacctgatccaggcctgggcgcatgccttccggaacgagcccaagtacaaggtggtccaggacacctaccagatcatgaaggtggagggtgagtcaggactgaggttgggaccaggttgaggcttggaactgctgggcagtcaggctcaacgggcacagtggcgaggggcctgggaagatgggttgttccctgtgttgggagggaggagggcggtrgcctggagccagggaagaccgtgcatgtgagggcgggttcagaccggctcctgcctttctggacccacggcccacgggcaggggcaggcagtgatggcagacaacacacaggtgaaaaggcagcagacagcctgtttcagaatggcaggactcctgggggccgggttgggctgtgcagtcagggaaggcctctgaaggagctgtcccaagtgtcgagactggaacagaagccagagccggcgtgagcaggcaggcagcacccgtgggcagacactcagggttgaggccccagggcagaaa

SEQ ID NO: 30957 - DNA, 601 bp, Human
caggacacctaccagatcatgaaggtggagggtgagtcaggactgaggttgggaccaggttgaggcttggaactgctgggcagtcaggctcaacgggcacagtggcgaggggcctgggaagatgggttgttccctgtgttgggagggaggagggcggtggcctggagccagggaagaccgtgcatgtgagggcgggttcagaccggctcctgcctttctggacccacggcccacgggcaggggcaggcagtgatggcagacaacacacaggtgaaaaggcagcagacagcctgtttcagartggcaggactcctgggggccgggttgggctgtgcagtcagggaaggcctctgaaggagctgtcccaagtgtcgagactggaacagaagccagagccggcgtgagcaggcaggcagcacccgtgggcagacactcagggttgaggccccagggcagaaaggtggccagcgtgccagaggagagtgcagccgggcctgtgcgccgagggcctccaggctgttgggctggagttcagggttgctgtcagcgcagcaggaggcctctggtgggttttcgtctaggtcgtggctgccaaggtgtg

SEQ ID NO: 30958 - DNA, 601 bp, Human
ctccttcctggggtgggagctctcctggattttttctggggtcgtgtgtcaagaatagctcaaggtcttgtcctcaggatcagtgggagccctggccagagagcagagggtgagggagccactcagcaggcggggccacgcaggggcctcatgccctgatggagtgggagcagtgtctcaggaagagggcagcagggcctggctcttgtctcccgccacagtgaggacagaggccccatggggacacccaatcttgggggcaggaggctgtctcggtgcccccagacaccttcacttgggygcacggtcactgctgcgttgcagctgccgagagtgaggaaggggctcccggaagtcttgcaggccaggtgggagcaggcagtgactatggcttcatctctccagggcacgtctttccagaattcaaagagagcgatgccatgtttgctgccgagagagtgagtgtgggcggccgccaggggttctggagtcgggctgctcaggaagcgtgaaggggagtgctgggagcccggcttgtttgagggttggtggctgagctctcgtctgtctgggacctgaggatgcctgtgtgtcctgggcg

SEQ ID NO: 30959 - DNA, 601 bp, Human
gtctgggacctgaggatgcctgtgtgtcctgggcggaggcgtagcagctgtctctgcagggcgaggtggagacgtggcttgagggcctttagagtggctagggggctcgggaaaggaaaacaagcacctttgatgaggaaggaagtcccttcctcaggcctcggcagcttcaccccaggccacgccgctgggaagggccgcccggggcattgctctcgctcgtgctggggtcctctctgggtccgttgccttctgtggggcaggggaggctctgtgcctctggggctggtggggcgggaarcgtgtggtcctgactgctgcccctcctcaggccccagactgggtggacgctgaggaatgccaccgctgcagggtgcagttcggggtgatgacccgtaaggtgagttcccacctggggggctctacagccccggccagacaccaggtcccctgccgtgcacaaggccaccgtccctgctgggcctttccttcctggtgggtggttcaggaggtgagtgcagctcgcagcgggtggcagtgtggcgtcaggagggggacagtgagggcccacgtaagggcctgatgccactgcctgggccgg

SEQ ID NO: 30960 - DNA, 601 bp, Human
cttcaccccaggccacgccgctgggaagggccgcccggggcattgctctcgctcgtgctggggtcctctctgggtccgttgccttctgtggggcaggggaggctctgtgcctctggggctggtggggcgggaagcgtgtggtcctgactgctgcccctcctcaggccccagactgggtggacgctgaggaatgccaccgctgcagggtgcagttcggggtgatgacccgtaaggtgagttcccacctggggggctctacagccccggccagacaccaggtcccctgccgtgcacaaggccrccgtccctgctgggcctttccttcctggtgggtggttcaggaggtgagtgcagctcgcagcgggtggcagtgtggcgtcaggagggggacagtgagggcccacgtaagggcctgatgccactgcctgggccgggcccagcctcactctggaattataatgttttaaacctagggctacaggccttgccacagtcactctgctgcttgccagggccgtggggcccccttctctttgtggcttagcccatctggattcttaccctcgaggcatcttcacatcaaaaccccctccaggctggc

SEQ ID NO: 30961 - DNA, 601 bp, Human
ggcctgatgccactgcctgggccgggcccagcctcactctggaattataatgttttaaacctagggctacaggccttgccacagtcactctgctgcttgccagggccgtggggcccccttctctttgtggcttagcccatctggattcttaccctcgaggcatcttcacatcaaaaccccctccaggctggcaaccggcagtgcttggggtttggggtgtcagcagcttccagcacccactgcactcacaaaagctcttgttttatcagcagaattgatgtgtattttttccttgcccttrcttttaacttaccttattttccccaaaacggtggctggcgttgagactcccgggagcatgtccaggttccccggccttagggtcttcccaggcacttgttctgcttgtcccttgccttcccccacctgtgaggcccagcttcggcatcgtacggggtggttctgggccgggtggcgcatcagggtcccccagtgcctgtgaccaggcccgcccgccccatcttacagcaccactgccgggcgtgtgggcagatattctgtggaaagtgttcttccaagtactccaccatccccaagtttg

SEQ ID NO: 30962 - DNA, 601 bp, Human
gttttaaacctagggctacaggccttgccacagtcactctgctgcttgccagggccgtggggcccccttctctttgtggcttagcccatctggattcttaccctcgaggcatcttcacatcaaaaccccctccaggctggcaaccggcagtgcttggggtttggggtgtcagcagcttccagcacccactgcactcacaaaagctcttgttttatcagcagaattgatgtgtattttttccttgcccttacttttaacttaccttattttccccaaaacggtggctggcgttgagactccygggagcatgtccaggttccccggccttagggtcttcccaggcacttgttctgcttgtcccttgccttcccccacctgtgaggcccagcttcggcatcgtacggggtggttctgggccgggtggcgcatcagggtcccccagtgcctgtgaccaggcccgcccgccccatcttacagcaccactgccgggcgtgtgggcagatattctgtggaaagtgttcttccaagtactccaccatccccaagtttggcatcgagaaggaggtgcgcgtgtgtgagccctgctacgagcagctgaaca

SEQ ID NO: 30963 - DNA, 601 bp, Human
cttcacatcaaaaccccctccaggctggcaaccggcagtgcttggggtttggggtgtcagcagcttccagcacccactgcactcacaaaagctcttgttttatcagcagaattgatgtgtattttttccttgcccttacttttaacttaccttattttccccaaaacggtggctggcgttgagactcccgggagcatgtccaggttccccggccttagggtcttcccaggcacttgttctgcttgtcccttgccttcccccacctgtgaggcccagcttcggcatcgtacggggtggttckgggccgggtggcgcatcagggtcccccagtgcctgtgaccaggcccgcccgccccatcttacagcaccactgccgggcgtgtgggcagatattctgtggaaagtgttcttccaagtactccaccatccccaagtttggcatcgagaaggaggtgcgcgtgtgtgagccctgctacgagcagctgaacaggtgagtccccgccccccatttgggctgcaggtggggcaggctctccaggctgggttttctgtccctcttggccatggtgcctgaggcctgcagaccccagaggaccctcac

SEQ ID NO: 30964 - DNA, 601 bp, Human
tgcgtgtgttcacacaggttttattttgaatttgcatgagtgcagatgtcatgccccttggcactcagatcttcgcctgtgatctctgagagggacagtgctctcatggccacagcagtcactcgggactgcgctgccacccagtgctggcttctgctctgtggtccacgttccatttctgccgtggtcccagcagcgtcgctgtgggtctggcctgggttgcgtgtgtttcgtatgtgggccgtgctccctgcttggttcccttttcctggaacgtgtcactgcctccctgtctcgctcygtggacatttctgggaggtcaggccgtggccacctggccccctgttcaggtctgaggctcccacctgcttaggttcgggaagctcaggagtgaggccatgccctcctcaggacatcccatccaagccagccatgtccggtgatgggccgctgcccggaaagttccttttccttcttgtaactgagaagaacttgccttgagccacgtcaagtcccgtccgtcgcagccactgcccacaagcgtgagtctgctgtgagccagcggctccatggcagggcatcccaacgccattcctgcctt

SEQ ID NO: 30965 - DNA, 601 bp, Human
ctccctgtctcgctctgtggacatttctgggaggtcaggccgtggccacctggccccctgttcaggtctgaggctcccacctgcttaggttcgggaagctcaggagtgaggccatgccctcctcaggacatcccatccaagccagccatgtccggtgatgggccgctgcccggaaagttccttttccttcttgtaactgagaagaacttgccttgagccacgtcaagtcccgtccgtcgcagccactgcccacaagcgtgagtctgctgtgagccagcggctccatggcagggcatcccarcgccattcctgccttcacacacacttgctgccgtttccctgtgctgggggctgtgcaggtctgcctcggtgtggacttttctcttaggaaagagccccaggtcggccgagcacggtggctcatgcctgtaatcccagcactttgggaggctgaggcgggcagatcacgaggccaagagatcaagacaatcctggccaacatggtgaaatcccgtctctactttttaagtatcttatacttaaaatttttgtattttatacaaaaattagcgggcttggtggcagatgtctgtagtcccag

SEQ ID NO: 30966 - DNA, 601 bp, Human
cgcactggggacatccctgtccctgccgaagcaactggctctgtcacctgtgagactcagatgcccttttctccccagaactcgtcggcgcctctggctgaggacatcgaccctgaggtaaggcccagcatggggtgcatcctctcacggtttctggccttgggagtgaccccctcattgcctgcagctcgcacggtatctcaaccggaactactgggagaagaagcaggaggaggctcgcaagagccccacgccatctgcgcccgtgcccctgacggagccggctgcacagcctggggargggcacgcagcccccaccaacgtggtggaggtgagggggccactcccggcattcctagtggcagggtcccttggaaggggtggatgcgggacaggttggaggccccactcattctctctcttccagaaccccctcccggagacagactctcagcccattcctccctctggtggcccctttagtgaggtaagctgtggctccctccacgggccagggcaaaacatggcctcctggcccacagcgccaggcacatggcacaggtgcctgccctaaccagagggccgtgctagagcaagggtg

SEQ ID NO: 30967 - DNA, 601 bp, Human
ctctctcttccagaaccccctcccggagacagactctcagcccattcctccctctggtggcccctttagtgaggtaagctgtggctccctccacgggccagggcaaaacatggcctcctggcccacagcgccaggcacatggcacaggtgcctgccctaaccagagggccgtgctagagcaagggtgtctgccccagcccagccctggcctgccctgccctgccctttgtggcctctcccaatggaaactctacaccaggctgtggtccagagctcgggccactctctgtggacctaacayggacctgaatattccagagcagcctagaaccatcagatgagtccttggcgttgcctggggcttgtgggctggttggctgtcagagcacaggtccctggagagggagctggcagtggggccctgagccagctccgtcctgaccagggcttgcagctggacaaggaccccgcctccagggcctcgccttcctcagctgtagaaggggctgcttgcataaggagcagatggactctgctccaggcttgagtatagctgggtgcctccatcccaggccccaccagggaggctggctggggcgtg

SEQ ID NO: 30968 - DNA, 601 bp, Human
cagagctcgggccactctctgtggacctaacatggacctgaatattccagagcagcctagaaccatcagatgagtccttggcgttgcctggggcttgtgggctggttggctgtcagagcacaggtccctggagagggagctggcagtggggccctgagccagctccgtcctgaccagggcttgcagctggacaaggaccccgcctccagggcctcgccttcctcagctgtagaaggggctgcttgcataaggagcagatggactctgctccaggcttgagtatagctgggtgcctccatcycaggccccaccagggaggctggctggggcgtggccgcactcatccagaaccctgctctgcctgcagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggcgtaggtgcccgcgccacggg

SEQ ID NO: 30969 - DNA, 601 bp, Human
caggccggggccggctgggggacctcgcagcataaccagcatgtttttgccgcacaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccaggcatgtgccatcctcccgccacccagaggcttgtgggctgaggaccaactctcaccgctgtctcttttgtccccagctccaggccatgcccgcagccggaggygtgctctaccagccctcgggaccagccagcttccccagcaccttcagccctgccggctcggtggagggctccccaatgcacggcgtgtacatgagccagccggcccctgccgctggcccctaccccagcatgcccagcactgcggctggtaaggacgggtcggggcagagaccatgccttttatccctcgtctttattttagccgaatttacagaaaagcagtaagaatggtgcgaagggttttcccagttgccccgatgtgaatgttgtccctgctttttcctgtttccatgcaaacgc

SEQ ID NO: 30970 - DNA, 601 bp, Human
gcacaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccaggcatgtgccatcctcccgccacccagaggcttgtgggctgaggaccaactctcaccgctgtctcttttgtccccagctccaggccatgcccgcagccggaggcgtgctctaccagccctcgggaccagccagcttccccagcaccttcagcccygccggctcggtggagggctccccaatgcacggcgtgtacatgagccagccggcccctgccgctggcccctaccccagcatgcccagcactgcggctggtaaggacgggtcggggcagagaccatgccttttatccctcgtctttattttagccgaatttacagaaaagcagtaagaatggtgcgaagggttttcccagttgccccgatgtgaatgttgtccctgctttttcctgtttccatgcaaacgcactcacacaggctttcctgctggagccgtgtttcagtccgtgcgtggcagg

SEQ ID NO: 30971 - DNA, 601 bp, Human
tgtcccgtacgtctgctcacagggggagacgcatacccgaggccccttctcagcagacagaacgaggacacaagtctcagggcagatacgcgcatccgcaagtgtagacaggaaaaaccgtgaatttacttgaaaggcaaaggccgcatgagctggctgcatgagctgcagtccgtggacatggattacaagcacttgtgggtctgtggctctgctgggacaaaagccttcctccctgggctggggaagggaggaccagggccatgcctgctttcctcctgcacagatggcaccctctggyggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttcccca

SEQ ID NO: 30972 - DNA, 601 bp, Human
aaaaaccgtgaatttacttgaaaggcaaaggccgcatgagctggctgcatgagctgcagtccgtggacatggattacaagcacttgtgggtctgtggctctgctgggacaaaagccttcctccctgggctggggaagggaggaccagggccatgcctgctttcctcctgcacagatggcaccctctggcggtcccccccagcagcagccccccgtggcccagcaaccgcaggcacaggggccgccggcacagggcagcgaggcccagctcatttcattcgactgacccaggccatgctcaygtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctg

SEQ ID NO: 30973 - DNA, 601 bp, Human
tcttgtgtccaaaatccaatcaattactacatcctgtcaattttgtttccttcaaactcatatctaccaacgttattcttagttcacgtcaccattatttcttgcctagattactagcatggcttctgaaagttgtctctatgcctccaactcttgaactgcatggtatttcctccacgctgcagcctgaacaatatttggcttaaagtagtttaatgctcacctcccaactatcctgatgataaaacactcaacttgcagcatggcttacaaggaccttcagggtccagctcttgctatstcagatctcatgtcttactcagtacaccctctctcacttggacttgtgtgctcttctttctatccggaaggctcttgccactcacctcctaaccaccctcctctcacttaacttagttagctccttaaggtctcagcttaattgccgcctcttccaggaagccccttctctgacccctctcctctctttcctatttgttactacacagagctgatctgaggagtagaccagctggggaggtttccaaggggtaaatctgtaagtggaactgaacctcgtctccctgagaaagtatgctta

SEQ ID NO: 30974 - DNA, 601 bp, Human
tgggcagacggaagagaacatagaaaagaactaagctcggagggatttgcagaggttgggggaggaagcaatgaaaaagaataggaagggccatctgatgaaacaagaagaaaattaggaaagggtgatgtgagaagccaagagaggagagcattccaaaaaggatggaatatgtagtatcttgaatatttttgagagactggataaggaaagaacagaaaaataaataatacctaatacatttagcatataggagatcataggcaacactgaaaaaagaagcaatttcagtaaatgggtagagtagatatcagatcagaacaggttacaatgactagaaagtgacataccgaaaataatttatatagttaacactttctggaagcttggcagtgaccacaaaactgagaattagagcagtaggtaagacacagtttgtggctaaggaatgtttttgggtttttttaaagatagaaattattagagtgtgtttatgctgatagaaattatctagaaatgaggggatgaaaatatataaaagaaaggaatttcaagtccttgataagaagacaagggagaatatccaaaacccttatggaag

SEQ ID NO: 30975 - DNA, 601 bp, Human
gtcagcagatatccatcagtgacatactctgtgttttggtgcaattaatttaggacaaaatctaggagtgatctcccaaaatttacactaaagaagggagatattctttagacaagcaaacagtaatatgcataaattattatggtatacaaagtgccctgaaaagaaagaacaagacactttgataaagaacaatatgctatgtatttaaaggtggttgtaaaggaagacctctgcaaaggactggggtttgtgtcccctcaaaatttttatgttgaaatcctaaaccccaacgcaatgktaataggaggtaaggtgtttgaaaggtgatcaagtaatgagagtagactcttcatggatgcaatcaggctccttataaaagagaccacagaaagctctctcaccctctttcctccacatgagaatacaatgagaaggtggcagtctgcaaccccaaagatggccctcactagaattggaccacgctggtacattgatcttggacttccagcttgcagaactgtgagaaataatttttgttgcttataagccacccagtccatggtatttcattacaacagcctaaacagactaagacaat

SEQ ID NO: 30976 - DNA, 601 bp, Human
ggaaactaatgcatagaagtggttactcaaaatgtaaaggtcaaagtgagggtccaaacccagacagggtggcagcagaatctgtgcccttaccattgtgtcactgtgcctttcctctgttctgcaaaacagggctcacgctattcaacatgacacaccaacaaatgatttcaatgacagtcagtagtagaaatattgaatatataaaaatgtcagacagtatcatacagaatagaaaaatgtaatataattgctgttagtgtagcagaagccgagggaaaaggaacaatatcattgatgktcagaaaaaaatctgtaattattgagattataaatcacctaatgactatcaatttaagaagaaacatgttggaaacatttgatgcaattacctgtgtgaaatcatggctgactcatgggatcatttagcaagtaacagctctactcaaaagagtcagccaacactgtccataaatcaacaattatttagaaatcttaacactgacttcatcatttgcactgcaacacacagttatcccttcttcccaggaggtatgttctaagattcccagtgggtgactgaaactagggatagtaccaa

SEQ ID NO: 30977 - DNA, 601 bp, Human
tcctatgagttgttgaaatattgaaatatatgttgattgggaaattgcagtttagtgcccctaccatctctctgactcctcccttgcatcacctcaacattagagaccacttctacctcctcattattaagcaattataatgttaatttctgacataataggtctccaggatcctattccaatgatctctctcttctgaaaacaaatcatgctgtctgagcaatattactggttcccccaaagaatctcagaatgctgggctgggcccagctggtggtggttgtatgtacaatcgtaaatwtccacctggatggacaattctgggtcctgtggctggctgtggctttcaagaaagtgacggcaattctagaataacctgcccagttatcagtatctatcccatcagttcagtgcaaaaattctactgaggatgaaggcactggaccctctacctctttactttgcagctgaggctactgctgacacctttagcatctgcctactcaaccgataagatgagaaccttagtccactgcctgcttaggaataagggttagggagaaccagagccagctgccaactgcagcatatcccaattcgc

SEQ ID NO: 30978 - DNA, 601 bp, Human
gtttgtctcacttttcctactaccacagtttaataaaacaaagacacaagcttagattgtcctaagaaagaagctaattataatagctaacacttgttgagtactgtgagccatgcgctttaaaaaatattttataagtaataattcttctaatcttcatgagaattttcatgagtagagatgccacttagttggaatatatcagtaaaatcctatgagttgttgaaatattgaaatatatgttgattgggaaattgcagtttagtgcccctaccatctctctgactcctcccttgcatcmcctcaacattagagaccacttctacctcctcattattaagcaattataatgttaatttctgacataataggtctccaggatcctattccaatgatctctctcttctgaaaacaaatcatgctgtctgagcaatattactggttcccccaaagaatctcagaatgctgggctgggcccagctggtggtggttgtatgtacaatcgtaaatatccacctggatggacaattctgggtcctgtggctggctgtggctttcaagaaagtgacggcaattctagaataacctgcccagttatcag

SEQ ID NO: 30979 - DNA, 601 bp, Human
ggcagacactataccaaacattctagctagagataatgtagatcaaactctcagaaagagatctcctaatacaagacatagacgtgagaattattcactagatagagtgaagaaagagaaaagctgaaggcaagagatgtcaaggacaagagatacaagcatatcaatgatgtttttgcaatggtattgtgtttaaaccatccttgggcaccttgaactattacagattagctttcaaggtctatctttgtctcagactgtaggaaacacagaaagtcctcttcctcccaagtagacaagyactcctggggcagagtcaagcagcgccattcaccactggttctcaggatacattacaagaaagtcatcctcaggactaggaatgcaggcaagccctaataacttacaaacaattcatccctctgacaccaatacccctaaagtactcattgttttcttttgcccttttctgggaaaacacactttatctaattctaacatgtctattgtagggtctagccataacccttattttctctttaaaaaccacttgaatatatattcaattattcaaaattttcctacatgcaaggcactgttc

SEQ ID NO: 30980 - DNA, 601 bp, Human
aagttacttctccatccccaaagatctttcatatctgtagattccacttctcatgccctccctccacgtcttcctagtggcaagtggccacacgagattgcagttactctactgtcttaatagtcaaacactctgcagatttgtgaacacagtagaggaccttgagctgggaggtaactgaggcaggtaaaagaaatacccaaacaaaagtggaaaggtgaaggggagaagctgaaacaacaatatccaggttcaatttaacaaataggtatgtagtgctttatctgtggcaggcagacaytataccaaacattctagctagagataatgtagatcaaactctcagaaagagatctcctaatacaagacatagacgtgagaattattcactagatagagtgaagaaagagaaaagctgaaggcaagagatgtcaaggacaagagatacaagcatatcaatgatgtttttgcaatggtattgtgtttaaaccatccttgggcaccttgaactattacagattagctttcaaggtctatctttgtctcagactgtaggaaacacagaaagtcctcttcctcccaagtagacaagcactcctgg

SEQ ID NO: 30981 - DNA, 601 bp, Human
aactcctctgctcaagcaattcacccatctcagcctcctgaatagtgggaactacaggcatgagctactgcacttgattgagtatgttttaatttgcaaatctcaagattcattttttaatgtggtaatactattgatttatataaaccatcatctaagcccagatgagcccagaaacaaatatttatgggtatgacttgtttaacaataaacatgaatctacgtggacaaattaagttacttctccatccccaaagatctttcatatctgtagattccacttctcatgccctccctccaygtcttcctagtggcaagtggccacacgagattgcagttactctactgtcttaatagtcaaacactctgcagatttgtgaacacagtagaggaccttgagctgggaggtaactgaggcaggtaaaagaaatacccaaacaaaagtggaaaggtgaaggggagaagctgaaacaacaatatccaggttcaatttaacaaataggtatgtagtgctttatctgtggcaggcagacactataccaaacattctagctagagataatgtagatcaaactctcagaaagagatctcctaatacaag

SEQ ID NO: 30982 - DNA, 601 bp, Human
gttgttacataggccaatgcaggtcttttgttgcatgtaccagccaaacctataatttaaaagttctgccttatcatgtgcttgctataattttaggaatcacgttctatctaataattacaacgaatccttgagtttcaccaaatgacatattgtgcttcctatcaaattcaaacatagacttagatctgtatacacactaaatactagatcattttccctcttctcacgctgagccttgctatgaagtgtgtttgggattatctcgaataatcttttatgtttaataggtaacacaggmgttattttaatgaccaactaatttataaaacatttccaactgacttgctagaaagttctttgttcagttttagattcctagagtagtttgaattgttgatgttaattactcctttccacctgtgctatagtagagtgcacagctcagcttcagcctctccattatgcaaatattaataggtaactaacatcttccaaaaaataaaaataaaaagcattgagaggttgttttccttaaacttgaatttctctaaaaggtccgagtggccacagaggtgacatttctattgcagtctattgg

SEQ ID NO: 30983 - DNA, 601 bp, Human
cataaacaaacatggctccaccctccacagacatacatttacattccattaatgtgcatctccaaagttgtacatgaagaaatagaaaaacaatgagtcctttctcaattcacagatttgcagagaataacctacagttacacatacgtaagtaacaaacacactagacgtatcctgagttaatagctgagaagatatgtttcgaagggaactaagccaataaagagtaggagagaactttggatgaagttttaaaggaaggagagtacaggtgagaaggtagatgacagatggtcaggawatacctcacaaggtaatcagataatgaagcagaaaattctcacttgcctaaaatacatatggaccatggagaatatttccagacttacgcatcttttggcccttcctgagaaagatcaaagacttgccgtggattcaggtaccacatgaacatctgcaggactttggttccctgtaaaaaataaatacacaaaaaggcaataataggaagaaatttcccaagaataactgctcatttaaaaaataaatacttttatttaaaataatacacagggcacggtggcacacgcctgtaatccca

SEQ ID NO: 30984 - DNA, 601 bp, Human
tctacactgcctactttaaaaaaagacctgtggaaggttaatttgcccaaaggtcaactagcatctactaaatatctgaatataattttcacagagcccagcccatgtaatgctctcatatgagcagataaaaagttggtggggaccaggtgcagtaactcaagcctgtaatcccagcactttgggaggctgaggctggtggatcacgaggtcaggagtttgagaccagcctggccaacatggcgaaaccctgtctctaataaacatacaaaaaaaattagctgcacagggtggcgggcasctgtaatcccagctactcagaaggttgaggcaggagaattgcttgaacctgggaggcagaggttgcactgagctgagatcgtaccactgcactttagcctggcgacacaacaagactgcatctcaaaaaagaaaaaaaaaaagttggtggggctgtatatgtgtatgcatatgtatatatacacagtgtgtgtatatatattgcgccttcttactatcttagtactataacatacgtaagtaaataaatggctgtttagtgactgcagaacgatttcccccaagcttgcctgaagttggc

SEQ ID NO: 30985 - DNA, 601 bp, Human
ttttttcacaatggctttcatgagcctttgtgttaccctttaggtattttatggcaagtgatccatgaagccgcagacagtgcctgtgttggaaaacagtttaaagtctcactatgagttttcttggtttgagaacagccactcactatctactgacaaaataagtaagcttgccacaattaaaaatctggtcttgcttatcctgttttttcttctatagcttagcttaagatttcttgactaactagttaaaaatagggggaaaatacaaatgaacagaaacagtaaaaaaaaaaaaaaagaaagaaaaaaaggctatttgcttaattatatatttcatagacaaataattttttaatttactatttaaaaaaagcagaataacagctactgaaaagtccatacctctggtctaagtgtatcagcaaaatctggttccaatatcttatagttatttaatttttttaccacctctatcccacctgcatgaatatttacctattatttccaattaacataaattctcccttaacagcccttcagtggctgattttcctcaaaggctctgatttacatgcaggggaaatgtttacaattccat

SEQ ID NO: 30986 - DNA, 601 bp, Human
ggaaaaagaaggcactccctttaacctcacgtatgcgtccatgaaaaacaccccatattctgccagtttctaatccaaacgtcaatgtgcgcaccctggtgaaaactacgttcttacctaaaattcttcagacatcctcagtctacacaattcctccatttcttacactggctttgatgtttgtttctcacatccctttttgaatagcatcttctcttgttcaacatgaagcctcggggcttgcttaaaagctcagagatgaggaacaccaactctctttctgacagctaacttaagaaayacacctcactttcattcttaagcccagccatgaaacagtaaccatagatagacatatataaatgagatgtatatgtgattatttctcatgtagtttgcaactttatgatacacagtgaattggcaataagtaatatgtagtaattatgaaataaaatgtatacctacccctgcatagaacattttatttcgaaaacgactgttgaatttctctggatttgcttctgtgaaagaggaaaagtagttttgttatggagacctcactaaaggtagcgacttagattagcactcctacttcctc

SEQ ID NO: 30987 - DNA, 601 bp, Human
ttactactatgaacgtgcctgagaaacaaaagaaggaaaaagaaggcactccctttaacctcacgtatgcgtccatgaaaaacaccccatattctgccagtttctaatccaaacgtcaatgtgcgcaccctggtgaaaactacgttcttacctaaaattcttcagacatcctcagtctacacaattcctccatttcttacactggctttgatgtttgtttctcacatccctttttgaatagcatcttctcttgttcaacatgaagcctcggggcttgcttaaaagctcagagatgaggaamaccaactctctttctgacagctaacttaagaaatacacctcactttcattcttaagcccagccatgaaacagtaaccatagatagacatatataaatgagatgtatatgtgattatttctcatgtagtttgcaactttatgatacacagtgaattggcaataagtaatatgtagtaattatgaaataaaatgtatacctacccctgcatagaacattttatttcgaaaacgactgttgaatttctctggatttgcttctgtgaaagaggaaaagtagttttgttatggagacctcactaa

SEQ ID NO: 30988 - DNA, 601 bp, Human
tgggagagtgagtcaccacaaaataatgaaatcaacacttcgttctaaaatggagattatcctggaataaatatcctcctcagattatcctggaataaagatacttgtttggagagtaccgatttatgcttcaagacccagctaacatcatttttttttataaaggtcttcctgaccccaccatagtcagagttatcacttctccctttgtgccacaaccatattatacacacggttgaataacagttttattgttctgaagtgacttatgtgaccttcttcaaaactgaactgtgagttycttcaggagcgaaactagtcttttcatttatcttcatccccagcaactaagacagtgcctgacacataataagtgtaggttgaatgaactacacaaaatgatctccaaagttctatgcagtccagtgattcaatatataaactaagtatttgggagttttttgtggcagtcatatcatattcaaatgaaataaatcaacatattcaatacttacaacaactttaacatgtttggatagatctctagaacttctctgtaggaagtcagaaaaagctgcctataccacagggaaataaagaa

SEQ ID NO: 30989 - DNA, 601 bp, Human
tcatttacttatacgactatgtgcaacaaagtcatgttccttccttcttttaacttgtttactataaggaaacattaatgtttttcttaatacctaattttattctatttttgaatgtgtcaccttgagaaagataaatttctctctcccttgcccccaagcagtatatttccgcaacctgatatagagacccaggaagaaacagcacatacacaaaaaatccatctagtggtgaggaaccttgaccaggtgggagagtgagtcaccacaaaataatgaaatcaacacttcgttctaaaayggagattatcctggaataaatatcctcctcagattatcctggaataaagatacttgtttggagagtaccgatttatgcttcaagacccagctaacatcatttttttttataaaggtcttcctgaccccaccatagtcagagttatcacttctccctttgtgccacaaccatattatacacacggttgaataacagttttattgttctgaagtgacttatgtgaccttcttcaaaactgaactgtgagtttcttcaggagcgaaactagtcttttcatttatcttcatccccagcaactaa

SEQ ID NO: 30990 - DNA, 601 bp, Human
tttatattttcatgctccttatatttcttcatatctcattagcttaagatcatatatttttctctattttcatgtatatattttgttctgttctctcttgtcaaaattaatctttttctttttcttttttttttttttagacggagtgttgctctgtcgcccaggctggagtgcagtggtgcggtctcggctcactgcaacctctgcctcccaggttcaagcaatctcctgcctcagcctcccgagtagctgggactacaggcacatgccaccacgcctgcctaattttttgtattttgawagagatgggatttcaccattttgcccaggctgctctcgaactcctgagctcaggcaatccagctgcctcggcctcccaaagagctaggattacaggcatgagccaccgcgcctggcccatcaaaattattcttattctttagaataagataaattcaagcattgataaattcaaacattgctatattctcatcacttcttttccatctatatatcttttttctctttctcattctgtcatttacttatacgactatgtgcaacaaagtcatgttccttccttcttttaacttgtttacta

SEQ ID NO: 30991 - DNA, 601 bp, Human
ctaactaaatcccaaatgtttacacctagttataatgatttttttcctcctcataagatataatttatataaacattccacctttaatattacatatataggctgatatcacatctttcctagttatttgctgccattttggcctctctgcaagcatcttttagactctactataaagtcacccatgcatgagacatgtatcatcaaggggactgagatatgagagagaaaactctctagcagttaggaagttacagagtttgatatcaatccggtgacttgcacagtacactgccattcyatatggccaccacccagcatgcactgggtctcctggcaggtactgtggatgcgcctgtaaatgcaaaacacactggaaagggcagtaaagtttaatttttgctaggctgcaggcagctgaagaaacaggggaagtttaatgtaaggttgctgctacttaaatttaatagccacgattttattgaaataataatcctcatagttcaatgggccctgtgttcttgtatctagctttaagaaggcaatatttcagtctcaagcgtctccaccactaaaagatacttgctttatatttttattg

SEQ ID NO: 30992 - DNA, 601 bp, Human
aagtatcctgtggtatccaactttctcctcgttcgttatctatatttctcactatgattcatgtatgtctgttttctatgatatatcatgaattatctataggtggtttcagaatttggtcttaaaggaagatgtatgcatgccagtagaaaagagacagggaaatgaagtgggaagcatttgccattaatacataagcaaaataagaggtactcacaggagaagggaaaggtaactatggaagacagagtgaagaagagatgaaatatagataagagattagaaagagaatgggaaacaraagaaattggagaaatagaggaagaagaatacagatggaaagagggagaagcaagaaaagacagaagaaggacaagagaggaagaaggacaagagaggaaggacaagagaaagaataataaagcaaagtaataaacaatgctttctgagaatcaaggccttctacttcaattaagctgtaaatatttctggaataaaattgtaactgactatattgagcactgccaagaataatcaggagactatgatgtgttttcctagccacagatttacatacaactctcatttcaattaaattcag

SEQ ID NO: 30993 - DNA, 601 bp, Human
tcgaaatcatggtgatcacctgggtttccccagggcattgtgccagcacaatatctgcaagagaagattaaagacagaagtaaatatgtcccatccttctcatgactatcatgaggtgttagtttgtagttagacccaatgtttatcaaacataaaaacagttttccattcttggtacacaccttccattagaaaaggaaatgcacttcttatcatctacaaaataccaagctgtgaaaacgggccataattttgcaacaaaagtatcctgtggtatccaactttctcctcgttcgttatytatatttctcactatgattcatgtatgtctgttttctatgatatatcatgaattatctataggtggtttcagaatttggtcttaaaggaagatgtatgcatgccagtagaaaagagacagggaaatgaagtgggaagcatttgccattaatacataagcaaaataagaggtactcacaggagaagggaaaggtaactatggaagacagagtgaagaagagatgaaatatagataagagattagaaagagaatgggaaacagaagaaattggagaaatagaggaagaagaatacagatgga

SEQ ID NO: 30994 - DNA, 601 bp, Human
tgactaaaatacatttcattttaataaaacagttatattgctcaccaaagaggccatggtaaatccaatgacttcaatataaccatcatcatgacgctgaggttcgaaatcatggtgatcacctgggtttccccagggcattgtgccagcacaatatctgcaagagaagattaaagacagaagtaaatatgtcccatccttctcatgactatcatgaggtgttagtttgtagttagacccaatgtttatcaaacataaaaacagttttccattcttggtacacaccttccattagaaaagraaatgcacttcttatcatctacaaaataccaagctgtgaaaacgggccataattttgcaacaaaagtatcctgtggtatccaactttctcctcgttcgttatctatatttctcactatgattcatgtatgtctgttttctatgatatatcatgaattatctataggtggtttcagaatttggtcttaaaggaagatgtatgcatgccagtagaaaagagacagggaaatgaagtgggaagcatttgccattaatacataagcaaaataagaggtactcacaggagaagggaaaggtaact

SEQ ID NO: 30995 - DNA, 601 bp, Human
cccttccctgctgggacgtatctacgacccactgtgccactgctgccagcatgagcgcaacctgcccccatccacccagctgtaccaccactgttagcaccagtactcaaatgaagatcagtagccccactccctgccctatgttgccattgcctccagtgtgaatgcacacatggagaccaccagccccacacccgccagtgccccatcgcacccactattactgccacttgcaaatgcctgtatggaggctggaagcccctggctcaccagggccccactccagctgatgagcatgcaygtcatcacactgctgttgcttctggcatgtacaaatgagcacagatcttacttccaccacccagtgaagctctttggctgtcactgcccatcaaggcaacaggttcctaaccctgaggagccagagatgaaagcagggggcccaaaatgagcccaccagagttaaagcacacagctcaggagtgttgagctgagcattggccccctaaaatattccagaaatgaagccagttgaccaaacccaccttataccataatcaaacacccaacaacaccaaagaaaatgaaagcaaacaaaaac

SEQ ID NO: 30996 - DNA, 601 bp, Human
ttgccagtgtgtgtgtgccagcagaccttgcctacccttccctgctgggacgtatctacgacccactgtgccactgctgccagcatgagcgcaacctgcccccatccacccagctgtaccaccactgttagcaccagtactcaaatgaagatcagtagccccactccctgccctatgttgccattgcctccagtgtgaatgcacacatggagaccaccagccccacacccgccagtgccccatcgcacccactattactgccacttgcaaatgcctgtatggaggctggaagcccctggcycaccagggccccactccagctgatgagcatgcatgtcatcacactgctgttgcttctggcatgtacaaatgagcacagatcttacttccaccacccagtgaagctctttggctgtcactgcccatcaaggcaacaggttcctaaccctgaggagccagagatgaaagcagggggcccaaaatgagcccaccagagttaaagcacacagctcaggagtgttgagctgagcattggccccctaaaatattccagaaatgaagccagttgaccaaacccaccttataccataatcaaacaccc

SEQ ID NO: 30997 - DNA, 601 bp, Human
gggatagttgcttagagaggtggtaagggcagggctccagccagtgtggagcccagagggtttggtgcagcaatgtccacagtgaagcatgaccagggatacccatccccaaggcgtcccatgctcccctaggaaactttagccttaggcaaactgtcagacctgaacagagcagggccagtctgacctgagtgacccctgtatgctggcatctcctgcttgcagtgcagccgcagatgcctaactggggtgtctcccagggacatgcataatagctcctgcgctggctgactgtgcctgrcaatcaaatagctccagcccagtggcctctgccaaggcacatcagcccacccgcaccctcccaccactgcagcatcctctgtaccactttgctggcatgcactcatccaaggccacccccataccattttgccagtgtgtgtgtgccagcagaccttgcctacccttccctgctgggacgtatctacgacccactgtgccactgctgccagcatgagcgcaacctgcccccatccacccagctgtaccaccactgttagcaccagtactcaaatgaagatcagtagccccactccctgcc

SEQ ID NO: 30998 - DNA, 601 bp, Human
acttccaggcagcttttatgtttcccacttttaataatgaagagaaaggcaaaagtgatcagaaaattgagaaatttttctaatgcagaagccaaagatcaaaataaacaggatcctccaggcaagatagctgaacagacacagccagaaggaacatctgccatcgagagaccaggacatcaggaagactggcacactctaagcagatcttcagaaggaaggtattgagaatggctagagaaaggacacagatgctgggtttaagggggaggaagctggaaaccctgcaggggctaccatwcatcagttcctggccctcagtaacccctggggtagtggtgagttgagcagggaaggaatgacatactctcaccatggacttatagaatcctggcaggaggagaccacaagacccccacagaaacttaagctggaagggatagttgcttagagaggtggtaagggcagggctccagccagtgtggagcccagagggtttggtgcagcaatgtccacagtgaagcatgaccagggatacccatccccaaggcgtcccatgctcccctaggaaactttagccttaggcaaactgtcagacctg

SEQ ID NO: 30999 - DNA, 601 bp, Human
gcccactaccaacatttataaggctcaaggcaagaacataaagacctgcattccatatttctagatatttataagtttaatgttaatccccaaaactgttaaatgaaatatgttctatcttcctatcctgataaatattcctttgtagttacctaaatgagatgctgaaactcataattcttgtactccaaggagtattagaacaaaacatagtgcttgtggtccatagttagacctccttctctttccactccatggatgttcaaaacatgaaagaacttgtgcttatgtatacagatamtacagaccacatccccaaactttctccaaagcccatgcaaactgctgccccaaagggccttccttagtcctatgcccactctacatgactcctgtgagactagaccagaagaagaggcctacgcagatcctagaagcaggtctggagctgttggggcaggaattctaagaatccaaagcacagtctagaaaagggtagagaaatccctagatgagcccttttccttagcactttagacaaatcatcccatgaagcagggcaaagccagaaatgggacatatctaggacatcgaaagctga

SEQ ID NO: 31000 - DNA, 601 bp, Human
gaaatatattaacatgagaacaggcccactaccaacatttataaggctcaaggcaagaacataaagacctgcattccatatttctagatatttataagtttaatgttaatccccaaaactgttaaatgaaatatgttctatcttcctatcctgataaatattcctttgtagttacctaaatgagatgctgaaactcataattcttgtactccaaggagtattagaacaaaacatagtgcttgtggtccatagttagacctccttctctttccactccatggatgttcaaaacatgaaagamcttgtgcttatgtatacagatactacagaccacatccccaaactttctccaaagcccatgcaaactgctgccccaaagggccttccttagtcctatgcccactctacatgactcctgtgagactagaccagaagaagaggcctacgcagatcctagaagcaggtctggagctgttggggcaggaattctaagaatccaaagcacagtctagaaaagggtagagaaatccctagatgagcccttttccttagcactttagacaaatcatcccatgaagcagggcaaagccagaaatgggac

SEQ ID NO: 31001 - DNA, 601 bp, Human
gatatccaccacccattgtggaaaggcacagttaccttacagaaaatgaagattaattgatcatctgaagactgcagtgatccccagttttcttcccaccctgaattccccaaaagctggcagccagaaccttactttctaggaaaaacattggaaaactcatctcaatggaatctgacaaaaccatgaggaaatatattaacatgagaacaggcccactaccaacatttataaggctcaaggcaagaacataaagacctgcattccatatttctagatatttataagtttaatgttaatycccaaaactgttaaatgaaatatgttctatcttcctatcctgataaatattcctttgtagttacctaaatgagatgctgaaactcataattcttgtactccaaggagtattagaacaaaacatagtgcttgtggtccatagttagacctccttctctttccactccatggatgttcaaaacatgaaagaacttgtgcttatgtatacagatactacagaccacatccccaaactttctccaaagcccatgcaaactgctgccccaaagggccttccttagtcctatgcccactctacatg

SEQ ID NO: 31002 - DNA, 601 bp, Human
aactgccaagcttccttgacatttcctctattttacttaggagtagtgagagcacttatcacctgagcaccagtgtcactatccctgagctcaacaattcatcttattttggtagcagagactttgtttaagtccaggaagcatgagttaatactcaaccttcacaatggaacttttattgcagggattaaatggaattcacaagttctaactaagtgaaaagaacaagctgtgttccagaataagatggcatatttcatgcacatattaatctctcaccagaaatactactaacctacartaaatagatttttaaaagaaatcaacaaaaataaggataaaataacagatgaagtagatgaaaaattggcaactgactcagagcccttagagagtcaaatcctaaaccactagtgggtatagacatgaaccaaaataatttctactgcaaaaccctcaaaaggcttgcaaactggcagtaccgggtgcctcaggagctgaggttaaaggaggtggttaagatagaagcactggatgttagatcaccagatatccaccacccattgtggaaaggcacagttaccttacagaaaatgaagat

SEQ ID NO: 31003 - DNA, 601 bp, Human
attaccaacaactgtcaaatttattccaagaaggtggcaatatgcagtagaaaggatttgcagtcatccactgctgggtttaaatcccagtattgctttggtcttgcaaattactcaacttagctacttagtcaattcttctgagccttggtttaaagactacggtgtttagaatagatgtcatacaggatttttgtaaagactcaatacaacactatatttaaaaataaattatcaaaacatcaatttttattctcccttactcttttcactatcttttgagcatctttagccagaaaayagacatacccaatcatctatcttttaatttagcatagtactacaaggattagctagcagtagtttcgtaagttatatgccagttttctaaaaactaacttctactcttcctgccatgtaaaaaaacaacgtagtagaaaaatattgtaatctgacacttccatttgggcctttacatggcgaagaaaaagcagaaacttttcaaaaattaccaccttccttctacactatggttaaccaactgccaagcttccttgacatttcctctattttacttaggagtagtgagagcacttatcac

SEQ ID NO: 31004 - DNA, 601 bp, Human
gtgaattgtcgcagtaacgatggattggcagaacagggaggctgctcatggacagttgataattatgcttgcattttttatgcttatgcctaaatttatgcttgcatttgcaatagacaacatgaggatgcagtgccgggggaattaaacattgaggattctggacacttactccttccttcctgaatgcagacaacttcatctttttgtctgtctacaacagtttcctatttatgagacttgagctactcaaggcactgttgctacctggtggccaatatcagaactaaaggcataaaaygttagaaagaaaagaacaaaaaacagcttctagaagaggcaaagcttaaaaaatccaactaattttaaggatggccaatgtaagagtggtaacagtaggacctcagaaaacaataagacaagactaagttatgcaccttataaaatatcctacttaggtagtgtcaaacacacacagtggctttagtgtatagaacctacttcagatagaatcacaagagtcctgaaatactgaaaaatagtcttctttccaaaacttaaaaaaaaatctacaaatttctcattttaaaagtacaattac

SEQ ID NO: 31005 - DNA, 601 bp, Human
cgtaaaaagaaagaagtactttctccctacaccttttttattatttcagtctcttcttgtttgcagttgtcacacactttcctagcatgatccatgttgccccttgccacctgcccctcatctcattgtgtttcactggccctgagatgaagtgaattgtcgcagtaacgatggattggcagaacagggaggctgctcatggacagttgataattatgcttgcattttttatgcttatgcctaaatttatgcttgcatttgcaatagacaacatgaggatgcagtgccgggggaattaaamattgaggattctggacacttactccttccttcctgaatgcagacaacttcatctttttgtctgtctacaacagtttcctatttatgagacttgagctactcaaggcactgttgctacctggtggccaatatcagaactaaaggcataaaatgttagaaagaaaagaacaaaaaacagcttctagaagaggcaaagcttaaaaaatccaactaattttaaggatggccaatgtaagagtggtaacagtaggacctcagaaaacaataagacaagactaagttatgcaccttataaaatatc

SEQ ID NO: 31006 - DNA, 601 bp, Human
gaaaaatctaaaataacatatttgatttttctatatcagcataaatgtgtttctcgtggttaaaaaacaatctcataaatattatgggttttttagatatgtccgtaaaaagaaagaagtactttctccctacaccttttttattatttcagtctcttcttgtttgcagttgtcacacactttcctagcatgatccatgttgccccttgccacctgcccctcatctcattgtgtttcactggccctgagatgaagtgaattgtcgcagtaacgatggattggcagaacagggaggctgctmatggacagttgataattatgcttgcattttttatgcttatgcctaaatttatgcttgcatttgcaatagacaacatgaggatgcagtgccgggggaattaaacattgaggattctggacacttactccttccttcctgaatgcagacaacttcatctttttgtctgtctacaacagtttcctatttatgagacttgagctactcaaggcactgttgctacctggtggccaatatcagaactaaaggcataaaatgttagaaagaaaagaacaaaaaacagcttctagaagaggcaaagct

SEQ ID NO: 31007 - DNA, 601 bp, Human
aactcacctcctgtaggcggtctatgtacatacggcaagtctccaaatcacagtctccacgcacaactagaatacccagaggtatcgctaagggtgaaggaagaagaaaaatctaaaataacatatttgatttttctatatcagcataaatgtgtttctcgtggttaaaaaacaatctcataaatattatgggttttttagatatgtccgtaaaaagaaagaagtactttctccctacaccttttttattatttcagtctcttcttgtttgcagttgtcacacactttcctagcatgatcyatgttgccccttgccacctgcccctcatctcattgtgtttcactggccctgagatgaagtgaattgtcgcagtaacgatggattggcagaacagggaggctgctcatggacagttgataattatgcttgcattttttatgcttatgcctaaatttatgcttgcatttgcaatagacaacatgaggatgcagtgccgggggaattaaacattgaggattctggacacttactccttccttcctgaatgcagacaacttcatctttttgtctgtctacaacagtttcctatttatgagactt

SEQ ID NO: 31008 - DNA, 601 bp, Human
agttttatttatttttttgtttacaaaatctagctgtctctgacataagtgtcagacacaaaacattaaatatcactgttttctttcattatttatcagtccctgttgaaattctgaacatctcaaatatacaggtatgtgtctggtaaaatgacaagttccaagctatagttatggaacacaccagggcaacagcaccctgtagtcaatgctttcccatttcaaccatctgaggagtgaacaacagagacagtgggagagggtgacatacagcgtatgcttgaaggacaaagccaccacwtttccacttcctctccaaatgcatcatttcagaagcaaatatatatggctggtaattgtttacaaaaatggaaagttgaggagaataaaaaattggctaaataaactcacctcctgtaggcggtctatgtacatacggcaagtctccaaatcacagtctccacgcacaactagaatacccagaggtatcgctaagggtgaaggaagaagaaaaatctaaaataacatatttgatttttctatatcagcataaatgtgtttctcgtggttaaaaaacaatctcataaatattatgggtttt

SEQ ID NO: 31009 - DNA, 601 bp, Human
tgcctctcccctgaatttatttctaccaagagaaacagaatcaaatattcagggtgaagtggttacaactcagagggattttaaacagtatgtgtctactttatttacaatatttacctatgtataacatgttgtctgggacagaattgcttatcaaggggtatcaagacaacccaacagctttaaaaatacaaatgtctaggccacacccaagaaaagtgactctaatatacatctttcatcaaaaaaaatgataaagaaatcgtcatatatgctttttgcaatttgtggaatggagacrgttaagactccccctcaaatttttgcaaaaacaaccaacaacaattgtaatgatgagtttgggtctcctggctttgctggtgcagttcacatttatgggagtgccatatacggggtcacttcctttctgtttctctaaagcaagactagattgagaaaaaaaaatagattattcttttgtgttctgacaaattcctatgagatgtagaggatttttctttcccatagaagttttatttatttttttgtttacaaaatctagctgtctctgacataagtgtcagacacaaaacattaaata

SEQ ID NO: 31010 - DNA, 601 bp, Human
ctcctatagaggagaccagaagtaaaagacaggcaattttgttctgataaatggggattatatttaatgtgcatataaacttttggcttgtgaagaaggctttggaaatccctttaaacacttagaaagcttttctttacctcagaccagatacatactgtcatggtaactgtttatactgataagtcgcttagcaaataggggttttcatagactacaaagagaaaatcaccaaccacctccacattatcacaaagtgcaaattaacagggttgaaattaatgaggttttactggcagaytgtgaaagcctgactcctttcataaagttttataacgaacttgtcaccattgtcatgcctcctaggcttccttgctaatgagtgtagtgattctattcacagatgtcagcaatcctgggtacctttgtccttacacctgtttcccacagggtttcatcacattactttccattagttttaaaaatttttcctctttatttgttgagttgcctcttttttaaaaatcctacttttagttgaatattggtgcattaagcatgctattaagttagttaagttggtttttaacaaagtcaattc

SEQ ID NO: 31011 - DNA, 601 bp, Human
gaacacacccaaattcataaaggttaaataaagaaggtaatgccagaaataataaaatcaaaccaagctggactgagagaaggtcattaagctgttgaaacctataagtcctacatagtgtttaaagtaagtgttatattattatttcaatctcctatagaggagaccagaagtaaaagacaggcaattttgttctgataaatggggattatatttaatgtgcatataaacttttggcttgtgaagaaggctttggaaatccctttaaacacttagaaagcttttctttacctcagaccasatacatactgtcatggtaactgtttatactgataagtcgcttagcaaataggggttttcatagactacaaagagaaaatcaccaaccacctccacattatcacaaagtgcaaattaacagggttgaaattaatgaggttttactggcagattgtgaaagcctgactcctttcataaagttttataacgaacttgtcaccattgtcatgcctcctaggcttccttgctaatgagtgtagtgattctattcacagatgtcagcaatcctgggtacctttgtccttacacctgtttcccacag

SEQ ID NO: 31012 - DNA, 601 bp, Human
aagtatcgaacacacccaaattcataaaggttaaataaagaaggtaatgccagaaataataaaatcaaaccaagctggactgagagaaggtcattaagctgttgaaacctataagtcctacatagtgtttaaagtaagtgttatattattatttcaatctcctatagaggagaccagaagtaaaagacaggcaattttgttctgataaatggggattatatttaatgtgcatataaacttttggcttgtgaagaaggctttggaaatccctttaaacacttagaaagcttttctttacctyagaccagatacatactgtcatggtaactgtttatactgataagtcgcttagcaaataggggttttcatagactacaaagagaaaatcaccaaccacctccacattatcacaaagtgcaaattaacagggttgaaattaatgaggttttactggcagattgtgaaagcctgactcctttcataaagttttataacgaacttgtcaccattgtcatgcctcctaggcttccttgctaatgagtgtagtgattctattcacagatgtcagcaatcctgggtacctttgtccttacacctgttt

SEQ ID NO: 31013 - DNA, 601 bp, Human
gggagccagaagaaactgactgtaggtcctaatgagaaaatgaaaaaaaaaatccataccttaaaattagtttgaacaagctgccccacaactcaatctcaactgaactcccaatttaatattactatgctcatctggaaagtatcgaacacacccaaattcataaaggttaaataaagaaggtaatgccagaaataataaaatcaaaccaagctggactgagagaaggtcattaagctgttgaaacctataagtcctacatagtgtttaaagtaagtgttatattattatttcaatctcytatagaggagaccagaagtaaaagacaggcaattttgttctgataaatggggattatatttaatgtgcatataaacttttggcttgtgaagaaggctttggaaatccctttaaacacttagaaagcttttctttacctcagaccagatacatactgtcatggtaactgtttatactgataagtcgcttagcaaataggggttttcatagactacaaagagaaaatcaccaaccacctccacattatcacaaagtgcaaattaacagggttgaaattaatgaggttttactggcagattgt

SEQ ID NO: 31014 - DNA, 601 bp, Human
tgcctctgccactgctattctaaggcttggaaagcccttccctttgcctctgccatctaaatcatacttgtctttaaagaaccagctcaagtgcttctgcttctgtgaaacctttctcagtcccaacctcccaacaccagacagaacctgctgaccctgcatccatccacatttacattttttaaaacttcttatacagactatcttcacagataaccatgagactaagagacctgcctctttaaaaatctgtttcatttaatcttttatgcctcctgaaattagcaaatgatcttaaagwaagttaggaattagtatgtatttattaagtaaataaagctagaaaaagctacagttacgtagacttctcagtgaagtgacttcccacttcggaaaatggcttgaagattcaggccagagaccatatgtggtcttaaatgaatcatttcactttcaacctgcatccttagagtcatgtctgaaggaagccaaaacagcaaaaaaattatttaagcattctctgaaagagattgagctacatctatggtatgcgaaaaaaatctaaattacaaattttgggtttctagaaattattttaaat

SEQ ID NO: 31015 - DNA, 601 bp, Human
tggaaaaaaacttacctgagatctgtctattcgataaaagcgatcagcagaagttgctaggggaaaaaaaatgcagatggcattcagaatgttctgtaatctggcaccaaatttataaccttctcttcgactatgctggtcaaaacccctacatggcagtcatgctagtctcctggccagtccctaaatctattaagaaaacctcagcacttccatgcctctgccactgctattctaaggcttggaaagcccttccctttgcctctgccatctaaatcatacttgtctttaaagaaccagmtcaagtgcttctgcttctgtgaaacctttctcagtcccaacctcccaacaccagacagaacctgctgaccctgcatccatccacatttacattttttaaaacttcttatacagactatcttcacagataaccatgagactaagagacctgcctctttaaaaatctgtttcatttaatcttttatgcctcctgaaattagcaaatgatcttaaagtaagttaggaattagtatgtatttattaagtaaataaagctagaaaaagctacagttacgtagacttctcagtgaagtgacttccc

SEQ ID NO: 31016 - DNA, 601 bp, Human
tctgtactcatttgcaagattaagccacatcatcttgagtccataaatcataaaacacgtgaagacaaataaaaggttcaagcttaagttatgaacaccattccaaaatttgtgtctcagtggttttcgttagaaaaatttatgagattagctaccaataaagcacattaacttgggaatttttcactttcacaagcaggctggaaaaaaacttacctgagatctgtctattcgataaaagcgatcagcagaagttgctaggggaaaaaaaatgcagatggcattcagaatgttctgtaayctggcaccaaatttataaccttctcttcgactatgctggtcaaaacccctacatggcagtcatgctagtctcctggccagtccctaaatctattaagaaaacctcagcacttccatgcctctgccactgctattctaaggcttggaaagcccttccctttgcctctgccatctaaatcatacttgtctttaaagaaccagctcaagtgcttctgcttctgtgaaacctttctcagtcccaacctcccaacaccagacagaacctgctgaccctgcatccatccacatttacattttttaa

SEQ ID NO: 31017 - DNA, 601 bp, Human
gggagatagggagagatgaatccccttggttcaggatttccaattaaccaggactttttcttagatatatctagaaatggtcttgcctcatcttcttcccaaatactattagagaagtgacacccacatacaattggcccagcaggagtgtatgataagtggacttctaccccgtcatctggtcaaagctaagcagcatggttaacaactttatcattaggttcaatactgtacatttttctcctaggagaattcagataatgggaggaattcttaacttgggcaaaaccattttttttttctcatcactgacctccagggattggcgaactgaaactaagtagtctagttatacacctggggcctcaaacttgctaaacagaaatgagcttaaaaagacatgaaatttggctaaaaaggagtaaaaatatctttgtgaatgaaaatttggagtacaggctggtgataatgtctacaagtcaacttattttctgtactcatttgcaagattaagccacatcatcttgagtccataaatcataaaacacgtgaagacaaataaaaggttcaagcttaagttatgaacaccattccaaaattt

SEQ ID NO: 31018 - DNA, 601 bp, Human
aggagaagcacactcaccccgaggcttgttccaccaccaggtcaggcatgcccggaggtgtccccgccggctgtgacaccaccatatctgggtccagaataaaaatctcatcttgggaaatctccatcacaaagtgcaaatgttcctaaagaagaacaagaagtctgttgcatgaagaataacaaaacaagtattcttggtctcgaggaataatgaaattctgcaacgtgtcaaaggatcacactgtgttgtcagaagcttgatcagttggtgatcctccccaaagctgcgctaacgcagrcagtgggagatagggagagatgaatccccttggttcaggatttccaattaaccaggactttttcttagatatatctagaaatggtcttgcctcatcttcttcccaaatactattagagaagtgacacccacatacaattggcccagcaggagtgtatgataagtggacttctaccccgtcatctggtcaaagctaagcagcatggttaacaactttatcattaggttcaatactgtacatttttctcctaggagaattcagataatgggaggaattcttaacttgggcaaaaccattttt

SEQ ID NO: 31019 - DNA, 601 bp, Human
aagtactagtgctttctaggtttgttaggaagggttgctgtgatggggaaagaggcttggacatggtgtaaatctggttttgtgtttcttcacggccattcataagacagacttataataaccactctaaggaaacacaacaagaaaatctacacttcaaaatcatttgatgtcattagaacgatgtcaagttcaaaggcgaaccagacatggatgtcaccctaaggccagcctcacaggccaggagaagcacactcaccccgaggcttgttccaccaccaggtcaggcatgcccggaggygtccccgccggctgtgacaccaccatatctgggtccagaataaaaatctcatcttgggaaatctccatcacaaagtgcaaatgttcctaaagaagaacaagaagtctgttgcatgaagaataacaaaacaagtattcttggtctcgaggaataatgaaattctgcaacgtgtcaaaggatcacactgtgttgtcagaagcttgatcagttggtgatcctccccaaagctgcgctaacgcaggcagtgggagatagggagagatgaatccccttggttcaggatttccaattaaccaggac

SEQ ID NO: 31020 - DNA, 601 bp, Human
tatgtcatagttattattatataatctacatgtctccagcagcctggaaatagcaaagaagaggaagaggagaaaatttgtcaaatcacctgtgtcaatttttaatgtagataacagagttactacaaacgtacaagcacaaacacaagtactagtgctttctaggtttgttaggaagggttgctgtgatggggaaagaggcttggacatggtgtaaatctggttttgtgtttcttcacggccattcataagacagacttataataaccactctaaggaaacacaacaagaaaatctacayttcaaaatcatttgatgtcattagaacgatgtcaagttcaaaggcgaaccagacatggatgtcaccctaaggccagcctcacaggccaggagaagcacactcaccccgaggcttgttccaccaccaggtcaggcatgcccggaggtgtccccgccggctgtgacaccaccatatctgggtccagaataaaaatctcatcttgggaaatctccatcacaaagtgcaaatgttcctaaagaagaacaagaagtctgttgcatgaagaataacaaaacaagtattcttggtctcgaggaataa

SEQ ID NO: 31021 - DNA, 601 bp, Human
tgtatcaattcttttaatcgccaaacaattctctgagtgaggattattgttatttgtattttacagatgagaaaataagcacagagcacttaagatgattaagtcactatgaagcggtggtagaaacagaagagagacacaggacagagctcttaaaaagggcttggtatgtcatagttattattatataatctacatgtctccagcagcctggaaatagcaaagaagaggaagaggagaaaatttgtcaaatcacctgtgtcaatttttaatgtagataacagagttactacaaacgtayaagcacaaacacaagtactagtgctttctaggtttgttaggaagggttgctgtgatggggaaagaggcttggacatggtgtaaatctggttttgtgtttcttcacggccattcataagacagacttataataaccactctaaggaaacacaacaagaaaatctacacttcaaaatcatttgatgtcattagaacgatgtcaagttcaaaggcgaaccagacatggatgtcaccctaaggccagcctcacaggccaggagaagcacactcaccccgaggcttgttccaccaccaggtcagg

SEQ ID NO: 31022 - DNA, 601 bp, Human
aggccccatagaccagtaaaacactaaatttcacaaggacaaagattcttatctgtttttatttttgtactgttattccccaagtgcttacactaggacctggcacacaaaattctctaaataaatagtttttaattattgaaataacttagaaatactaattatgttttggtggtagaaggtggtagttaaatgcatgggctctggcatcaggtaacccaggactatatctcattttttctacttattttctgtgaaatattagacaagtaacataaccctttaggtctcaattttttawtctatgaattaaggataattgtaccaaattttcaaggtcactagaatgatggtgatgactattattattattgtaataacattctgtttaatgcatgttttaaaaatgccaggaatgactttaagtgctttacctgtatcaattcttttaatcgccaaacaattctctgagtgaggattattgttatttgtattttacagatgagaaaataagcacagagcacttaagatgattaagtcactatgaagcggtggtagaaacagaagagagacacaggacagagctcttaaaaagggcttg

SEQ ID NO: 31023 - DNA, 601 bp, Human
tatggtttctagagcaattcttacttcaacaattcaggccccatagaccagtaaaacactaaatttcacaaggacaaagattcttatctgtttttatttttgtactgttattccccaagtgcttacactaggacctggcacacaaaattctctaaataaatagtttttaattattgaaataacttagaaatactaattatgttttggtggtagaaggtggtagttaaatgcatgggctctggcatcaggtaacccaggactatatctcattttttctacttattttctgtgaaatattagrcaagtaacataaccctttaggtctcaattttttaatctatgaattaaggataattgtaccaaattttcaaggtcactagaatgatggtgatgactattattattattgtaataacattctgtttaatgcatgttttaaaaatgccaggaatgactttaagtgctttacctgtatcaattcttttaatcgccaaacaattctctgagtgaggattattgttatttgtattttacagatgagaaaataagcacagagcacttaagatgattaagtcactatgaagcggtggtagaaacagaa

SEQ ID NO: 31024 - DNA, 601 bp, Human
cctagtggactgtttattcatactgtatgagtctgtgtacacgatgtgcatttactatttgggcacattgtgtatggtttctagagcaattcttacttcaacaattcaggccccatagaccagtaaaacactaaatttcacaaggacaaagattcttatctgtttttatttttgtactgttattccccaagtgcttacactaggacctggcacacaaaattctctaaataaatagtttttaattattgaaataacttagaaatactaattatgttttggtggtagaaggtggtagttaaaygcatgggctctggcatcaggtaacccaggactatatctcattttttctacttattttctgtgaaatattagacaagtaacataaccctttaggtctcaattttttaatctatgaattaaggataattgtaccaaattttcaaggtcactagaatgatggtgatgactattattattattgtaataacattctgtttaatgcatgttttaaaaatgccaggaatgactttaagtgctttacctgtatcaattcttttaatcgccaaacaattctctgagtgaggattattgttatttgtat

SEQ ID NO: 31025 - DNA, 601 bp, Human
aaagtgaaaaaaagtaaatcaagtgacaaggggaaaacaggaatgaagatgacattgcagttgtgctagcctagtggactgtttattcatactgtatgagtctgtgtacacgatgtgcatttactatttgggcacattgtgtatggtttctagagcaattcttacttcaacaattcaggccccatagaccagtaaaacactaaatttcacaaggacaaagattcttatctgtttttatttttgtactgttattccccaagtgcttacactaggacctggcacacaaaattctctaaataartagtttttaattattgaaataacttagaaatactaattatgttttggtggtagaaggtggtagttaaatgcatgggctctggcatcaggtaacccaggactatatctcattttttctacttattttctgtgaaatattagacaagtaacataaccctttaggtctcaattttttaatctatgaattaaggataattgtaccaaattttcaaggtcactagaatgatggtgatgactattattattattgtaataacattctgtttaatgcatgttttaaaaatgccaggaatgactttaa

SEQ ID NO: 31026 - DNA, 601 bp, Human
gcttccctgttcctggtttagttcaggggaggcaactggtgagaaataagaaaggcactgattcaagtcctggtggattttcaggctactttatttttggagctagagctaacagaggtctagcaaggccaaagcatttggccattatttgacatgaagaaaacgaccatacaaaaaattagccaggcgtggtggcaggcgcctgtagtcccagctacccatgaggctgaggcaggacaatggcatgaacccgggaggcggagcttgcagtgagccaagatcgcaccactgcactccagtytgggtgacagagcgagactccatctcaaaaaaaaaaaaaaaaaaaaaaggaaaagaaaaagaaaatgaccaagtgagcaaagaccagggcaacttggcagaatggactttctccttactagatcaagagtcagagcccaggttaggtggggtaggaggacacccagactctagcacctgctgcttctgcagtaggacaaaacactctacctgctttccccactactgatgggtctgatgcatggatgtgccccacgaagttggccttccccaccacctttggggctcccaggggtgcatc

SEQ ID NO: 31027 - DNA, 601 bp, Human
acaaccagctggatatagtgatttcccacattgcaaatgattctttatttaaaagtacaaaaaaaagtgtgataataaactcaggatcttgggaaatcagttgcctgaactaaaagcatatagaaaataaaatggaagggtttcaaatgtacagtgctttgcaaaattttctggtgtagaaatccaccaagggcaggaatcaattttattcatgcctttgtttcccacaaaacctaatggaaggccttgcacagagtacaggatggtatgggcttaatccactggtaagaaacggcactgwactcatcaatatactgcttggagagcactcttctcttctgggtaacaatttctattgacactatgatctgtgcagtggcacaggcaccgttttcaggattatgtgcctaaagggggcagttgatcaagatgtttgcaaacattttcaccatttgttttcctctagtaacctgttgaaaaatgcagcacaggtgtccttcagtttgtccaacagatgcgcctaaaaaaagttatgtctgagggtaggactgttcagctttctcttagggctattggttccttgatctgcaatggcacctca

SEQ ID NO: 31028 - DNA, 601 bp, Human
aaatgtgaatacaattcagtcactgtgctcaaagccctcacagcccatggtggagacggataggtaaagaatcacacagtaatggacaggaacatcacaaaggtctcagagaagcactagggaagcatgaagcaggggatggaaacagccacggaagacctcccaggacatggatccaaagcagtagctgaatggaggtaaggacaatggaggtaaggaacatccctaaactggggggcaagagggcaggaagaagtagctagcaattttccacaaaactctaaaaggatatcctgttccrttcaactgcgttgtcttaaaatgacactccctttctttgtggggagatcgacaaaggatagcagcatgggacctgttcagggtcaactgccttgatcctgccttcctgtgctgtttctagacaccatgaacattcagttagtccacggacactttctgcagcccagttgtccaggagctatttgtgacagccttcacacaggggtggctccagagatgttctcttcgctagtctctatctctcgctctctttgtctctctctctctctctctttctctccctctctctcatacaaacata

SEQ ID NO: 31029 - DNA, 601 bp, Human
taaatgtgaatacaattcagtcactgtgctcaaagccctcacagcccatggtggagacggataggtaaagaatcacacagtaatggacaggaacatcacaaaggtctcagagaagcactagggaagcatgaagcaggggatggaaacagccacggaagacctcccaggacatggatccaaagcagtagctgaatggaggtaaggacaatggaggtaaggaacatccctaaactggggggcaagagggcaggaagaagtagctagcaattttccacaaaactctaaaaggatatcctgttcyattcaactgcgttgtcttaaaatgacactccctttctttgtggggagatcgacaaaggatagcagcatgggacctgttcagggtcaactgccttgatcctgccttcctgtgctgtttctagacaccatgaacattcagttagtccacggacactttctgcagcccagttgtccaggagctatttgtgacagccttcacacaggggtggctccagagatgttctcttcgctagtctctatctctcgctctctttgtctctctctctctctctctttctctccctctctctcatacaaacat

SEQ ID NO: 31030 - DNA, 601 bp, Human
tatgagagaagactggaaaaaaaaaacaaaacagaattttgtagcctgaggataaggtggctacatgaggatatggtctaagtttataaaatattgaacattacagaaaatgtgaatgagtccctcatctccaaactacagtatttcatgacaagagtgcctgcatgaagcttctaacaggtaattttaggacaaatgagaattaaataacccagcaggtaataagcaaaaggaacacattatctctcaagaagttagatggcacacattatagataatcaaacatcccataaggtgaaasagcataaatgacctaaatgcaaagaataagtcctagtgttccataccattgtaggatgactatagttaataatatattaaatagttttaaatagctagaaggaggatgttgaacattcccaacataaagaaatgataaatgtgtgaggtggtggatatgctaattaccctgatctgatcactgtatacgtatcaaaacatcactatgtactctattaatatgtataatcatttgtcaattaaaaatactttcttaaaaaaagaacctaaattcagagttcacgtcttcactcaaatacat

SEQ ID NO: 31031 - DNA, 601 bp, Human
actgtagctaagcttcttgcctgtgtccttcagtttttcttcagtcttatgaacctatataccaaatatcaaagctgcttctttttctcccatgtaagatcactgaatacaagtatagacacatacacacgcatgcatgcatgcacacacacgaacacacatctggcttccttcttcatccagatatgcagcccagcctgcaaaccttctgttaatcatccaacacatacctaataggctagagataatccacagagtgagacccaaaatgattcagaaaatgtagtagtttctatatgaragaagactggaaaaaaaaaacaaaacagaattttgtagcctgaggataaggtggctacatgaggatatggtctaagtttataaaatattgaacattacagaaaatgtgaatgagtccctcatctccaaactacagtatttcatgacaagagtgcctgcatgaagcttctaacaggtaattttaggacaaatgagaattaaataacccagcaggtaataagcaaaaggaacacattatctctcaagaagttagatggcacacattatagataatcaaacatcccataaggtgaaagagcat

SEQ ID NO: 31032 - DNA, 601 bp, Human
gaagctcaggcagaatccggaacaaggataacagctaaccggtaataaaatgagagtcatgtagcagaccacaatgtttccagccttagaggacatagagaaaagtcaaaaaggtgaagtaacattcctggactgtgttatcactcacagagatgaccagtgtctcttctaactctggagagagtctgtgggtattgaacaggctagggaaactgaatcatgctgaattacttttttcatttattttctgagcactggtctctatggtctctctctcgaaggagtagtgaggggtggagtkgagaacaaaagcatctctatgttggcttagcattctcctgagtgaaagagtaattatggctataagcagaaatagcttggtgactgtagctaagcttcttgcctgtgtccttcagtttttcttcagtcttatgaacctatataccaaatatcaaagctgcttctttttctcccatgtaagatcactgaatacaagtatagacacatacacacgcatgcatgcatgcacacacacgaacacacatctggcttccttcttcatccagatatgcagcccagcctgcaaaccttctgttaatca

SEQ ID NO: 31033 - DNA, 601 bp, Human
agcaggggcagagtctgctaaaagttcgagagtatttctgccattctgaaaactgcctggatgaagggtaacttagaaaatgcaaaatgcaatggatttcacaggtaagtgatccttggtaagttcactatgcctacttaccgtggtcaaggatatatttcacaatctccccgttgccggttttagctgcgtagtgaaggagtgaacagtggtctggtccctgaattagcagactgcctccatttttatagctttctattagctgcaagagagacatacaaaaagaagctcaggcagaatycggaacaaggataacagctaaccggtaataaaatgagagtcatgtagcagaccacaatgtttccagccttagaggacatagagaaaagtcaaaaaggtgaagtaacattcctggactgtgttatcactcacagagatgaccagtgtctcttctaactctggagagagtctgtgggtattgaacaggctagggaaactgaatcatgctgaattacttttttcatttattttctgagcactggtctctatggtctctctctcgaaggagtagtgaggggtggagtggagaacaaaagcatct

SEQ ID NO: 31034 - DNA, 601 bp, Human
gtcagtggtctgcaaccacgactgcctcaaataagcaggggcagagtctgctaaaagttcgagagtatttctgccattctgaaaactgcctggatgaagggtaacttagaaaatgcaaaatgcaatggatttcacaggtaagtgatccttggtaagttcactatgcctacttaccgtggtcaaggatatatttcacaatctccccgttgccggttttagctgcgtagtgaaggagtgaacagtggtctggtccctgaattagcagactgcctccatttttatagctttctattagctgcaagagagacatacaaaaagaagctcaggcagaatccggaacaaggataacagctaaccggtaataaaatgagagtcatgtagcagaccacaatgtttccagccttagaggacatagagaaaagtcaaaaaggtgaagtaacattcctggactgtgttatcactcacagagatgaccagtgtctcttctaactctggagagagtctgtgggtattgaacaggctagggaaactgaatcatgctgaattacttttttcatttattttctgagcactggtctctatggtctctctctcgaaggag

SEQ ID NO: 31035 - DNA, 601 bp, Human
tgccttagggcagtagggccccattttttcagaaactccagttgagaaagaataaatgtgatgggtatattaaaaggtaagtgtaattatttagacttctcaacattccaagatgcaccagtgcagaagtacattgtttgaagcaagctctaaatgatgattagcgctgactatggaggcaagcattatgacaattgtcatcaatttctattccgtaattttttatttaggctattagccctgcacatttatgaacaaagttgaaagtggactttgaattaattaagttaaaattacctaygatatgctctatagattacattcttctcccagatatgttctgaagaaaataacctagactatgtaataaaaggcaacactcacgtttcactgtctgccatatccaataactcggaaggtcctaaataagaagaaagcaagatgaccgtcaaaaataagctcaaaaactaaacattaacagaaaatctatagtcacagaattaaaatgccttggaaagctaaatttggggataggaataataagacagaaagaaaaataaaaggattcctctacctcctcatcaccaaactcccaatctcc

SEQ ID NO: 31036 - DNA, 601 bp, Human
gaaaaatcaatagcagcctttagagaaggcaaaatggggtaagtgatggcaccacttataatcttgccaataggatgtgctggcatgtggaccagctctatggagtgatagacagcttcttccacagctctactgcttctcttcgtcctccattctattcatttctacttctcctccttcccacatgcttagctactcaccacctcattcctctccacaccaactcatctttataccttttcaaatatggctttcaggattagttgtacagcctatctttgttcctgtttggggagcagtrgctatttcgctactttagaaataaggttgaaaacaaacattatcatcagtttaggcaccatcccagagctgatgactttttcaatcaggatcccttctctgaaccacagaagacagaaaatagagtgactatgttctcagttcttcagtggtggttcataacttgtcctgttctagactaacagagagaagttatgtcactacatgtgaataatgccttagggcagtagggccccattttttcagaaactccagttgagaaagaataaatgtgatgggtatattaaaaggtaagtgtaat

SEQ ID NO: 31037 - DNA, 601 bp, Human
gaggcagcagggaatgggtgaggggagctgatgtagggtgctcctcagcctccttccctgtaggctgctgagactttggctgtagggtacattctggggaggtagggaaggggatttctaaaaattccttgagctagccatcaactgatcataatatctgactctagccccctttccaaatagtgttgattaagtttagtaatttttttaaaagctactactatttgatttaggtgatagtcaatgcagtattaaacagactaattgtctagatgtatctgaatactgaagccattctcttctgtgcatacatttgagcagagcgagaaaggcactgggtgaaagaacagggagcagtgtggagcgcctctggcccttcaggcacagcacgcagcccttggttgatggccactcggcctgcagtggagtatctcctgagaacccaagttcaaagaaccaggccaacacccactctgctctatccactttagattctgtgtgagtggcaggtggaaggagggggcagccacagaggatatctgagaggcacagtgagaccctgggagagtttgagagccagggctctccccaggaggcagca

SEQ ID NO: 31038 - DNA, 601 bp, Human
ggcaggcagccttgtgcagtgcagtctcacccctaaatcaaagatgaaatgggaaaccacccataaaggggttggaggcagcagggaatgggtgaggggagctgatgtagggtgctcctcagcctccttccctgtaggctgctgagactttggctgtagggtacattctggggaggtagggaaggggatttctaaaaattccttgagctagccatcaactgatcataatatctgactctagccccctttccaaatagtgttgattaagtttagtaatttttttaaaagctactactatttratttaggtgatagtcaatgcagtattaaacagactaattgtctagatgtatctgaatactgaagccattctcttctgtgcatacatttgagcagagcgagaaaggcactgggtgaaagaacagggagcagtgtggagcgcctctggcccttcaggcacagcacgcagcccttggttgatggccactcggcctgcagtggagtatctcctgagaacccaagttcaaagaaccaggccaacacccactctgctctatccactttagattctgtgtgagtggcaggtggaaggagggggcagc

SEQ ID NO: 31039 - DNA, 601 bp, Human
ttaaaacacgttggagtaagtactgaaggaaaaccccaaaggggcttctcagtagtcaggccaaagtctttgaaaatggtcctgacccctctccttgggctttggacctcaactcccatgacttggctgctagcgctcagcaggacaaccccaaagtcccaaggtcaacgtgttcagaggtttataaagccccataggcaagcacacgccctccctttgtgcttatacatttaaatcacagtttctctaaatgaagcactctattttttcctcctttttccaaagccccaggcacttccakaagcacagaaaggatgtccgtgctatggtcacaagcaaaggcaacagcgcctgcgatctcgcccagcgggaggatgtttgcactcactcatcgagttaccttggagtccgtctttctcagagatgctcctgcatccaccagaagctggcacacagcccggttccgctggcaggcagccttgtgcagtgcagtctcacccctaaatcaaagatgaaatgggaaaccacccataaaggggttggaggcagcagggaatgggtgaggggagctgatgtagggtgctcctcagcctccttccct

SEQ ID NO: 31040 - DNA, 601 bp, Human
ttccctctatctttcaaccctttctcttgggtgctctctataaacttaaacaactcgtggtgcagcttgttctcagttctcctaaacagagtttcccctaaggcctcacctccgccagctgatgctatcaaggttggcatacatgtcacagtacaatatctggcctcactgccctcttattaagatagtcctaagaaagtggacactttaagttcagatttacataacttttgctgtggagaaaccaaccacatttcaagccaagtgccacaggtatcactgtacctcaacaaaacagacyccataaacaaaccgattttgttatgtggctggggtgttctggcaccaaatgagaaccaccaacctgctgatacaacactgggctggacgtcaaaagagctcaatttaatttaagcctcagctactggtccaagggtatgtgtaactttctctaggcttttagctcctatacctataaatgacagtaattcccatgctatctagtacctgaggttaacttttagagaataatattagaaaacaaatggaaagaattttttaaaaatgaagaactacataaacacaccagatttaagactat

SEQ ID NO: 31041 - DNA, 601 bp, Human
caacggaaattcgtaaactttcttaaaacatcgtaagatttgtgtgtgtgtgtgatttttattttttcagttcatcagctattgttagtgttagtgtatttcatgtgtggcccaagacaattcttcttcgtccaatgtggcccagggaagccaaaagattggacacccctgctctatggtgttgatcttctatgtaaactaactcctctttctctctcttctttcttataggctgagccctgggtcaactctactaagctacaactcctccttccctctatctttcaaccctttctcttgsgtgctctctataaacttaaacaactcgtggtgcagcttgttctcagttctcctaaacagagtttcccctaaggcctcacctccgccagctgatgctatcaaggttggcatacatgtcacagtacaatatctggcctcactgccctcttattaagatagtcctaagaaagtggacactttaagttcagatttacataacttttgctgtggagaaaccaaccacatttcaagccaagtgccacaggtatcactgtacctcaacaaaacagactccataaacaaaccgattttgttatgtggc

SEQ ID NO: 31042 - DNA, 601 bp, Human
tctaccgagagtgttctaaaactctcagagcttatcagaatcctctatggcaagcttgtccaacccacagcccgcaagccatatgcgacccaggatggatgcgaatgaggctcaacggaaattcgtaaactttcttaaaacatcgtaagatttgtgtgtgtgtgtgatttttattttttcagttcatcagctattgttagtgttagtgtatttcatgtgtggcccaagacaattcttcttcgtccaatgtggcccagggaagccaaaagattggacacccctgctctatggtgttgatctyctatgtaaactaactcctctttctctctcttctttcttataggctgagccctgggtcaactctactaagctacaactcctccttccctctatctttcaaccctttctcttgggtgctctctataaacttaaacaactcgtggtgcagcttgttctcagttctcctaaacagagtttcccctaaggcctcacctccgccagctgatgctatcaaggttggcatacatgtcacagtacaatatctggcctcactgccctcttattaagatagtcctaagaaagtggacactttaagttcaga

SEQ ID NO: 31043 - DNA, 601 bp, Human
ttttgctttttggagcatatcttcctacattactagttttctatgtgaggggtttataattataaaaacaagctatttccattttttttttaaaaaaagcagacacatacacaacacaaaacagaaagaagtttccatgaacattgagtcttttatctgattcagaaacttagaaagataaaaaagcagacctgctcaagagccaggtctcctgattcctgtttggtttgtccctctttttcatggcttctctctgtttttaaaatgatctgagttgagtgtaggaccagcctttgtgtgstaaagaggcagttgtgctgctgtggtctgagtggccctggcaagaccaaccctaccccataacctggctccattaatcctgaatataagttgtgtgtttctcaatcaggctaaacatcaaaacatctgagtgcaaataacatctgggaagaacatcacattgagaaattattacttttaatggcaaaaaccacaattacttttacaccaacctaattatctgccatttgaaatagtgtacccaattagctagccagacaggtaacagaccactagaaaccaggacacagctcaagtgtgt

SEQ ID NO: 31044 - DNA, 601 bp, Human
tacaagtttaatgatatctaggtctaggttgtgaggtttccagcaattttttgctttttggagcatatcttcctacattactagttttctatgtgaggggtttataattataaaaacaagctatttccattttttttttaaaaaaagcagacacatacacaacacaaaacagaaagaagtttccatgaacattgagtcttttatctgattcagaaacttagaaagataaaaaagcagacctgctcaagagccaggtctcctgattcctgtttggtttgtccctctttttcatggcttctcyctgtttttaaaatgatctgagttgagtgtaggaccagcctttgtgtggtaaagaggcagttgtgctgctgtggtctgagtggccctggcaagaccaaccctaccccataacctggctccattaatcctgaatataagttgtgtgtttctcaatcaggctaaacatcaaaacatctgagtgcaaataacatctgggaagaacatcacattgagaaattattacttttaatggcaaaaaccacaattacttttacaccaacctaattatctgccatttgaaatagtgtacccaattagctag

SEQ ID NO: 31045 - DNA, 601 bp, Human
acgttgagtgaaaagttatacgatatcatgtatgtatgacttcatctagttaaaaacaacaagagagaaaaacaggcatatctacatgtgaagggggatcattacaagtttaatgatatctaggtctaggttgtgaggtttccagcaattttttgctttttggagcatatcttcctacattactagttttctatgtgaggggtttataattataaaaacaagctatttccattttttttttaaaaaaagcagacacatacacaacacaaaacagaaagaagtttccatgaacattgagtcytttatctgattcagaaacttagaaagataaaaaagcagacctgctcaagagccaggtctcctgattcctgtttggtttgtccctctttttcatggcttctctctgtttttaaaatgatctgagttgagtgtaggaccagcctttgtgtggtaaagaggcagttgtgctgctgtggtctgagtggccctggcaagaccaaccctaccccataacctggctccattaatcctgaatataagttgtgtgtttctcaatcaggctaaacatcaaaacatctgagtgcaaataacatctgggaag

SEQ ID NO: 31046 - DNA, 601 bp, Human
tccttaaaaagtaatgaagtatagctatattatttcatgtggtaagacctctagaatataacgttgagtgaaaagttatacgatatcatgtatgtatgacttcatctagttaaaaacaacaagagagaaaaacaggcatatctacatgtgaagggggatcattacaagtttaatgatatctaggtctaggttgtgaggtttccagcaattttttgctttttggagcatatcttcctacattactagttttctatgtgaggggtttataattataaaaacaagctatttccattttttttttaaaaaaagcagacacatacacaacacaaaacagaaagaagtttccatgaacattgagtcttttatctgattcagaaacttagaaagataaaaaagcagacctgctcaagagccaggtctcctgattcctgtttggtttgtccctctttttcatggcttctctctgtttttaaaatgatctgagttgagtgtaggaccagcctttgtgtggtaaagaggcagttgtgctgctgtggtctgagtggccctggcaagaccaaccctaccccataacctggctccattaatcctgaatataagt

SEQ ID NO: 31047 - DNA, 601 bp, Human
gtatttttataaaaacaaaaccacaattcatttacatactgttttacaacctttcttagtaatatatcataaatttgtcattaattttttacatcaacatgttaaatgatcatataatttcttacagactactataatgccttttgtacacttatatacacacatatacacatatatttgtatatatatattgctattttttaaatgaggccactgaataagaagtcagcagtaaagggagaaagagtgtccattcttttgaatgcctgtatatattacttggcatcgctcaaaatttctmatttttgttgaatgataaagttttaactatttaaaaagttatgttaagttccaaaggaagggtagaggcatgatcattgtaccaaataaatagctccatgtacaaatgcacacaagtgttataaatattatcagagacttctcagctttcatctcggctatcccaacagatactggcgacctcaatccaacctgctctacatagcctactggggagaggacaaaagggaagtaacaatggctctagaatctttctaaaatgttacttattcacttgggatttagccgttaaccactagtt

SEQ ID NO: 31048 - DNA, 601 bp, Human
tcagacttgggctatttcatctctctaaaaactaagctagtttctcaatacaaaagtggtagatattgattaaagaaatcttggaaagcttgaaaagcacaaagaagaaaaggaatatccctaatcattccaccaaactaagataaccactactaaccttccattgataactagattttgtcttttatatgcctctatacgtatttttataaaaacaaaaccacaattcatttacatactgttttacaacctttcttagtaatatatcataaatttgtcattaattttttacatcaacatkttaaatgatcatataatttcttacagactactataatgccttttgtacacttatatacacacatatacacatatatttgtatatatatattgctattttttaaatgaggccactgaataagaagtcagcagtaaagggagaaagagtgtccattcttttgaatgcctgtatatattacttggcatcgctcaaaatttctaatttttgttgaatgataaagttttaactatttaaaaagttatgttaagttccaaaggaagggtagaggcatgatcattgtaccaaataaatagctccatg

SEQ ID NO: 31049 - DNA, 601 bp, Human
gcgagttttgaaacccagagcctttctggaagatggggaggtagaaattactgaatttaaaaaatagggaggcaggcatttagatttctagtttaggactctttctattattctaaacttgggaaatcaacatacagaaactaaaaggaagggatagtcataaaaaaattgaaaggttttctttattggtttcagacttgggctatttcatctctctaaaaactaagctagtttctcaatacaaaagtggtagatattgattaaagaaatcttggaaagcttgaaaagcacaaagaagaaraggaatatccctaatcattccaccaaactaagataaccactactaaccttccattgataactagattttgtcttttatatgcctctatacgtatttttataaaaacaaaaccacaattcatttacatactgttttacaacctttcttagtaatatatcataaatttgtcattaattttttacatcaacatgttaaatgatcatataatttcttacagactactataatgccttttgtacacttatatacacacatatacacatatatttgtatatatatattgctattttttaaatgagg

SEQ ID NO: 31050 - DNA, 601 bp, Human
gattccaatggtggtttgcactaaggactttctgaaaagggaaaaataaagtagataaaataatatattagactaccccatacatagaaaatggggttatcaagtacgacctttggacctgacaaataatagttgaagcatccttctgaatgatccaggcatcccataaatctggcagtggaactcatacaacaagcctttgttcttgggtcaaggattacttggagtaatgaaaaccaaaaacctaaaagaaagacctaaaatggggctcctctcaccactgtatccaacagtctatagytattagcctctgtgcaacattccaatgactgtttcctatttcagtgacatatgttgacatatgttgctacttttgcttttgctgttttttttttccaagtcaattagggtgctttctattatcattcaacaaagtttagaagtaaacattgttagagtgctccatttcctgtaaccacagttcccacacaggattatttgctctgcaatttaaacagcacttaaaattgagtggttctgcaaactagctgtgggcctctgtttaatcctttgctcatcttctattgcagcaaaaggcaaa

SEQ ID NO: 31051 - DNA, 601 bp, Human
ggctagattccaatggtggtttgcactaaggactttctgaaaagggaaaaataaagtagataaaataatatattagactaccccatacatagaaaatggggttatcaagtacgacctttggacctgacaaataatagttgaagcatccttctgaatgatccaggcatcccataaatctggcagtggaactcatacaacaagcctttgttcttgggtcaaggattacttggagtaatgaaaaccaaaaacctaaaagaaagacctaaaatggggctcctctcaccactgtatccaacagtcyatagttattagcctctgtgcaacattccaatgactgtttcctatttcagtgacatatgttgacatatgttgctacttttgcttttgctgttttttttttccaagtcaattagggtgctttctattatcattcaacaaagtttagaagtaaacattgttagagtgctccatttcctgtaaccacagttcccacacaggattatttgctctgcaatttaaacagcacttaaaattgagtggttctgcaaactagctgtgggcctctgtttaatcctttgctcatcttctattgcagcaaaag

SEQ ID NO: 31052 - DNA, 601 bp, Human
aagagaggtacctgtaagtaccattcgatccgtggcaggtttagatgttacaattctaactatctgacagacatttctggctagattccaatggtggtttgcactaaggactttctgaaaagggaaaaataaagtagataaaataatatattagactaccccatacatagaaaatggggttatcaagtacgacctttggacctgacaaataatagttgaagcatccttctgaatgatccaggcatcccataaatctggcagtggaactcatacaacaagcctttgttcttgggtcaaggaytacttggagtaatgaaaaccaaaaacctaaaagaaagacctaaaatggggctcctctcaccactgtatccaacagtctatagttattagcctctgtgcaacattccaatgactgtttcctatttcagtgacatatgttgacatatgttgctacttttgcttttgctgttttttttttccaagtcaattagggtgctttctattatcattcaacaaagtttagaagtaaacattgttagagtgctccatttcctgtaaccacagttcccacacaggattatttgctctgcaatttaaacag

SEQ ID NO: 31053 - DNA, 601 bp, Human
taagagaggtacctgtaagtaccattcgatccgtggcaggtttagatgttacaattctaactatctgacagacatttctggctagattccaatggtggtttgcactaaggactttctgaaaagggaaaaataaagtagataaaataatatattagactaccccatacatagaaaatggggttatcaagtacgacctttggacctgacaaataatagttgaagcatccttctgaatgatccaggcatcccataaatctggcagtggaactcatacaacaagcctttgttcttgggtcaaggrttacttggagtaatgaaaaccaaaaacctaaaagaaagacctaaaatggggctcctctcaccactgtatccaacagtctatagttattagcctctgtgcaacattccaatgactgtttcctatttcagtgacatatgttgacatatgttgctacttttgcttttgctgttttttttttccaagtcaattagggtgctttctattatcattcaacaaagtttagaagtaaacattgttagagtgctccatttcctgtaaccacagttcccacacaggattatttgctctgcaatttaaaca

SEQ ID NO: 31054 - DNA, 601 bp, Human
aagagccgggcgcagtggctcacgccggtaatcccagcactttgggaggccaaggcaggtggatcacaaggtcaggagattgagaccatcctggctaacacgcggtaaaacatcatctctactaaaaatacaaaaaaattagccaggcgtggtagcaggcacctgttgtcccagctactcgggaggctgaggcaggagaatggcgtgaacccaggaggcggagctggcagtgagctgagatcacaccactgcaatccagcctgggcgacaaagcaagactctgtctcaaaaaaaaaaaaagaaatcaactcaggccaagtgtggtggtgcacacctgtagtcccagctactgggaaagctgaagaagtgggaggatagcttgggcccaggaggtggaggctgcagggagctgagatcgtagtactgcactccaaactgggcagtagagcaaaacccagtctcaaaaaaaaaaaaaaaaaaaaaaatcaaccgcaagacacccgctcaacagacacgtgtgcagtataccgctcccactccaagggtcctctggacctgtgcccctcctcttcacagctacatcatatcacttctacccaaa

SEQ ID NO: 31055 - DNA, 601 bp, Human
tttcaacattaaacagagaccaagagagaaatggttccaacatttcaccacatatatttcttcttacgcagtctaagctgagaatgccatgtaaatgggtcactgcgaaatgcagcaatttaatttttctccaatcaaaataagaaacaaaccagtatgatctcacttctattaacttttgaaggtttacagcagttaaagtatttttgcttctatgtatgaaggttaaaaaaatcattttttttcataaaatacaagagcaaccaatttcaccatccagtaaaagtaaaaactgggattmttttttaaattagtccaaagtggcgtttaggaacttagttgtaggctgctgcgctgacaccatgacaaaccaaagtgtagggctgggtctggttttgtttcggttttcttttcaatatccaatgctcatggattaagttctggaaatgttccaattgtaaggcagggatctgtttggattccaccatgggtatgctccttgggttggatgctggagggtgaggcacgttttgccggacccatgtcgactacctagtagtcatcaaggtcaaaaaattcatcgtctcctccttggtattcc

SEQ ID NO: 31056 - DNA, 601 bp, Human
gccggacccatgtcgactacctagtagtcatcaaggtcaaaaaattcatcgtctcctccttggtattccattccctggaaatctactcggtaccgcaagatacctggggaaacaaaccaaaaggtaaattacctgtgttcatgggatgggcatgtgtgtaggtggctggtaagggaataagggaagccctattctcttgcagaattgcagaaagcaaagaggtaataataaacatgggtccaaattaggaacctgcacctgctgcgtcaatcacctatcccagcagataataagcacctcrccggaagcagggctagggctagccaggagggaccttgacctgagaccctggttttaagtttggtttgctgatttgctactcacctccaattccaccaaatcctttcacaaactgagacccttcttgtgatttatctgtgacaatttccaacgtagctccaaattttttatagttgttagcaaaccattccaacaggggcatgctctcgataagctcatgttcctgtccggtctacagggatgaccatgagatacaaaaatgggggattaggatatatgaaggctaattagtccctctcac

SEQ ID NO: 31057 - DNA, 601 bp, Human
catttctataaaaaaaattaggctgcctggcatggtggctcacgcctgtaatcccagcattttgggaggctaaggcaggtggatcacctgaggtcaggagttcgagaccagcctggccaacatgatgaaacccagtctctactaaaaatacaaaaattagtcaggcgtggtggcgggcgcctgtagtcccatctactcgggaggctgaggcaggagaattgcttgaactcgggaggtggaggttgcagtgagccgagatcacaccactgcactccagcctgggtgacaagagcaaactccmcctcaaaaaaaaaaaaaaaaaaagggaatgagggcttgtgcctgtactcctggctactcagtagactgaggcagaaggattgcctgagcccaggggttcgaggttatagtgagctatgattgtgccactgaatccagcctgggtgacagaccaggaccctatctcaaagaaaaaaaaaaaaagaccggtcatggtggctcacacctgtaatcccaccacttgggaggccgaggtaagtggattgcttgagctcaggagtttgagaccagcccagggcaacatggtgaaaacgcctctcta

SEQ ID NO: 31058 - DNA, 601 bp, Human
cactgaagtctaaatatggggaaggagcccaatttaatcaaaagctgctcttaaagtgaacagcactgccaattatatcacacattttattagacctactataggacaactcattaagtgcaaacaaaaataagttattgtggaggaaaggggggaccactggctcctgccaaataaggtagtagaggttaagacgggctggggagggtggctcacacctataatcccagcactttgggaagctaggagaggcagacagcttgagtccaggaattctgagaccagcctaggcaacatggtraaaccctgtctctaccaaaaagtacaaaaattagttgggcatggtgacacatccctgtagtcccagctacttgggaggctgagctgggaggatcacttaagcctgggagatcgaggctgcagtgagccatgattgccactgcactccagcctaggcaagatagccagacccagtctcaaaaaaaaaaaaaaaaaaaaaaaaaatatatatatatatatatatatatatatatatatatatttttttttttttttaaaggcaatttctttgggggaccttctaccataaggctacttcctc

SEQ ID NO: 31059 - DNA, 601 bp, Human
taactaaacgttcagcataaactgctacttgttttcagagagcgactactaagtctatgtcaagagaggagctgtaagtaccaatgaggcaccagtcattacaggaggcttctctccccatcatctggattcactcccctcacatcatactgttttctctctctctcttttttgagacagagtctcactctgtcgcccagactggagtgcagtggcgcaatcttggctcaatgcaacctccgtctcccgggttcaagcaattctcctgcctcagcctcacaagtagctgggattacaggcrcccgtcacatttttgtatttttagtagagacagggccgggctggtctcgaacttctgacttcgtgatccacccggctcggcctcccaaagtgctgggattacaggcgtgagccaccgcacccggcccaccatactgttttcttattgctagacacaaagtaagtgggttcatgttctcctcctgtattaccgtgtttctttgggagatccacagtgaatttgtgcaggacttctcttgtgtttccttggagtgtgccaaaaagtgcaccactaccatctattacaatgaatccaaacttg

SEQ ID NO: 31060 - DNA, 601 bp, Human
taagtgggttcatgttctcctcctgtattaccgtgtttctttgggagatccacagtgaatttgtgcaggacttctcttgtgtttccttggagtgtgccaaaaagtgcaccactaccatctattacaatgaatccaaacttgctatcatctgaaagtagtgctgtaagagcctgaaaagcaaacacaagtaccacacggtgaatcccaaagctttgctaaggtcaaaaaaactctgaaaggatatatacaagccctttcactccactcaccatgctattagcactgtgggaaaaccttctayggaataatttatagacttcagttataaacatgtaactcttatggacaaatttgaacccaataaggaaataacgaatgatatctatgtgaagcttttcaacacatttgacatgggcatgtaaatataaaaccacaaagatatctgtatgcccatgtttatagcaatattacatacagcagttaatactactcaatctcaaaaaggaagaaaattttgaaacacactacaacagggatgaaacttgaatacatgctaagtgaaataaccctgtcaaaaaaggacaaatactgtatgactcca

SEQ ID NO: 31061 - DNA, 601 bp, Human
ggatgaaacttgaatacatgctaagtgaaataaccctgtcaaaaaaggacaaatactgtatgactccacttatatgaggttcctggagtaatcaaaatcagagacaaaaagtcaaatggtggttgccaggggctggaaaaaagggggaacaaggaattattgctcaatggatacagtttcagttttataatatagagttctaagctgggtatgatggctcacacatgtaatcccagcactatgggaggctgtggcaggcagatggcttgagctcaggagtttgagactggcctgggcaacrtagcgaaacactgtctctacaaaaaaatacaaaaattaggtggctgtggtgacacgtgcctgtagtccctaccagctacttggaaaggctttagtctgggaggtgtaggttgcagtgagccaagattgtgccagtgtactccagcctgggtgatccagagaccttgtctcaaaaaacaaaaaaactttaacttgttccttttttttttttttttgagacagggtctcactttgctggccaggctggagtgcagtagccatcatagctcactgcagcctcgaagtcttggactcaaatgat

SEQ ID NO: 31062 - DNA, 601 bp, Human
gatcactcgaggtcaggagtttcagaccagcctagccaacatggtgaaatctcatctactaaaaatacaaaaattagttgggcgtggtggtgcacacttgtaatcccagctactcaggaggctgaggcaggacaatcacttgaattcgggaggtggaagttgcaaggagccgagatcgtgccattgcactccagcctgggcaacagagcaaaactcaatctcagaaaaaagaaaaagaaaaagaaaaaagacatgaatatgaatattgcacgttaataatatagccttatcaaaatgaccygttaggtagattgaagtttttaataaatctgcttatcagggaataggcatatcccttattagaatatataattaccctgataaacaggatataaccctctcagttaaagctaaaatgtacaaagttagcaagattaaacagtatcttagaaaaggagttaaggtttggaaaaaagccaacaaggctaactcagtaagtgagcaaaagccagacaacatgggtacctggcactgtttaaatcaacaagattcaaaatcggctttcatccaaccagatacaggtaagtggtttcagtggctg

SEQ ID NO: 31063 - DNA, 601 bp, Human
tgcagtcgaccaagatccaactataaatggacttcccatcaagttagcaaaaatcatccactgtaaactgtcgacaaatgtcagttctaattccactgtagaggtttttccctaggttgatgaaaggcaagagaatgaactaaggagccagctgtgaattcttgattgttctactgttgactgatttaggtcactctaatgaggtttcctttccactgttcaagttcatcctatggcagctttgtcactcaaaagtttcaggggaaaggggggaaaatgagttcttacagttctgctactaaaaattttacaattgttatgtgaaaactgagtgcaataactcaaagagtataactggactgcttgtaacacaatggatatacgcttgaggaaatgggtaccctattttccatagtgtgatagctcacattgcatgcctgtatcaaaacatctcatgtaccccatatacacctactatgtacccacaaaaatcaaaacacacacacacacacacactttgggaggctgaagcgagcagatcacttgaggccaggagtttgggacaggcctggccaacatggcaaaactctgtctctactaa

SEQ ID NO: 31064 - DNA, 601 bp, Human
aatgaggtttcctttccactgttcaagttcatcctatggcagctttgtcactcaaaagtttcaggggaaaggggggaaaatgagttcttacagttctgctactaaaaattttacaattgttatgtgaaaactgagtgcaataactcaaagagtataactggactgcttgtaacacaatggatatacgcttgaggaaatgggtaccctattttccatagtgtgatagctcacattgcatgcctgtatcaaaacatctcatgtaccccatatacacctactatgtacccacaaaaatcaaaaaacacacacacacacacactttgggaggctgaagcgagcagatcacttgaggccaggagtttgggacaggcctggccaacatggcaaaactctgtctctactaaaaaaacacaaaaaattagccaggcatggtggtgcacacctgtaatcccagttattcaggaggcttgaggcacaagaatcgcttgaaccatggagatggaggttgcagtgggccaagattgcaccactgcactctagcctgggcgacagtgtgagactctgtctcaaaacatgctgaatgactagtgtcataataaat

SEQ ID NO: 31065 - DNA, 601 bp, Human
tcactatgggattcattacaggtaagccatttagtcttcagcttattcttaactcttctgttattttcaaagctctatgagaagaatgaacaacagaaaattcttattttctttgaatttatttttttataaacaatgcagttttaaagtattttcatctagtacattgaaattcaagctatataatgggcaaacatttcatttttaaaaaaataaaaaattatcagacaagttacatgttatcatataaatttaaaaagaaaacagctttagtttgctttttttccttttttgctttttwctcttcagccaatggagatggtgttgttggacacagactttctgatgtaaataaataccttcgttattataaaacttattttcatgacttatctgcatttgcagtatctgactttccactcataatatgttaaaacgatgccagagagatattttctggatgcactgatttagctttaacaataaaattattgttacttgttctgattagtggtagagctcattaaccgtgttccttctttttcttactgaaatgatcctgtttaaaagctcagtgagccacactttcttctaacacaaa

SEQ ID NO: 31066 - DNA, 601 bp, Human
agagatattttctggatgcactgatttagctttaacaataaaattattgttacttgttctgattagtggtagagctcattaaccgtgttccttctttttcttactgaaatgatcctgtttaaaagctcagtgagccacactttcttctaacacaaatattaaaaatgacctactgtcacttgatgatagttgtttctcatgcacatatctattgactcaaaatgaccacaatatgtacacccggaaagcactatttttattagtctaaataaaaaattgcattacaaatttatattcaacrtattaggaaaaattggacttcaatatataaagagactgaatcttttctttctgcccagagataaaaaggcaaacatatttacactcatgtaatcttacactcatgcatcatttgatgaaaaacatgtattgaagcttacagtaatagtgatgttaaaatctttctctttacaatctatccacatctctctccttttttgatataacaaaatgcatttaatattgtaaatgaaaaccgtcttatatgtaagcattatcatagtgaagagagtgccttttcttttgtgtagagaaattgact

SEQ ID NO: 31067 - DNA, 601 bp, Human
gagataaaaaggcaaacatatttacactcatgtaatcttacactcatgcatcatttgatgaaaaacatgtattgaagcttacagtaatagtgatgttaaaatctttctctttacaatctatccacatctctctccttttttgatataacaaaatgcatttaatattgtaaatgaaaaccgtcttatatgtaagcattatcatagtgaagagagtgccttttcttttgtgtagagaaattgactactgcatttgactgtagaagtcgggatgcgcctacaagtagggaaaagatgattttgytatttccttcactacagatatcaatggcattattggtgtttcaacttagaattgtattcctttggctcttaaatactttgatgcccccaaattcaattattaagtccatctatgagggatttactttaaatcattatcagcaaatactttgactttggtttccaaaagtagacagatctagcatttaaacttgacacatatgatctgtgtgatcatgggtacgttaacctccttatactttcgttgtctataaaattagataaataatagctctttttaaaggagttattagaaaaatgt

SEQ ID NO: 31068 - DNA, 601 bp, Human
ttatcatagtgaagagagtgccttttcttttgtgtagagaaattgactactgcatttgactgtagaagtcgggatgcgcctacaagtagggaaaagatgattttgttatttccttcactacagatatcaatggcattattggtgtttcaacttagaattgtattcctttggctcttaaatactttgatgcccccaaattcaattattaagtccatctatgagggatttactttaaatcattatcagcaaatactttgactttggtttccaaaagtagacagatctagcatttaaacttgayacatatgatctgtgtgatcatgggtacgttaacctccttatactttcgttgtctataaaattagataaataatagctctttttaaaggagttattagaaaaatgtaaaaaatgaatacgtagtactttagagtacccagaattttgatgatcataaataaatatttgcaaataatcataataccatttatataatatcttacagttctaaaacttactttattttggcaaaatctttttgtgttgttaggtgaagtcaagctcaggaagtctaagtgttttgcccagtaatataaaatag

SEQ ID NO: 31069 - DNA, 601 bp, Human
gtacccagaattttgatgatcataaataaatatttgcaaataatcataataccatttatataatatcttacagttctaaaacttactttattttggcaaaatctttttgtgttgttaggtgaagtcaagctcaggaagtctaagtgttttgcccagtaatataaaataggtacctatttggagtagatcagttctattgatttcaagcctatgtttgtttaaccatgccagaatgagaaagagatggcaactatttccaaatgaaaatatggattaagatttgaaggcaaaagttccaggygacagaatggggaaaatgattgatataagattaaaaaaaaaaaaaccttaagctctgaaacataatacctggattttaatttgggttcttctacttacaagctacttgaccataggctggtcagttttgttatttataaatcggatttaattacactcattctgcatatctcacaggtatggctgaggtatagcgttagagaacatgctgtcctgttactctccaaagcatgttcttgttccttcttgtcagcttttaggggtcctcttacttatagaaaatgtctgtattaaagggttg

SEQ ID NO: 31070 - DNA, 601 bp, Human
gagaacatgctgtcctgttactctccaaagcatgttcttgttccttcttgtcagcttttaggggtcctcttacttatagaaaatgtctgtattaaagggttggagtatttgtacacagacctgtgtatttcacaactggaatacttaaccaccttacagaactgtttcaatctaggtaaattagttaatatagaagaactcttacctctctagcccctaaaataaatatagagtaattcctagtttaagggaaaacaagagatagtttatataagcccaattttatataaaccaatgtactttttttttttttgagacagaatcttgctctgtcgccaggctggagtgcagtggcatgatctcggctcactgcaatctccgcctcctcagtccaagcgattctcttgcctcagcctaccaagtagctgggattacaggcatgtgccaccacacccggctaatttttgtatttttagtagagacggggtttcaccatgttggccaggatggtctcgatctcctgacctcatgatccatctgccctggcctcccaaagtgctgggattacaggcatgaaccaccactcccggcctaaatcaat

SEQ ID NO: 31071 - DNA, 601 bp, Human
acagaactgtttcaatctaggtaaattagttaatatagaagaactcttacctctctagcccctaaaataaatatagagtaattcctagtttaagggaaaacaagagatagtttatataagcccaattttatataaaccaatgtactttttttttttttgagacagaatcttgctctgtcgccaggctggagtgcagtggcatgatctcggctcactgcaatctccgcctcctcagtccaagcgattctcttgcctcagcctaccaagtagctgggattacaggcatgtgccaccacacccrgctaatttttgtatttttagtagagacggggtttcaccatgttggccaggatggtctcgatctcctgacctcatgatccatctgccctggcctcccaaagtgctgggattacaggcatgaaccaccactcccggcctaaatcaatgtactttttaaaggatcttatttattacaattgctcagtagtgccttagtgagctacaagaggtaatttattttccaaaggtgatactcaacactgccaaggaactccctagacagtgggactttggctcatataaacaatcagtgttaatccct

SEQ ID NO: 31072 - DNA, 601 bp, Human
ggggtttcaccatgttggccaggatggtctcgatctcctgacctcatgatccatctgccctggcctcccaaagtgctgggattacaggcatgaaccaccactcccggcctaaatcaatgtactttttaaaggatcttatttattacaattgctcagtagtgccttagtgagctacaagaggtaatttattttccaaaggtgatactcaacactgccaaggaactccctagacagtgggactttggctcatataaacaatcagtgttaatccctgaattaaaactatgtttcaagcaaaaamctcctttttacttagcacacaagtgcatctatatacattaaatgtggactgtgagggatgtacagcatgaaatttttgttatttgcatagtattgaaacaaatgtttgtggggagacataagattgttacaaattacgacctttttagtctgtttataattcttcaatgccgaaaggaaagtattcatttttatattgccctcttgctcacaaggaagaaatctattctatatatgtgtatataagtatatgtcaagaggaaaggatctgaggaattaaatgattttaattgagaactaa

SEQ ID NO: 31073 - DNA, 601 bp, Human
tccatctgccctggcctcccaaagtgctgggattacaggcatgaaccaccactcccggcctaaatcaatgtactttttaaaggatcttatttattacaattgctcagtagtgccttagtgagctacaagaggtaatttattttccaaaggtgatactcaacactgccaaggaactccctagacagtgggactttggctcatataaacaatcagtgttaatccctgaattaaaactatgtttcaagcaaaaacctcctttttacttagcacacaagtgcatctatatacattaaatgtggamtgtgagggatgtacagcatgaaatttttgttatttgcatagtattgaaacaaatgtttgtggggagacataagattgttacaaattacgacctttttagtctgtttataattcttcaatgccgaaaggaaagtattcatttttatattgccctcttgctcacaaggaagaaatctattctatatatgtgtatataagtatatgtcaagaggaaaggatctgaggaattaaatgattttaattgagaactaataattttgtcctagtttcaacctattgtacgactgttgatatatcagta

SEQ ID NO: 31074 - DNA, 601 bp, Human
agcatgaaatttttgttatttgcatagtattgaaacaaatgtttgtggggagacataagattgttacaaattacgacctttttagtctgtttataattcttcaatgccgaaaggaaagtattcatttttatattgccctcttgctcacaaggaagaaatctattctatatatgtgtatataagtatatgtcaagaggaaaggatctgaggaattaaatgattttaattgagaactaataattttgtcctagtttcaacctattgtacgactgttgatatatcagtagaaattctcaatttyatttttgtgctttaaaattaaaggaattaaacttgaaatgaaactgtcgtttcaagtgttcagttatgaaaaccttattgttttgtgcaattacatttataataatcaaaatgtactatatgatattgcgtttttaattctgcctttcccacttgaatgtacattttgaggagtaatttcttttgtgagtgccataatgtgtttgtgttttcccccacttttgttttgttctttttaggtttaggtttagccttcaacctgcaacccgccttaaccataattggcaaatacttctatagg

SEQ ID NO: 31075 - DNA, 601 bp, Human
tgttacgtcttacatagttgcagcacagcagtgaaaagtagggagtgtgtggtttctatttcatatttgtttttttcagactgaactttcactgctcctctcagaaagaattgaagctttagttctggaaagcatatctggtttcttgatgatgctaaaaaattcttttttttttcttattagaggtattaggctaattattatttaatccttaaaatatttcttttattattttttattttattattattagactttaagttttagggtatatgtgcacaatgtgcaggttagttacatrtgtatgcatgtgccatgctggtgtgctgtacccattaactcgtcatttagcattaggtatatctcctaaagctatccctccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccagtttcatccatgtccctacagaggacatgaactcatcattttttatggctgcatagtattccatggtgt

SEQ ID NO: 31076 - DNA, 601 bp, Human
agttctggaaagcatatctggtttcttgatgatgctaaaaaattcttttttttttcttattagaggtattaggctaattattatttaatccttaaaatatttcttttattattttttattttattattattagactttaagttttagggtatatgtgcacaatgtgcaggttagttacatatgtatgcatgtgccatgctggtgtgctgtacccattaactcgtcatttagcattaggtatatctcctaaagctatccctccccctccccccaccccacaacagtccccagagtgtgatgktccccttcctgtgtccatgtgttctcattgttcaattcccacctatgagtgagaatatgcagtgtttggttttttgttcttgcgatagtttactgagaatgatgatttccagtttcatccatgtccctacagaggacatgaactcatcattttttatggctgcatagtattccatggtgtatatgtgccccattttcttaatccaatctatcattgttggacatttgggttggttccaagtctttgctattgtgaatagtgccgcaataaaaaattcttaaaacatttagaaagtatgct

SEQ ID NO: 31077 - DNA, 601 bp, Human
aataagaggaatatactttgaagaataatttatttgaatttttatcattatatgactgttttattatgccaacttaaaagatgttctttgtcttctaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaaygtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactct

SEQ ID NO: 31078 - DNA, 601 bp, Human
attttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatggagaattctgaatcccaaacccctggtttaagtaggtagaaggaggatgcctaatcctacaaagtgaccctttatacatttcattttttatttgatattaaagtatgagatagagttgaragacaattaattatcccctcttacacacaaacacacatactcccacatacttacccacatgtacacagagtatctggagaataaaacccaaattcaaaaaaaaaaatgataatttatttttaaggtaaaaataatccatgaagataaaagaaacatatgtctgcgtgctactttacaatgttggttttaaagataagcacatgggtaaaaatgagggtgatccttattcaaaaataacatctgactactataaaaatatttgcatatataagtttgacaaagaaaagaaaatcaatgtta

SEQ ID NO: 31079 - DNA, 601 bp, Human
ctaatttttttattaataaaatctgtttttgtgttcctggccctgacacataaagagctagcaggaatagaatctttcctttctggcaagagaggcccctgctttcttcctgatctccatctcatgaccttttgaaaggtacatctgtaccccctggtccccacagcaagctgactggaggaccagttcatccttgctgaggggttggttgataaaggtttgtggagccttgcaggggaatctgtggtttaacaagacaatctagaaagtggaaagaccaaagcattcaaaggaaagacaytttaatgacaaaatttcaggcatgttgaaatagaatatcaggaaaatggaaaatttggagcaagaaccttacaagcactccccaagtcccaccatattagatggacatcacctttctgaaggtcagtgaacactcaccaatgcaccactgtctccccaacctttctttggccctcagtaaactgacctctgatccattcagagtggctaaaatttcacacctgaaagcatgactagagatttggtactccagaaatgaagtgaaagaaagcaatatttactgaaggtctaggaggtacct

SEQ ID NO: 31080 - DNA, 601 bp, Human
cctgaaatggaaatctccgtaaaattcctcatgaactaagcactgatggccacccgtcctcggtatcaacgagcagactttagacaaatgttctcaccagcaatctgcatagcagatgttgagttaaaactacactatctattatgtctgtgaatggaacagttttgtagtttcaattatgttagtgccactaacacaacacattttccccctgaaaatgcattttgaaatattttacaaatgcctaataatgctttaaatatctaaggccataaaactaaataagccacagttaggtcaygtaaatatactgaataacctttaacatcttaagggtgtaaaaagtcttttatagctgggctctaaaatgtacatgttttaaagtgataaatcccagctctccctcaggcaacctgaatgcaaaatgtgatggaaccccggtgtgttttctaaatgcactcctcttccgacctttcgtcataaactgagactaaacatctctcctcaaaataaaactttaggtggtgaatgggctttcttagtagtttttgtattcatgcttgctctgtattgttggagactcataatcatcagatatctg

SEQ ID NO: 31081 - DNA, 601 bp, Human
tgaaagaatcattaatacttttttattggttgaaaagggaacacagatgttgcacaaggaaacatttaaaagtatcatctaattgactggaatggattcagaatcaatatgtcattctctgtacagtgaggcaactgcctccccacccttgctgacattgtatatactcaacagtttttactaagacaaatgataaaataaaaagaaacgtaaggggtccactcccacctatataagagaaacttgagttttctgatgccgtagggattctcaggaggaagctttgctccttttacttcaygccaatttgatcaatagtgtttactgaatacccactgtgtacagaaaaatagcattcccatgtatggcgcaggaggcaaccgcagttcgcaagggactctgggctgcttgacactgtacaagcatgaaaattgcctgctgtttggacacttagttttactacatcctgaaatggaaatctccgtaaaattcctcatgaactaagcactgatggccacccgtcctcggtatcaacgagcagactttagacaaatgttctcaccagcaatctgcatagcagatgttgagttaaaactacact

SEQ ID NO: 31082 - DNA, 601 bp, Human
gctggagtcacagtccactaacttcctttagtatgtcccaggtaccccagaggccactcaagaagttactcctggagcatgggcagaaatctaaatggacctagctgccaaagactatgccggaacaggaccacagaaagacatcgttattgtgtccattgttgtagacaaatcttgcctgtgacaggatatgattagcagaggagaggcatattcacccttggtaatacatattcatccttccaaacacagcagaatgtacccgcaagcaatgtgtgccattcacaacattcttagctckctttttattttcttggacctctggaaaatattagaagaatgttttctgatacctctggggacagagggcacatgccatatgtcctcgttcagcaggagccgaatactaacttcatggagcaatctggtgtttaggttctgaagtttcatacagtgagacccaagatgtgaactcacgcaaaacaaacacaatccaagttagaaagaaacaaattgattctggatggagaaatgggaaatttctattgtgagaaggccagtcctgttggaccaagacaccagcccaatccaagaactagct

SEQ ID NO: 31083 - DNA, 601 bp, Human
agtggacaatgagctccacagaggaccaccaaattaatgttgcatcttttcttttttgattccctgagggccgaactacaaagccacataataaaatccataataaaagccacataataaaaattaattcctagaatcacaggtttataggaaagtagctagtctagaaagtgtgcctgaaaacaggtgttaggagactaaatgtgtgtcataagaataagaatataagtgtctgctttaagtgaaaacacttggcaagaaatcgaatcttatataatgaattcgccttcctgcatacctygaactctgaggactgctgtgcctgtgtaattattcagcagtgggacgcagggctctttggtggattcagaggggaacgagacctgatccttgtctttaaggtgtctatgtttgagtgtactcagaagaatactagatgacctgactgattactggtgaggtgaatacaggccgtttgcttgcttgtttttgaaattatgttcttgaccttttacagaaccctctttaccacaacaaaaccagcagcaacagaaaactttgtcttcctccttgactaagggaaatcaatttgtaaggctgc

SEQ ID NO: 31084 - DNA, 601 bp, Human
attgcttgagcccaggaggtaaaggctgcagtgagctgagatcatgccactgcattccagcctgggcgacagagaaatttaaaatgtaagagcaaacataaatgagaaaatgagaaagtgaaatgattcacgtgtgaagagattcttcattgtagaagctctatatcctataagaccacagggtccctctaagtagcttcttcttaagaggctcctgtagagtttgtctacaaacttgaaaatacttaatcgaggaaaactaaaagctcaagtgtttctggattctgcttttcataaattwctaaaaaattatgataaagcaaatctcaggttggaatacatgagcaatttcctatctggcttaacatgtcccattggatggcagggaatctagaccattgcactgcctgcctgggtaaccatcagcaatcccaggcaaggccagagagcaagaagggatgtttgtgagactgaaaaataaaagctgccgttcccttcaccacctccacaaaggggatggatggacaggaccgtgctggtcagaagagaaagtggtttcttagcttggtgatttccccatgtttgccatttgatgctcttt

SEQ ID NO: 31085 - DNA, 601 bp, Human
atagataaaagccaattttgtggatccaatggacacaaatagtaatgaggttaattaagaacatgcttttaaaataggactttaaaatcttcagtatggtgaattaagtgggatttcctggttatatggttacagcaagaaaatgatttgcctctaagcgaatcaagagaccaggcgttaatgtgttttgagggcattctagaaatttttcatgtcatttactcctaaaaatgcttcttccatgacacttccaggctttttcatggtgccggcctcaaaaaacagtgaacactgaattatrattctatctgctgaataaaatcacaagatgatgacttcgaagcctcttttcctcactagagggctttggggttcaggtggtagaaggtaaaccctttgcttcggggctcccctcctgcagatatgcggctgtccagaggaattcccatagctgtcactcaggaagggaatgcactagaagcccaaggatgcccctgccactgtctctgttgatctttcaacaaagactctgccatggctgggcagagaggccatgatggggtgtgagccaggctgtggctaaatgcagggcttggtgtgc

SEQ ID NO: 31086 - DNA, 601 bp, Human
ttcaacccttagggtgaacttgtatttgtttgggagtgatctttgtgtttcttttgacctcttgaacactcttatctcataagaacaaattttatacatactttgcctcgacatttgcttttcttgataattttcagagcatactctctagcagtcgatctgcgaagagaaagttcatgtttttaaaatgaaacttaacttcaaatctattgaattattttgtcagggatcaatttcctaccccatagatcttgcatcatgttgtaaatattttgtgaaaggatttcctttccttttttawaaaaaaacaaataaatatgtaaacgttgatggactgaccaagtgtaaggacagtaagtctgctggcatagagaaatcttgggctatttatgttgccgtacttgtaataaaaacactagcactggcactttgttcctcgaattgcccacttgtccctcttccaagtgtactttccttccttttcttactgttggaaaactttctaataaacttccactcctgctctcaaaacaaaacactagcattgctagtgtgtcttagcttctcctgctgccaggttactcttccctccccttccctc

SEQ ID NO: 31087 - DNA, 601 bp, Human
attcaacccttagggtgaacttgtatttgtttgggagtgatctttgtgtttcttttgacctcttgaacactcttatctcataagaacaaattttatacatactttgcctcgacatttgcttttcttgataattttcagagcatactctctagcagtcgatctgcgaagagaaagttcatgtttttaaaatgaaacttaacttcaaatctattgaattattttgtcagggatcaatttcctaccccatagatcttgcatcatgttgtaaatattttgtgaaaggatttcctttccttttttwaaaaaaaacaaataaatatgtaaacgttgatggactgaccaagtgtaaggacagtaagtctgctggcatagagaaatcttgggctatttatgttgccgtacttgtaataaaaacactagcactggcactttgttcctcgaattgcccacttgtccctcttccaagtgtactttccttccttttcttactgttggaaaactttctaataaacttccactcctgctctcaaaacaaaacactagcattgctagtgtgtcttagcttctcctgctgccaggttactcttccctccccttccct

SEQ ID NO: 31088 - DNA, 601 bp, Human
acaaaaagataaggaagtgaagtcatatctaatcattccaaataacttttatcccagggatatacataaagttatattctagtaagtgtataacattctattccaccaaaattcaacccttagggtgaacttgtatttgtttgggagtgatctttgtgtttcttttgacctcttgaacactcttatctcataagaacaaattttatacatactttgcctcgacatttgcttttcttgataattttcagagcatactctctagcagtcgatctgcgaagagaaagttcatgtttttaaaatraaacttaacttcaaatctattgaattattttgtcagggatcaatttcctaccccatagatcttgcatcatgttgtaaatattttgtgaaaggatttcctttccttttttaaaaaaaaacaaataaatatgtaaacgttgatggactgaccaagtgtaaggacagtaagtctgctggcatagagaaatcttgggctatttatgttgccgtacttgtaataaaaacactagcactggcactttgttcctcgaattgcccacttgtccctcttccaagtgtactttccttccttttcttactg

SEQ ID NO: 31089 - DNA, 601 bp, Human
agaatgggatgaaacttagatcacattaagaagggaagagagtaagcaaacaaaaagataaggaagtgaagtcatatctaatcattccaaataacttttatcccagggatatacataaagttatattctagtaagtgtataacattctattccaccaaaattcaacccttagggtgaacttgtatttgtttgggagtgatctttgtgtttcttttgacctcttgaacactcttatctcataagaacaaattttatacatactttgcctcgacatttgcttttcttgataattttcagagcrtactctctagcagtcgatctgcgaagagaaagttcatgtttttaaaatgaaacttaacttcaaatctattgaattattttgtcagggatcaatttcctaccccatagatcttgcatcatgttgtaaatattttgtgaaaggatttcctttccttttttaaaaaaaaacaaataaatatgtaaacgttgatggactgaccaagtgtaaggacagtaagtctgctggcatagagaaatcttgggctatttatgttgccgtacttgtaataaaaacactagcactggcactttgttcctcgaa

SEQ ID NO: 31090 - DNA, 601 bp, Human
cacacctttactaattccatgacaagatacagttcagttggcacatccatctcctcaatcagaagaacgatattgggatgcttcactcttcttaaaatagacacttcattctggatcatgtgctcctgtccaaaggaaaagttatcttcatcagcttccataaaacatgtggagggctaactcaaatgagtacaactatactatgtaagggtcaagagagatgcattttggtaaaatgtaataagcctgtcttatattctgatattcagatatagcctagaattgccaatagatatggagrtccttacataatgcttgcaaattcagaaccaatcatgataactacagtttcatagcaaagaatgggatgaaacttagatcacattaagaagggaagagagtaagcaaacaaaaagataaggaagtgaagtcatatctaatcattccaaataacttttatcccagggatatacataaagttatattctagtaagtgtataacattctattccaccaaaattcaacccttagggtgaacttgtatttgtttgggagtgatctttgtgtttcttttgacctcttgaacactcttatctcataa

SEQ ID NO: 31091 - DNA, 601 bp, Human
ctctagaatataggcaagtgcggtgccatcaataaagacttactttctttccaaaatacacacctttactaattccatgacaagatacagttcagttggcacatccatctcctcaatcagaagaacgatattgggatgcttcactcttcttaaaatagacacttcattctggatcatgtgctcctgtccaaaggaaaagttatcttcatcagcttccataaaacatgtggagggctaactcaaatgagtacaactatactatgtaagggtcaagagagatgcattttggtaaaatgtaatragcctgtcttatattctgatattcagatatagcctagaattgccaatagatatggagatccttacataatgcttgcaaattcagaaccaatcatgataactacagtttcatagcaaagaatgggatgaaacttagatcacattaagaagggaagagagtaagcaaacaaaaagataaggaagtgaagtcatatctaatcattccaaataacttttatcccagggatatacataaagttatattctagtaagtgtataacattctattccaccaaaattcaacccttagggtgaacttgta

SEQ ID NO: 31092 - DNA, 601 bp, Human
cactgaaagtcagtacactattcacatcattattaggacagtgctattttcccattatgttggtgactaaaagtttaaagcttgtttttacaagatggctggtacctttggatatagttcatggaaaagtgaatgattttccattacaacaacgacaattgtattggtacctaatgctttgtgtgtcacacaaactggtggaagccatctcttcatccccacaataacaccattaagcagatattattaatattctcactttacatatgttgaaagtgagacataaagaggtagacccaawgtcatgggcctctttgtgccaaggctgggacttgagcccttgtgtaccattctcctgtgaacattcctaatcactgggccaatgtacagaaatgagaacctgaatactgatgggagaaaataagggaaagagctctagaatataggcaagtgcggtgccatcaataaagacttactttctttccaaaatacacacctttactaattccatgacaagatacagttcagttggcacatccatctcctcaatcagaagaacgatattgggatgcttcactcttcttaaaatagacacttcatt

SEQ ID NO: 31093 - DNA, 601 bp, Human
atagtttgttttcatagaataagaaggtaatattatgtgacaggatgagattacgacattcactgaaagtcagtacactattcacatcattattaggacagtgctattttcccattatgttggtgactaaaagtttaaagcttgtttttacaagatggctggtacctttggatatagttcatggaaaagtgaatgattttccattacaacaacgacaattgtattggtacctaatgctttgtgtgtcacacaaactggtggaagccatctcttcatccccacaataacaccattaagcagrtattattaatattctcactttacatatgttgaaagtgagacataaagaggtagacccaaagtcatgggcctctttgtgccaaggctgggacttgagcccttgtgtaccattctcctgtgaacattcctaatcactgggccaatgtacagaaatgagaacctgaatactgatgggagaaaataagggaaagagctctagaatataggcaagtgcggtgccatcaataaagacttactttctttccaaaatacacacctttactaattccatgacaagatacagttcagttggcacatccat

SEQ ID NO: 31094 - DNA, 601 bp, Human
actagggaggctgaggcaggagaattgcttgaacccaggaggcagaggttgccgtgagccgagatcgtgccattgcattccagcctgggcagcaagagcaaaactccatctcaaaaaaaaaaaaaaaaaaagaaagaaagaaagaaagaaacaagtcctaatttgaagtagactaaaaataaatttcacctataaatacaaataaccactaagttaaaaaaaatgccaatatgtctaaggtgaagcaattctaaataacaaaaacttaaagaccctagaatgaacatttttcatatcatcrcagattagcttactaaatgctttcctcgtcttgaatttttaaaagagaaaacctcacattcaagtcagcagtgtagggattccaaacatgccctgggagcctgaggcgccccctggcggtgctcacagctgatgcagaaggcggtgcaaccaattacaacattctccaactaaggtagacattacttacacgttcagtttgatgaatatactagaaaagacttgagaacacaacagcttcatgaaaatgaagcatgccattttttaaaacttctacttcccgaaaatgtcaaatgtatgg

SEQ ID NO: 31095 - DNA, 601 bp, Human
catggagaaatcccatctctactaaaaatacaaaattagccgggcgtggtggcacatgcctgtaatcccagctactagggaggctgaggcaggagaattgcttgaacccaggaggcagaggttgccgtgagccgagatcgtgccattgcattccagcctgggcagcaagagcaaaactccatctcaaaaaaaaaaaaaaaaaaagaaagaaagaaagaaagaaacaagtcctaatttgaagtagactaaaaataaatttcacctataaatacaaataaccactaagttaaaaaaaatgccratatgtctaaggtgaagcaattctaaataacaaaaacttaaagaccctagaatgaacatttttcatatcatcgcagattagcttactaaatgctttcctcgtcttgaatttttaaaagagaaaacctcacattcaagtcagcagtgtagggattccaaacatgccctgggagcctgaggcgccccctggcggtgctcacagctgatgcagaaggcggtgcaaccaattacaacattctccaactaaggtagacattacttacacgttcagtttgatgaatatactagaaaagacttgaga

SEQ ID NO: 31096 - DNA, 601 bp, Human
gcctgatgagcatggaatttcattctcattaactgccgatccactgccgtccggaacatgagccttgtttgtctgagagcttcaggcattctttgggacatccctgggccctgagggtttgagaagcataccccacccacatgtctcagtggaaaagtcctgggagtctttcaagtcaagcctggggctggccttcacttccctgggaagcttctcgagctgtcctcagggcgttctgggtgagattaaatcgaagggtatggtcttgcagcacaattgagggtcccagcgctgggctacrgagaccttctatggcctttctagggtatcttggtgatgtagagagaattcacaaaggcagttaagtgcaacgaggaccttaccatagtctcctaaccaagcacacgattgacagactaagatttctcaccaaatgcgttcagagtgcctgagcctttgccatcttgaaatttcatttagtctcagcactccaaaaatcagccaacagtgggggtaagtcaataataacggggggtaatcaaattctaacagcacatagaagggcaacagaatggcttgaagttgttagtttaaaaattaa

SEQ ID NO: 31097 - DNA, 601 bp, Human
cgcccttcctgaagtgtcccatcccctccccttcagttttctaactcccgttgctctctcagggcccagctgcaggcccagctcctccacgaggcctgccttcctctgaacacataggcagcctgcgtgtgcaccgcctctggaggcagaaggctaaagtcctgtgcctgatgagcatggaatttcattctcattaactgccgatccactgccgtccggaacatgagccttgtttgtctgagagcttcaggcattctttgggacatccctgggccctgagggtttgagaagcataccccasccacatgtctcagtggaaaagtcctgggagtctttcaagtcaagcctggggctggccttcacttccctgggaagcttctcgagctgtcctcagggcgttctgggtgagattaaatcgaagggtatggtcttgcagcacaattgagggtcccagcgctgggctacagagaccttctatggcctttctagggtatcttggtgatgtagagagaattcacaaaggcagttaagtgcaacgaggaccttaccatagtctcctaaccaagcacacgattgacagactaagatttctcaccaaatg

SEQ ID NO: 31098 - DNA, 601 bp, Human
ctgtcctcaagcctgtcctcatgacagcgcccttcctgaagtgtcccatcccctccccttcagttttctaactcccgttgctctctcagggcccagctgcaggcccagctcctccacgaggcctgccttcctctgaacacataggcagcctgcgtgtgcaccgcctctggaggcagaaggctaaagtcctgtgcctgatgagcatggaatttcattctcattaactgccgatccactgccgtccggaacatgagccttgtttgtctgagagcttcaggcattctttgggacatccctgggycctgagggtttgagaagcataccccacccacatgtctcagtggaaaagtcctgggagtctttcaagtcaagcctggggctggccttcacttccctgggaagcttctcgagctgtcctcagggcgttctgggtgagattaaatcgaagggtatggtcttgcagcacaattgagggtcccagcgctgggctacagagaccttctatggcctttctagggtatcttggtgatgtagagagaattcacaaaggcagttaagtgcaacgaggaccttaccatagtctcctaaccaagcacacgat

SEQ ID NO: 31099 - DNA, 601 bp, Human
ctacacacaggttttcaggttgtctctgtgccacttgaggaggtgggacagtcaccgtggtctatgtgaacagcacccctggagttccaccacagggcatgtgtggctgtatatggagaccctgcaaagattccaccagtcccagttatctgggctcctggcatcttgtaatgtcctttttaataagagataaggtcttgctttgtcacccaggctggagtgcagtagcacaatcatggctcactgcagcctcagactcctgggctcaagtgatcctcctgtctcagcctccagagtagcrggaaccacaggagcaggccatcatgcttggctaattattattattttttttgtagagatgaggcttcgctttgttgcccaggctggtctccaactcctggcctcaagtgatcttcctgccttggcctcccaaaatgctgggattacatgcgtgagccactgcgtctggctcctttcttctttgtcctcaacaatgcagtcaacaggtcttatcggtcctttcttggacacgtttttccttcgcagccatctgggccttcctactccgccaaacgctcctgttgcctcatccctgggttgt

SEQ ID NO: 31100 - DNA, 601 bp, Human
acttttgtttcctttgttcctttttaaatatattgctttttggtaaaatggaatgatttttaagttccaacctaagttccatttattcaaaaatcctttcagagaattggggtctgatttactatcaatatgtgcatcatgcttgcctacagtgtaccaaaccgctatgcacagtaaccaactgtgatcgtctgttacctaatgcgctaaggaactcagttttctttttaaaatagctaaagcaaaagatagcccctgtaggctgatgattttcaaatctgcctctcgggcctgggccctytgtgcccctgtacagtctccactctggagacttctctcactgtcccccaagctgcaacggttctcaagctaaccacacaaattttttttttcaaagcaaatagttttttcaactttctgcttctctcaaaggtaaggctgctacacacaggttttcaggttgtctctgtgccacttgaggaggtgggacagtcaccgtggtctatgtgaacagcacccctggagttccaccacagggcatgtgtggctgtatatggagaccctgcaaagattccaccagtcccagttatctgggctcctg

SEQ ID NO: 31101 - DNA, 601 bp, Human
tgaggaacaggtaatactgcaaactgcacactgaaaatgttctactgcctagtgaaattattaggatgcacacacacacacacacacacacacacacacaatccccttcatacactagatttagctctctgagagtgggcatagtgttttctttttcaatattgtgctcctttgtaaggaacagagaaaaagaccagaaacttcatttcaaagttgagtgagagaaggagggaggaagggggggaaatctcaaagaaagttttctaggactgtcattcatctgaacttttgtttcctttgytcctttttaaatatattgctttttggtaaaatggaatgatttttaagttccaacctaagttccatttattcaaaaatcctttcagagaattggggtctgatttactatcaatatgtgcatcatgcttgcctacagtgtaccaaaccgctatgcacagtaaccaactgtgatcgtctgttacctaatgcgctaaggaactcagttttctttttaaaatagctaaagcaaaagatagcccctgtaggctgatgattttcaaatctgcctctcgggcctgggccctctgtgcccctgtacagt

SEQ ID NO: 31102 - DNA, 601 bp, Human
tagctcctgaaggctaactggaaattaacctttcaggtaaatttttaaaaaaagaaagaaaagaaaaaagaaatattcatattccttcatgagtgcttggaactcaggatgccctgtaggtggaattcctcttaccagcaggttctctggcttgatatcacggtggacgatgttcaggctatgcaggtatttgatggcgctggctaggttgtacagcatcccactggcgtctctctcggtgtatttgttagtggaagtaatggcatcaaaaaggtctcccccctgagaagagaacagaagstgaagcagcacattaacagacgggccagtggggccacctgcagaggccattgacaaaccccaaaggacaggaagaatggatgtggaatctttgggttcctaaaggcttttcctgctactttcctttcaaaggctcgaaggctgaatggtgatttctccacccactacaaaaaccagtggcatctcccccagagctcaaagaaaggggcagcgtgaggattctccaccaccagacacatggccatttccacagatcccagctaggggacgaggagatgcagctggatctccagggcagagg

SEQ ID NO: 31103 - DNA, 601 bp, Human
tacctttaacaaagaccaaatggaagccttaagattgcagtaattgacaaaacagattgggaaaacagagaaaatggctcccactgtaaatgttaaagaataaaatacaattttaaaaagagtggaagaaacctgatagctaattatgtctggatagggcacagcagtactatttttcctattctcgaagcgggctagttcttttgcaagcatagcacttaaacataagagaagcatttacccagtctctgcaatgatttctggagccacgtatgttggggtgccacagactgtgtacagkgggccgtctacaatggtggccagtccaaagtcacccagcttcagtgatttgctgccatcttggtgctcatacacctaaaacaaaggtaaaaatcacaattgtctgaaaaccaagagctcaaaagccctttcttgaagaaatgaggaacactgtgtttaaatttaatgtataggaggtaaaaaataaattaggcaattatgcaagaatggatatacatacaaaatagcttacttcctttagattactgcaaaactggaatcatggtgaacacctaacaaatggaaattgattaaataaatt

SEQ ID NO: 31104 - DNA, 601 bp, Human
tatggggaagaaatatggaaggcatataaattagcatgcatgacataacagggaaaaaataacagggattgcaagtaaagttcttgtgctcttttcctgctgcaggctcctttgtgcaagaagggctaatggatcactcagagagtagagaaatgctttgtcggcgctgaataaaagattgttgcccatacccacggaatggagggaaaccacacagcaggatataagtgattacacctgctgcccagatgtccaccttgaggccgtatctggaaaaataagggatgttagagttaggagrgtcaggctcggacaaattatgcagcttggtaaaatcaatgactttcctcctccaagccaaaaataaaaccaaacaaaataacaatcccaacaacaaacgctaaactaaaacccaccacctaaacagagttcaaagaaaaagtttaaaaaataataattttaaaaaagaccaaggtgcaggaataaaaatcaaaggaatgcattgctggacttatttgtaaatatcagtaaatgaaggttttcagcaaaaaggtttattatagtaataacaattctgagataaggatggacccttgagata

SEQ ID NO: 31105 - DNA, 601 bp, Human
aaagcacctcctggtcatcaccacttctgtttaggtgaacgacaacaaggaaaaacagcactaagatatcaactcagtgtacatcttttcagtcttaggcactggagcccttcctttccccccataaatgtgtaaaaatgtgtatttttaatcgattgaaaaatgtcaatgtggatctgttttggtaaattaagaaagagtttttgggccgggtgcggcggctcacacctgtattcccagcatttcaggagactgaggcaggtagatcacttgaagtcaggagttcaataccagcttggcyaacatggtgaaacccccatctctactaaaaatacaaaaagtaactggtgtggcggcgcacgcctgtgatcccagctattcaggaagctgaggcaggagaactgcttgaacttgggaggcagaggttgcagtgagctgagactgtgccactgcactccagactgagcaaaagagagactctgtctcaaaaccagaaagaaaaaaaaaaaaagaaagaatgagtttttaatgatatggggaagaaatatggaaggcatataaattagcatgcatgacataacagggaaaaaataacagggat

SEQ ID NO: 31106 - DNA, 601 bp, Human
ggaaaaataattccgttaagacacacagaatatagggaagaggaaggcactggacacctacctttgcagaatcggaaacattatcccagtatggagaaggaaagtccacctgccccatcaaaatctgatcaaaaagcacctcctggtcatcaccacttctgtttaggtgaacgacaacaaggaaaaacagcactaagatatcaactcagtgtacatcttttcagtcttaggcactggagcccttcctttccccccataaatgtgtaaaaatgtgtatttttaatcgattgaaaaatgtcartgtggatctgttttggtaaattaagaaagagtttttgggccgggtgcggcggctcacacctgtattcccagcatttcaggagactgaggcaggtagatcacttgaagtcaggagttcaataccagcttggccaacatggtgaaacccccatctctactaaaaatacaaaaagtaactggtgtggcggcgcacgcctgtgatcccagctattcaggaagctgaggcaggagaactgcttgaacttgggaggcagaggttgcagtgagctgagactgtgccactgcactccagactgagcaa

SEQ ID NO: 31107 - DNA, 601 bp, Human
tcattaagtcaagagctgagagaggtgaaaccacaggccatatagaaatctgagctgggctcaagcctggcgagggtggggcacagcaagaggctatagcaatgtcactggaatggcacctgagagagatgaaggcagcagatggagacacttgataagtacttgttgggatgtctgggaacagatgacttgatgactgtgaaatcttggaaaacctagcaattacaactaaaatgtgtacagaaatcatacttatgatgtcattagtttctttgcacacaatgatttggaaaaataattycgttaagacacacagaatatagggaagaggaaggcactggacacctacctttgcagaatcggaaacattatcccagtatggagaaggaaagtccacctgccccatcaaaatctgatcaaaaagcacctcctggtcatcaccacttctgtttaggtgaacgacaacaaggaaaaacagcactaagatatcaactcagtgtacatcttttcagtcttaggcactggagcccttcctttccccccataaatgtgtaaaaatgtgtatttttaatcgattgaaaaatgtcaatgtggatctgtt

SEQ ID NO: 31108 - DNA, 601 bp, Human
ctgggaaggcttcactgggaaattaagtcattaagtcaagagctgagagaggtgaaaccacaggccatatagaaatctgagctgggctcaagcctggcgagggtggggcacagcaagaggctatagcaatgtcactggaatggcacctgagagagatgaaggcagcagatggagacacttgataagtacttgttgggatgtctgggaacagatgacttgatgactgtgaaatcttggaaaacctagcaattacaactaaaatgtgtacagaaatcatacttatgatgtcattagtttcttygcacacaatgatttggaaaaataattccgttaagacacacagaatatagggaagaggaaggcactggacacctacctttgcagaatcggaaacattatcccagtatggagaaggaaagtccacctgccccatcaaaatctgatcaaaaagcacctcctggtcatcaccacttctgtttaggtgaacgacaacaaggaaaaacagcactaagatatcaactcagtgtacatcttttcagtcttaggcactggagcccttcctttccccccataaatgtgtaaaaatgtgtatttttaatcg

SEQ ID NO: 31109 - DNA, 601 bp, Human
attattcaaggttcaacttaaatcatagcttccccataaagtctttcttgatgatttcaacctacgttgaggttgagttttcttccttctgattaattgatggattcattcatatacttgttcatttattcagtatacattgagcaccagtatgctggtcatactttaggcagggatagtacagcaatggacaaaatagataaaaatccctgccttcgcagaatttgcattctagtggagagagtctggaaatgaactatataaagaagacatgcctacttatttatatctatcttttttkgggtagagagataggtagttagatagcacaccagatggacacacaggtgttaagtgttctggagaaaaataaaacagacaagtaggatacagcaagccaggtaaggtttaagagatgcaattggaaccaggatggtctgggaaggcttcactgggaaattaagtcattaagtcaagagctgagagaggtgaaaccacaggccatatagaaatctgagctgggctcaagcctggcgagggtggggcacagcaagaggctatagcaatgtcactggaatggcacctgagagagatgaaggca

SEQ ID NO: 31110 - DNA, 601 bp, Human
aagtcagcactcggagacataaattttaaaaagagcaatgaaaaggttttcctttttctcctcaaggtctacaaacatctcaatgtaagatttttatagccttcttagaagttgatttatcataaatattatttaatgtggtaaaatatacataaaatttaccacttcaaccattttcaagtgcacagttcactgacattcagtgcattcacattgttgtgcaaccatcaccttcatccatgttaaggactgatcttttagtttcatgggataaaaacaatgaaccttgtgttttcctccycctctgcctctaaatcctggctattattcaaggttcaacttaaatcatagcttccccataaagtctttcttgatgatttcaacctacgttgaggttgagttttcttccttctgattaattgatggattcattcatatacttgttcatttattcagtatacattgagcaccagtatgctggtcatactttaggcagggatagtacagcaatggacaaaatagataaaaatccctgccttcgcagaatttgcattctagtggagagagtctggaaatgaactatataaagaagacatgccta

SEQ ID NO: 31111 - DNA, 601 bp, Human
ggcatggggagctggacaggttcctgaagagcccccggccctgcagctgtatcgtcccatctcctttagcctgcgcctttctctgacactccctttctggcagcttcctggacagttgaagaaaatgagagacttgcactcaatatgcatcattttctacacaaagtggtcatgtctgaggggttggcttttaaagggaactcacattcaggacatgacaaaagcaaaggcataaacattgagcaatcaaaagataattatttctcaagataattattgagaacatttttctcaaattttyaaacatttaagtcagcactcggagacataaattttaaaaagagcaatgaaaaggttttcctttttctcctcaaggtctacaaacatctcaatgtaagatttttatagccttcttagaagttgatttatcataaatattatttaatgtggtaaaatatacataaaatttaccacttcaaccattttcaagtgcacagttcactgacattcagtgcattcacattgttgtgcaaccatcaccttcatccatgttaaggactgatcttttagtttcatgggataaaaacaatgaaccttgtgt

SEQ ID NO: 31112 - DNA, 601 bp, Human
gcattatccagttccttacatacacaggctttatagtaccactcgggaagggggtgatttaatttcattgagggagagagttcactcagccttcttcattcagtttctaacttggatcagaactcgtgaaagtatctgctgtgtgtgatgccctttgcaggtgctatggaggtgtaggagatggtcctatttgtcagtaactgtgagccctcagatcctgcagtgatggcatggggagctggacaggttcctgaagagcccccggccctgcagctgtatcgtcccatctcctttagcctgygcctttctctgacactccctttctggcagcttcctggacagttgaagaaaatgagagacttgcactcaatatgcatcattttctacacaaagtggtcatgtctgaggggttggcttttaaagggaactcacattcaggacatgacaaaagcaaaggcataaacattgagcaatcaaaagataattatttctcaagataattattgagaacatttttctcaaatttttaaacatttaagtcagcactcggagacataaattttaaaaagagcaatgaaaaggttttcctttttctcctcaa

SEQ ID NO: 31113 - DNA, 601 bp, Human
aatacaaagaaaaatagaactattgagaggtaaacaatttcatcatcctgaaattaatggaacttcctcatgagctcaaatggacttggaccaggaatgctctacctgggtcttaacgatgagtatgctatacaattgtccactctggattagaagttcccatgtcacaaaatggttagatatgcattatccagttccttacatacacaggctttatagtaccactcgggaagggggtgatttaatttcattgagggagagagttcactcagccttcttcattcagtttctaacttggatsagaactcgtgaaagtatctgctgtgtgtgatgccctttgcaggtgctatggaggtgtaggagatggtcctatttgtcagtaactgtgagccctcagatcctgcagtgatggcatggggagctggacaggttcctgaagagcccccggccctgcagctgtatcgtcccatctcctttagcctgcgcctttctctgacactccctttctggcagcttcctggacagttgaagaaaatgagagacttgcactcaatatgcatcattttctacacaaagtggtcatgtctgaggggttggcttt

SEQ ID NO: 31114 - DNA, 601 bp, Human
atttactccagaatatgacaccaggaagtatgaggtttcattattcctcggcccaatttaatctttgcctagagctgcgatcaaattgcatgtagtgtatgtctgcatgtatagaacagaaaagaaaggccttgtgcagacgcatcaataaaatagtaaatgttaaaagactttcaactttaagaacagaaatttctaaggagcaagacatcgtgacttcgttgggtgttcacagtaattcaatttcactgaaaatctcactgcgtagctttctgctatgctttgactttaatttaggtcyagtatcaagatctatagtgttccaagctctccctgcaatgtcgtctctctcagcttgcctttcctttctaggtcctagcaaaaggacactatgaactctttttcttagagccaagaagtttgcattggcacagagtccagcatgggggaggttttcggttttaaataaataaatcataaaattaatatatactgcaagacaccctggaggtgttggataatgatgtgatgcccagggaaatgatctgcagaaacacataatatatataagtcccatacctcctctagtgcattaagtggc

SEQ ID NO: 31115 - DNA, 601 bp, Human
ctcagtaacccagatctgggattggtggcatcaaacagatcacttgtttatcttcagtttttttttagagctctcgcgcaaccaaaaaagaaaaaaaggaaagaaactaaaaacacccagagaagtggttaaatattcagtactgctcatgagtgagaggtgctgtttaatagcataaatacttttgaaaaagtccacatcatagtgtcttaaattctttgtttggagaagaaaaacagctcaagtgattttcagattgaatatgctattaaaatttacacactctgaaaaaaagaggaawttattaaaaactcaagtaattggaacttgaatatatttactccagaatatgacaccaggaagtatgaggtttcattattcctcggcccaatttaatctttgcctagagctgcgatcaaattgcatgtagtgtatgtctgcatgtatagaacagaaaagaaaggccttgtgcagacgcatcaataaaatagtaaatgttaaaagactttcaactttaagaacagaaatttctaaggagcaagacatcgtgacttcgttgggtgttcacagtaattcaatttcactgaaaatctcactgcgt

SEQ ID NO: 31116 - DNA, 601 bp, Human
tttctcagaaagaattaaagatagagggcaagaacaacttgaaattttaaaacttcagcggcactgaggaacatctggaagagtaggcattccctttcactttacacatgtgccagttgctcacacgcatgtaaatcactattgaaagggttcaatcgagaaacacgaaatgcaaacagtacgagggtgtgtatgcatgcattcgtaccatttgcaaattctggaacctcatatcaaatactcagtaacccagatctgggattggtggcatcaaacagatcacttgtttatcttcagtttktttttagagctctcgcgcaaccaaaaaagaaaaaaaggaaagaaactaaaaacacccagagaagtggttaaatattcagtactgctcatgagtgagaggtgctgtttaatagcataaatacttttgaaaaagtccacatcatagtgtcttaaattctttgtttggagaagaaaaacagctcaagtgattttcagattgaatatgctattaaaatttacacactctgaaaaaaagaggaatttattaaaaactcaagtaattggaacttgaatatatttactccagaatatgacaccagga

SEQ ID NO: 31117 - DNA, 601 bp, Human
caatataattggatgtatccagtgctattctgaaagtatcacaatgaaggtggccaaaatagccagtttctaattcccagccccaccctttggttactgacctcagccaggttcttctagaaggtagagatatttatgagggaaaagcattctggagaaggtgcctcatgtacatagtatggtagaccagtttctcttaaaacaatctctgaaatctacattgatattctcttttatgcttgaaatattaatgctgatagttaacatatgaattgtgctatagatctgacaggcattttttaagatacagttttctgaaaccagccaattattttgaatctgaattaagttgataattattaaaaaaaaaaaaacctctgcagcagtaaagattaaacaagcatgcaaccaatgcataactcagcattacacagcccactttacaatttgtaagtatattaccagtttgtgcagtttccatggaaaccgtgttagtgatgaattgagaaacttgcattcaaaattgcattcaaagtggtccaatcatgacatttaggaaaaaaaaaagtggatctttgatcttcaaatactaatgagtgtt

SEQ ID NO: 31118 - DNA, 601 bp, Human
aagagtgtcacagattctctgatgagcattggtgatctccagcaggtagttaggtttctaactaaggaatgagaagtactagttaaaaattaattatttaattgttgattccccaactgccaccaaaccacaaactaacactatgtcctaaataataatttttaaaacattctaaagggtgtatgtaattctaaaaaattagtcccatggtaaaggcggtttaaaatacattattttatagcctctggggagagcgtatatacctaggaaaattctgtttgaatgaaatttatgctgaaaycagtttttgtaaatctatcaaagagaagtcatcactgtattatatcaattcctgaacttttaatgatgtgagcaaattaatcattatattaaattattaaattatcaaatagtctttatagaatataccatttataaaaaatttttcttctacctcccacttattttgcttcatagcagaataatctttcttggcagtcatactttggaatattatttaatgccagggtttctttttcttgtgatagtcccctgatagtcagcctttgcattttaagaatgaaaaaatggttatgcaata

SEQ ID NO: 31119 - DNA, 601 bp, Human
tggccacaaagacagctacttagtaattagctttctattgccatctacaggcaaagtgtcatataacaggtctcattttagaactaagcttcccagtgtcacaattatatgcatgctgattagtatggatttgttcaattagactgaaacgctctatttgcatgagcaaaatgcaaaagaagaactttaaagcattaggaaaattattggttaaaataataaacagtgttaaatgaggaaaaataaattggaactgacatcttagtcatcggttcttcatcaagctgagcaaatctaatawtgcctctctctcttccctcagctctcaaaaagttcaccgttaaaatgtcatctctaattcatttcatgtctataaattgcattttaataaccttttgtttccctttctctctctcttttttttttcaaatcccccaactactgagaaaggcagcagagggacaatggcgtctctctgagaggcacagaatgctgcaattctaaggaatgcaatgccttccacctaatcccatggcttgacctaatgtcagagcacctttcctccttcaggagggtgtgtgatccctgtgaacctccagct

SEQ ID NO: 31120 - DNA, 601 bp, Human
attttgtgctctgattataaactaggctatccaagtgtgcataaaatgcaatgtgaagttttaatctttttaaaaatgtgtgtttcattttattgagaaaaaaatcaaagtatactggctctcaggaagatgaaggtgtatgcttggccacaaagacagctacttagtaattagctttctattgccatctacaggcaaagtgtcatataacaggtctcattttagaactaagcttcccagtgtcacaattatatgcatgctgattagtatggatttgttcaattagactgaaacgctctayttgcatgagcaaaatgcaaaagaagaactttaaagcattaggaaaattattggttaaaataataaacagtgttaaatgaggaaaaataaattggaactgacatcttagtcatcggttcttcatcaagctgagcaaatctaataatgcctctctctcttccctcagctctcaaaaagttcaccgttaaaatgtcatctctaattcatttcatgtctataaattgcattttaataaccttttgtttccctttctctctctcttttttttttcaaatcccccaactactgagaaaggcagcag

SEQ ID NO: 31121 - DNA, 601 bp, Human
tgccccctacccccacctcccccccaaaaacaactcaactaatttactgatttatgctactttgtgattttgcgtgttatcacttccggatgctctaaaagggggggaaaaaaacctcaataaacgatatgctttttacatgtcaggacaacacagaccacagagatgaacctaaatgtaaaagagcaaaaaattttggtgatggtgttgcaaaagtaatgacatgtgatttaaaaatccatattaatgtagaccatagtttcagggttgaagagtaaaaatgcagcaagtgaagatcaaygtgcatttgaaaataaaggactatagaaacgttgttcacaaattttaagactctcaggtattaaagtatattcaaaacagagaacataggtactgttcagccaccagatgcaaatttcatgagatatccctctctggttgtctcgtggatcccagagcccagcaaaccttgggaatacatttgagttgggcacctgcctctaagacaccccaggagaatcctctctgagcactgtggtgatgcacagaacctgtgaatccccattctaaaatggaatctgttccagaagaaactcaggcc

SEQ ID NO: 31122 - DNA, 601 bp, Human
gcaggtaggtctctgcccattgcattcttcacacttttagagttgaggccaggctgtagagctactccatagccttggaatagtgctttgctttatatttctagagaaagcagtaatttccaactagttcagtgttcctcattaatatggaatctacctacacaccaacactctttctggtgttctgtgccccctacccccacctcccccccaaaaacaactcaactaatttactgatttatgctactttgtgattttgcgtgttatcacttccggatgctctaaaagggggggaaaaaaacctcaataaacgatatgctttttacatgtcaggacaacacagaccacagagatgaacctaaatgtaaaagagcaaaaaattttggtgatggtgttgcaaaagtaatgacatgtgatttaaaaatccatattaatgtagaccatagtttcagggttgaagagtaaaaatgcagcaagtgaagatcaacgtgcatttgaaaataaaggactatagaaacgttgttcacaaattttaagactctcaggtattaaagtatattcaaaacagagaacataggtactgttcagccaccagatgcaa

SEQ ID NO: 31123 - DNA, 601 bp, Human
cttgtgcttgtctgttaaccctctgagtacatctctgacattcaggatcttggtagcttaatgttagaaagattgcattccatctgattactcaagatttctacttgactggtcacattccactgtttattcagcatagatcactcaaattctacagtgatgtgctgggatccccatgctgaatgggccctgcattcttctgagctgcccttctgcagtgtgctgagaaacaccccctagcttcacacggtccagagtccccctagacgtcgatgggaaaaggcctgagccatgcaccgcgggctcagtacactagatgctgtagcaatatagttaatgcccacagaaaaagcagtaattcagagaaagaaaggaaaatgacagtccactgcaggtaggtctctgcccattgcattcttcacacttttagagttgaggccaggctgtagagctactccatagccttggaatagtgctttgctttatatttctagagaaagcagtaatttccaactagttcagtgttcctcattaatatggaatctacctacacaccaacactctttctggtgttctgtgccccctacccccacctcccccc

SEQ ID NO: 31124 - DNA, 601 bp, Human
attttaatatgcaccacgtgtaagttagatgagggctacggtaaaaacatttttgatgactgaaatcttacttttccttctaacgatctggagcaaatcacatattcattgatcatgacgaataaaatgatttctgctacaatgttgagaaaaaatgtgttcattaatatgaacacatgtctacagagatgatttacacgatgcaagtaatgaaagagttcttccttaactagtctactatcaaactgaaaagatgaatcttaaaattcccttgaaaataccatatgattggtcatgtgtyagtaaaagaaagacggtccccatcaccaggccaccaccataagagagctatattaaatacttgggaaaaaatatggaaacaccggtggtgatgattaaattgataattacatagatacactgccataatgatacatatttgttctatgataagtgaaatcaaaaataagatcaatttggttatagaaattccttaaagaacaccaccacttaattatttcaaacttgaactatcccaagaatgtcgagaaaaaaattagaaagcactggctaaaagcaaagcaatctggatacaccaatg

SEQ ID NO: 31125 - DNA, 601 bp, Human
cggttagtaccgtgttcattcattacttgggcaatttgattgaattctaatttatgcttgcagtggctgaagtatatataatatattcaatctcttaatgatgatatcatctcttaaagaaattaactaatactattaatgatagaatactgatattattacctaaataaagactatgaacttagcttttagcattttgacctaaatttgataaggagagtgtgtttgagaaatttttcagtattaatatattcatgacagctgtagtgctttttgtgccattgaatacccataaataatytgcatagtaatatacaccaatgctgtgtatttatattacccgtgagataaagaatactacttggatgaaattactttttttttttttttttttttttttgagacagagtctcgctttgtcacccaggctagaatgcagtggtgcggttttggctcactgcaacctccacctcccaggttcaacaattctcgtgtctcagcctcccaagtagctgggactacaggcgcctgccgccacacctgactaatttttgtatttttggtagagacggagtttccctatgttgcccaatccggtctc

SEQ ID NO: 31126 - DNA, 601 bp, Human
cagagtctcgctttgtcacccaggctagaatgcagtggtgcggttttggctcactgcaacctccacctcccaggttcaacaattctcgtgtctcagcctcccaagtagctgggactacaggcgcctgccgccacacctgactaatttttgtatttttggtagagacggagtttccctatgttgcccaatccggtctcgaactcctgggctcaagtgatctgcccacctcggcctcccaaagtgctgggattacaggcatgagccaccgtgcctggccctgaaattactttttttttgagayggtgtcttgctctattgcccaggctggagtgtagtggtgcagtcttggctcactgcaatgtctgcctcgtgggtccaagtgattctcatgcctcagcctcctgagtacctgggattacaggcacgtgccatgacacccggctaatttttgtattttttgtagagacagagtgtttcgccttgttggccaggctggtctcaaactcctgacctcaagtgatctgcctgcctcggcctcccaaaatgctgggattacaggcatgacaccacacctggccctgaaattactttaaatccatat

SEQ ID NO: 31127 - DNA, 601 bp, Human
ggagaagtgtgaaaagctaaatttggagtgtcccatttttctgcttctaaattacaaaggaagcaaatgttttgttttgttttgtttatcattcatagccccatcttcatgttatccatttaatgcttttaaagtatttaatattttgtctgttttcgtctacaggtagaagagagaccagaaaaagattttactgagaaggtaaggaatcgttcataaacctagagggtcccaaaagttgtggatgaaattgataagaaaatatgttgcttggttttttttaataaggatgttccccagygagggaactggactagaaagcggcccacctaacctggtatcaccttcccggaggtaggccaccgggagtcctgtccggtgtgcgttagatcctgtagagcagggaggcgtttataatgggccccaccatggagtttagggttaatccagctaatcgcagagcatccaggaggtgcctggaaatgatcccctccttacagtttactataagcccatgaagagtttccaatttggaaatggaattaaagtaacagtcctgtgatgttagatttatatgcagttttggttttgtctgaaatcg

SEQ ID NO: 31128 - DNA, 601 bp, Human
cctcatcttgtggggattatggggattacaattccagatgagatttgggtggggacacagagctaaaccatatcagcatgtgatcctctcaacgttccaggggtctcgtaacatgccgggcctgtctgcagccacgctggcctctctgggtgggacttcctctcggagaggcagcggagacacctccatctccatcgacaccgaggcatccatcagggaaatcaaggtgagatgctctcttcttactgacaacttgagagaaccttttgtaaaaatcagtctttagattaaaaaaaaaaaagttaattcataaagttctggatctttcttcttggtcctctctccctcacctcccctaaaatacggtgttctcctaacatcaagacccagctcagatagtgtctcctgcaggaatctgatcctacccactgaccccccagcagggcggaccgtgtgccggccccctgcgcccctcagcacccggggaataccttagtgagagcacttggcacgttgtgttgatgcacttggtcgtctctgtatgcttggtctgcatagacattcagtccacaagtttggacaccagacggctttacctact

SEQ ID NO: 31129 - DNA, 601 bp, Human
tcctctcggagaggcagcggagacacctccatctccatcgacaccgaggcatccatcagggaaatcaaggtgagatgctctcttcttactgacaacttgagagaaccttttgtaaaaatcagtctttagattaaaaaaaaaaaagttaattcataaagttctggatctttcttcttggtcctctctccctcacctcccctaaaatacggtgttctcctaacatcaagacccagctcagatagtgtctcctgcaggaatctgatcctacccactgaccccccagcagggcggaccgtgtgcyggccccctgcgcccctcagcacccggggaataccttagtgagagcacttggcacgttgtgttgatgcacttggtcgtctctgtatgcttggtctgcatagacattcagtccacaagtttggacaccagacggctttacctactttcacacaacccctccccactaagtatgttccccttcggcctagaacttgccctttcctttctctttgtaatgtgcctttagtagccctcatctttgtattttaatgattttttttatcccactgtagtgtaggtattattctctgctctatcctca

SEQ ID NO: 31130 - DNA, 601 bp, Human
ggatctttcttcttggtcctctctccctcacctcccctaaaatacggtgttctcctaacatcaagacccagctcagatagtgtctcctgcaggaatctgatcctacccactgaccccccagcagggcggaccgtgtgccggccccctgcgcccctcagcacccggggaataccttagtgagagcacttggcacgttgtgttgatgcacttggtcgtctctgtatgcttggtctgcatagacattcagtccacaagtttggacaccagacggctttacctactttcacacaacccctccccrctaagtatgttccccttcggcctagaacttgccctttcctttctctttgtaatgtgcctttagtagccctcatctttgtattttaatgattttttttatcccactgtagtgtaggtattattctctgctctatcctcagcacccaggacagtgccaggcatttggtagtattctgtgtgtgaaagagaaacacggtgctatttgttaaagtaactagggacagtgcatctgaaaacctgaagactggaagggcaggtgaggtgactagacctgtgtcctccagggagcagaaccaagaca

SEQ ID NO: 31131 - DNA, 601 bp, Human
tccccttcggcctagaacttgccctttcctttctctttgtaatgtgcctttagtagccctcatctttgtattttaatgattttttttatcccactgtagtgtaggtattattctctgctctatcctcagcacccaggacagtgccaggcatttggtagtattctgtgtgtgaaagagaaacacggtgctatttgttaaagtaactagggacagtgcatctgaaaacctgaagactggaagggcaggtgaggtgactagacctgtgtcctccagggagcagaaccaagacagaagcagctgraaggagccagaactgactcagattctgaattttctagtgctttaaactaggtttaaaagggaagcaacttccactggggatgtctgagcagctggatggccgtttgccagggaggacggagagggatttaagcatccaccagagtttggccagggttaccttgaagatgcttccaacacctatgttttataagtttacaaaaccagaagagccatttcccatgtgccacccctgggccacctgcagctccttgttgcttccctttttttttcctttttcttttcttttctttctttcttt

SEQ ID NO: 31132 - DNA, 601 bp, Human
ctgaaaggagccagaactgactcagattctgaattttctagtgctttaaactaggtttaaaagggaagcaacttccactggggatgtctgagcagctggatggccgtttgccagggaggacggagagggatttaagcatccaccagagtttggccagggttaccttgaagatgcttccaacacctatgttttataagtttacaaaaccagaagagccatttcccatgtgccacccctgggccacctgcagctccttgttgcttccctttttttttcctttttcttttcttttctttctttytttttttttttttttttttttttttggagacaagagttttgcttttgtcacccatgctggagttcaatggcacgatctcggctcactgcaacctccacctcccaggttcaagtgattctccagcctcagcctcctgagtagctgggattacaggcgcccgccaccatgcccggctaacttttgtatttttagtggagacggggtttcgccatgttggccaggctggtcttgaactcctgacctcaggtgatccacccactcggcctcccaaagtgctgggattccaggcgtgagccgctg

SEQ ID NO: 31133 - DNA, 601 bp, Human
tttctacagcagagcagcagagttggcggcagtcctgatgtttctctgcccttaggttgcgcgtgccgttcatttgttcaggtacttactgagaggctggctggtgccagatgctgtccccggcaccaggaatttggcaaagtagagacttggagctccataaatgcagggaaaaagtgctactgatttttgcctctagcatcttactgtacattgcacagagtaggaactcctagtgcttgaatgaattactaaataggagttgaaataacctgtaccgttttccgaggctctattttgyctgttttttaaactgtgtaaaatcatatgagatacactaaaattgtataaaatcatgtaaaaatatcatatgggatacacctgaactttaatctttaaatattgaagtttattttcccttaacgcttaataaaataaaaaagaaaattgggtgctcagactacccaaatagaaactaccctgaagtataaaagatttagggaatcacctgttttcccttgacatcatctgccttttttgccatttcccccaggaactcaatgagttaaaggaccagattcaggatgtagaaggcaaatac

SEQ ID NO: 31134 - DNA, 601 bp, Human
cccggcaccaggaatttggcaaagtagagacttggagctccataaatgcagggaaaaagtgctactgatttttgcctctagcatcttactgtacattgcacagagtaggaactcctagtgcttgaatgaattactaaataggagttgaaataacctgtaccgttttccgaggctctattttgtctgttttttaaactgtgtaaaatcatatgagatacactaaaattgtataaaatcatgtaaaaatatcatatgggatacacctgaactttaatctttaaatattgaagtttattttccyttaacgcttaataaaataaaaaagaaaattgggtgctcagactacccaaatagaaactaccctgaagtataaaagatttagggaatcacctgttttcccttgacatcatctgccttttttgccatttcccccaggaactcaatgagttaaaggaccagattcaggatgtagaaggcaaatacatgcagggattgaaagagatgaaggtaccaattcacagacgtgtggtctcacgatattaacccaacttaacttaaaaaaaaaaacaacatcctaaagaagaaattcaaagtgcatgct

SEQ ID NO: 31135 - DNA, 601 bp, Human
catttcccccaggaactcaatgagttaaaggaccagattcaggatgtagaaggcaaatacatgcagggattgaaagagatgaaggtaccaattcacagacgtgtggtctcacgatattaacccaacttaacttaaaaaaaaaaacaacatcctaaagaagaaattcaaagtgcatgcttactgtaaataggctccagggtgtagaagaactcacaatggcaggagtgccggcatgggtgtacactcaccattttcccaaatgcattgtttgaaccaagattgaaaatgtaactgcccagtrgaaaaggttactaacatactccctgatgcatgccttagacttaccatccttcccccaggcttaaaaccagtttctcatttcccataggcgtgtgccagacacttgaagaaggttcttggttttcttcactttttgtagtagttgtatacaaaaatgcttcagttgatttgcttctcaaaatatctgatgtctactaataaggccgtcctcacatgccacacttttgaaacatcccaattatttgcaccctgtaaaatgctactaattgaagtaaagactgactatggcattggctttctt

SEQ ID NO: 31136 - DNA, 601 bp, Human
caaaaatgcttcagttgatttgcttctcaaaatatctgatgtctactaataaggccgtcctcacatgccacacttttgaaacatcccaattatttgcaccctgtaaaatgctactaattgaagtaaagactgactatggcattggctttcttggagcgtgtgcacactgcttttagagtgtgcagtgacttcattgcaccagccaggagatgtggttgccctgttccttgacagtaaggtgggcaatcagtgactgtcttccttaggcagcagcggatcatggatctggaagtgggtggcrtatctgttacttccttttcagccccctagaaagtacctgcaagatcatttgaatttaatatcaaagggcaccagacagaggaggtgacatcgatcatgactaattcactatcttcatatctgccacctttcctgaaagggggaaaaataagactctggctttcaattcatgcgaaaaggagccacttggccaggcgtggtggctcacgcctgtaattccacactttgggaggccgaggtgggtggatcaccggaggtcaggagtttgagaccagcctggccaacatggtgagaccccgtc

SEQ ID NO: 31137 - DNA, 601 bp, Human
cttttgaaacatcccaattatttgcaccctgtaaaatgctactaattgaagtaaagactgactatggcattggctttcttggagcgtgtgcacactgcttttagagtgtgcagtgacttcattgcaccagccaggagatgtggttgccctgttccttgacagtaaggtgggcaatcagtgactgtcttccttaggcagcagcggatcatggatctggaagtgggtggcgtatctgttacttccttttcagccccctagaaagtacctgcaagatcatttgaatttaatatcaaagggcacyagacagaggaggtgacatcgatcatgactaattcactatcttcatatctgccacctttcctgaaagggggaaaaataagactctggctttcaattcatgcgaaaaggagccacttggccaggcgtggtggctcacgcctgtaattccacactttgggaggccgaggtgggtggatcaccggaggtcaggagtttgagaccagcctggccaacatggtgagaccccgtctctactaaaaatataaaaattagccaggtgtggtggtgcgcacctgtaatcccagctacttgggaggctgag

SEQ ID NO: 31138 - DNA, 601 bp, Human
tttcagagattctgagaaaaacagaaaatgtaatgtgtgagtgtcgttgttgttgttgtttttaactggctattatcctctaaatccaaagggttaaaaccaaggtacccttgacaaccttcaggcctgcttcttcgactgctatagaattgagttggaagctgaagaacattttacgcacaaagttccttatagctgaactctgcaagaggggagcttttcacaagactgatgtcatgtgggaacggaggagtggagagcacagcccagccccccttcgggtgggggcctgtaatgcatwtgcattcctcctggaatgctgtcattaggcatcattcagtggactgaaaactcccgagtctcactccagagaagctggatggtgctagaatgctgtcccgagatggacacaggggccatgcaaagccccacaggagggcccttgtcatagccaggagggcaccagccacccccaagctaaaggaagtgggcgaacagaagtgccagggtgagcagaagctcaggccagatcccatctcagatcacccgcctgacaggtctagggaaggagcgtcctgcaggcctgtaagctgtcagcaaa

SEQ ID NO: 31139 - DNA, 601 bp, Human
gagattctgagaaaaacagaaaatgtaatgtgtgagtgtcgttgttgttgttgtttttaactggctattatcctctaaatccaaagggttaaaaccaaggtacccttgacaaccttcaggcctgcttcttcgactgctatagaattgagttggaagctgaagaacattttacgcacaaagttccttatagctgaactctgcaagaggggagcttttcacaagactgatgtcatgtgggaacggaggagtggagagcacagcccagccccccttcgggtgggggcctgtaatgcatatgcaktcctcctggaatgctgtcattaggcatcattcagtggactgaaaactcccgagtctcactccagagaagctggatggtgctagaatgctgtcccgagatggacacaggggccatgcaaagccccacaggagggcccttgtcatagccaggagggcaccagccacccccaagctaaaggaagtgggcgaacagaagtgccagggtgagcagaagctcaggccagatcccatctcagatcacccgcctgacaggtctagggaaggagcgtcctgcaggcctgtaagctgtcagcaaagtgag

SEQ ID NO: 31140 - DNA, 601 bp, Human
acccgcctgacaggtctagggaaggagcgtcctgcaggcctgtaagctgtcagcaaagtgagttgggtctcaggccgtcaccagggattgcgctgctgtgactgggcaggaacacagcagagccgagctgccagcttcctgggctgagcctcaggtggggaggccaggcctgaggagcagctaggttttgcaggctctccatttgctcccccaaactctcctgtttttgtctcttaaggggcagccctgaagcacagagctggccaccagctgttcatgagagatgctttagtaggccatrtttatctcctttttatcccaaagagttttccttgtcatatttcagcaggggccattttatggtaagtccttgcagggcagcctcacccaggctctcagcacagtgctgtggaagacaccaggctccctgggggggcccttcgtcggctcttgcttcactgtagataagaaatcagaaaatccttgttgattgcatcaactcctcaggttaatttgacagtaagtcatcaggcatcatctataaagtccagaggaatctgtttgtgttgtttgaaagggcttgaaggccaggtgcagtggc

SEQ ID NO: 31141 - DNA, 601 bp, Human
agcagagccgagctgccagcttcctgggctgagcctcaggtggggaggccaggcctgaggagcagctaggttttgcaggctctccatttgctcccccaaactctcctgtttttgtctcttaaggggcagccctgaagcacagagctggccaccagctgttcatgagagatgctttagtaggccatgtttatctcctttttatcccaaagagttttccttgtcatatttcagcaggggccattttatggtaagtccttgcagggcagcctcacccaggctctcagcacagtgctgtggaagrcaccaggctccctgggggggcccttcgtcggctcttgcttcactgtagataagaaatcagaaaatccttgttgattgcatcaactcctcaggttaatttgacagtaagtcatcaggcatcatctataaagtccagaggaatctgtttgtgttgtttgaaagggcttgaaggccaggtgcagtggctcatgcctgtaatcccaacactttgggaggctggggcaggtggatcgcttgaggtcaagagtttgagaccagtttggccaacatggtgaaacccgatctctaccaaaaatagaaa

SEQ ID NO: 31142 - DNA, 601 bp, Human
aggggcagccctgaagcacagagctggccaccagctgttcatgagagatgctttagtaggccatgtttatctcctttttatcccaaagagttttccttgtcatatttcagcaggggccattttatggtaagtccttgcagggcagcctcacccaggctctcagcacagtgctgtggaagacaccaggctccctgggggggcccttcgtcggctcttgcttcactgtagataagaaatcagaaaatccttgttgattgcatcaactcctcaggttaatttgacagtaagtcatcaggcatcrtctataaagtccagaggaatctgtttgtgttgtttgaaagggcttgaaggccaggtgcagtggctcatgcctgtaatcccaacactttgggaggctggggcaggtggatcgcttgaggtcaagagtttgagaccagtttggccaacatggtgaaacccgatctctaccaaaaatagaaaaattagccgggcatggaggcaggcgcctgtattcccagctacttgggaggctgaggcagcagaatcgcttgaacccaggaggcagaggttgcagtgagctgagatcgcaccactgtactcc

SEQ ID NO: 31143 - DNA, 601 bp, Human
gagagatgctttagtaggccatgtttatctcctttttatcccaaagagttttccttgtcatatttcagcaggggccattttatggtaagtccttgcagggcagcctcacccaggctctcagcacagtgctgtggaagacaccaggctccctgggggggcccttcgtcggctcttgcttcactgtagataagaaatcagaaaatccttgttgattgcatcaactcctcaggttaatttgacagtaagtcatcaggcatcatctataaagtccagaggaatctgtttgtgttgtttgaaaggscttgaaggccaggtgcagtggctcatgcctgtaatcccaacactttgggaggctggggcaggtggatcgcttgaggtcaagagtttgagaccagtttggccaacatggtgaaacccgatctctaccaaaaatagaaaaattagccgggcatggaggcaggcgcctgtattcccagctacttgggaggctgaggcagcagaatcgcttgaacccaggaggcagaggttgcagtgagctgagatcgcaccactgtactccagcctggacaacagagcaagactccatctcaaaaaaatatat

SEQ ID NO: 31144 - DNA, 601 bp, Human
gccatgtttatctcctttttatcccaaagagttttccttgtcatatttcagcaggggccattttatggtaagtccttgcagggcagcctcacccaggctctcagcacagtgctgtggaagacaccaggctccctgggggggcccttcgtcggctcttgcttcactgtagataagaaatcagaaaatccttgttgattgcatcaactcctcaggttaatttgacagtaagtcatcaggcatcatctataaagtccagaggaatctgtttgtgttgtttgaaagggcttgaaggccaggtgcrgtggctcatgcctgtaatcccaacactttgggaggctggggcaggtggatcgcttgaggtcaagagtttgagaccagtttggccaacatggtgaaacccgatctctaccaaaaatagaaaaattagccgggcatggaggcaggcgcctgtattcccagctacttgggaggctgaggcagcagaatcgcttgaacccaggaggcagaggttgcagtgagctgagatcgcaccactgtactccagcctggacaacagagcaagactccatctcaaaaaaatatataaataaaaaataaaata

SEQ ID NO: 31145 - DNA, 601 bp, Human
cccttcgtcggctcttgcttcactgtagataagaaatcagaaaatccttgttgattgcatcaactcctcaggttaatttgacagtaagtcatcaggcatcatctataaagtccagaggaatctgtttgtgttgtttgaaagggcttgaaggccaggtgcagtggctcatgcctgtaatcccaacactttgggaggctggggcaggtggatcgcttgaggtcaagagtttgagaccagtttggccaacatggtgaaacccgatctctaccaaaaatagaaaaattagccgggcatggaggcrggcgcctgtattcccagctacttgggaggctgaggcagcagaatcgcttgaacccaggaggcagaggttgcagtgagctgagatcgcaccactgtactccagcctggacaacagagcaagactccatctcaaaaaaatatataaataaaaaataaaataaaagaccttgaagattgtgatgatgtagtagcaggtgatttgttccacagaaactataaatcgtgagagcctgaactggcatgccagaaacatgggattccactgctttagtgctgtttttctcctttacaggaatttgaa

SEQ ID NO: 31146 - DNA, 601 bp, Human
gcagggaaacagattctccctagagccttccagaaaggcttgattttagcccataagactcattttggacttctgacctctagaattgcaagagaataaatttgtgttttaagctgctgaatttatgacgattcattacaatggcaataagaaactaatacagggttggtttttaattttttgacttaatcggttctttaactgctgccttgaagtgagaatttcacccaaagcaggttttcttcctgcacttcttgaagccggaagtaggacaaggaaaaaaatcctagaatgctgacartgagttcagggttgatgaggtgaaagagtgcttgcggcctcactcactgtcccagctctcaggttctctctcgggctggggtttttcttcctctttaaccctttatctgctttctgtctgttcctttcctcaggaaatccgacagctacagcagaaacaggcgagttctatcagggagatttctgatcttcaggaaacaatagagtggaaagacaaaaagataggggtaggattcccaagtcttgaaaatctactcaaatgggcagcctgcttagcaaatagagttttttcagagtcttt

SEQ ID NO: 31147 - DNA, 601 bp, Human
tttctgatcttcaggaaacaatagagtggaaagacaaaaagataggggtaggattcccaagtcttgaaaatctactcaaatgggcagcctgcttagcaaatagagttttttcagagtctttagtttgcaaaaccgcttgtctgagtatgcatgcaactcccacgtgacacaaagtcgtattaatttatttaattttattaagtagtgaatacactaacttatccaaattgatatgaacttggattgtgacacggactctccatggagggtcttgtgaatgcgtagctgtgcgctctgcctrccccgtggctgggccgggccggtggttgttgaaacagctggagtgaggaggacactctgaggaggtctgatgtgtgcaagtccagacgtcttgggattatctgcctggtggtgctttgagaaaaaaaatctaagcaccaccaggcagatatccccactttgaaatcttccccagggaaggtctccacatacccttctccctccacaagaagaaaagaggcagttctacacttagaattgaaggatagggggaacagaaccccacaaagtagttgtcatgattggtaacaacaaatggttt

SEQ ID NO: 31148 - DNA, 601 bp, Human
ttcaggaaacaatagagtggaaagacaaaaagataggggtaggattcccaagtcttgaaaatctactcaaatgggcagcctgcttagcaaatagagttttttcagagtctttagtttgcaaaaccgcttgtctgagtatgcatgcaactcccacgtgacacaaagtcgtattaatttatttaattttattaagtagtgaatacactaacttatccaaattgatatgaacttggattgtgacacggactctccatggagggtcttgtgaatgcgtagctgtgcgctctgcctgccccgtggstgggccgggccggtggttgttgaaacagctggagtgaggaggacactctgaggaggtctgatgtgtgcaagtccagacgtcttgggattatctgcctggtggtgctttgagaaaaaaaatctaagcaccaccaggcagatatccccactttgaaatcttccccagggaaggtctccacatacccttctccctccacaagaagaaaagaggcagttctacacttagaattgaaggatagggggaacagaaccccacaaagtagttgtcatgattggtaacaacaaatggtttccccaaaat

SEQ ID NO: 31149 - DNA, 601 bp, Human
ggattggaacatctgagaaagaagtagcctttggaggacgatatcccagatttgtgtgtgttgaccgaatatttacgagtgctgcaccctagcatttctcttgtctctgtggagttaccctgtacttcaggaaaaaatggttttcttttttattattgtattaaaacagagtttaacctaatatcactgagtaaatattacgatgagcctatttttgttcccagaaacatggaataatcctaaattcagaaatagctaccaatggagagacttccgacaccctcaataatgttggataccraggtcctaccaagatgacaaaagaagagttaaatgccctcaagtcgacaggggatgggaccctaggtaagtatttgctttccttcggctcctcacacctttccactcagcattggttcaccctccatgcactgctggggttggagccaccgtcgctgatgggttaacagtcaccagcatgccatttgtttcatcacttcatggtaatttccttgcccacccggtgtggtcacccacgtgttgtctggcatgcatctctgtgtagtgcaccatcaatggctcaagtgaaccttttcttttg

SEQ ID NO: 31150 - DNA, 601 bp, Human
agaagtagcctttggaggacgatatcccagatttgtgtgtgttgaccgaatatttacgagtgctgcaccctagcatttctcttgtctctgtggagttaccctgtacttcaggaaaaaatggttttcttttttattattgtattaaaacagagtttaacctaatatcactgagtaaatattacgatgagcctatttttgttcccagaaacatggaataatcctaaattcagaaatagctaccaatggagagacttccgacaccctcaataatgttggataccaaggtcctaccaagatgacraaagaagagttaaatgccctcaagtcgacaggggatgggaccctaggtaagtatttgctttccttcggctcctcacacctttccactcagcattggttcaccctccatgcactgctggggttggagccaccgtcgctgatgggttaacagtcaccagcatgccatttgtttcatcacttcatggtaatttccttgcccacccggtgtggtcacccacgtgttgtctggcatgcatctctgtgtagtgcaccatcaatggctcaagtgaaccttttcttttgctgctcaaagctaccaagc

SEQ ID NO: 31151 - DNA, 601 bp, Human
tggctttgggagaaaccttcagattctggcgtgcagcctgaagttgcagcgtgcaagtgaggcctcatctgtcactggtcaccctctgcgttccagtgttttacaaagaggctggaataaggtcagggtccgtgacttttcattttaatgtagaagctttcatcttatttctttttatttatggaaatgtagacacctccaggccccatcttctcaggcctcgcattccagggaggtacctcattcattatctttatgactattaaagaaacacagctcttttcaattgtgtaaaaaaagytgtggcctagtgcagtggctcacacttctaatcccagcgctgcgggtggccaaggctggaggatcacttaagaccaggaattccaggccagcctggcaacctagcaagattccgtctctagataggtatgtagtatctatataccgttgttgagaaaagataaattaatcaatttccatcatacctttatatgagctacccgaacagctaggaatctgattacgctgctcttactcaaatacacattttataaatctttgataaccattgtgaaatgttgtaagaaccagaaatgtcagt

SEQ ID NO: 31152 - DNA, 601 bp, Human
atgattaaaaaagactaatcatactaatgatggaggagtaggaactctcttttctaatatgctttggtggaatataaaatgtataatgaataagcacatttgaaaacagtttggaagtttcttaaaagtgtacacctgccatatggtctagctattacactcctaggtatttacccaagacaagtgcaaatatatgttcatataaagatttctacacaaatgttcatagcatctaaacaacccaaatgtctatcagtaggtgaatggataaacaatttgtggtatatccatacaatgaaayactacttagcaataaaaaggaataactgattgataaatgtaacaatgtggataaacctcaaattaattatgtggagagaaagcagaaaaaaaaggtacctactatatgatatcattaacctaagactccagaaaaaatgcaaactaataaatagtgacagaaaggagatcagtggttgcttgtgaatagagtggggtagggtaggctgggaggaaaggattacaaagacacatgggaaattcttgggagtcgtggatatgttctttgtcttgattatgctgatggttttgtagacgttta

SEQ ID NO: 31153 - DNA, 601 bp, Human
cttaaaagtgtacacctgccatatggtctagctattacactcctaggtatttacccaagacaagtgcaaatatatgttcatataaagatttctacacaaatgttcatagcatctaaacaacccaaatgtctatcagtaggtgaatggataaacaatttgtggtatatccatacaatgaaacactacttagcaataaaaaggaataactgattgataaatgtaacaatgtggataaacctcaaattaattatgtggagagaaagcagaaaaaaaaggtacctactatatgatatcattaacytaagactccagaaaaaatgcaaactaataaatagtgacagaaaggagatcagtggttgcttgtgaatagagtggggtagggtaggctgggaggaaaggattacaaagacacatgggaaattcttgggagtcgtggatatgttctttgtcttgattatgctgatggttttgtagacgtttatgcagtttcaaaacttatcaaatcgtacaccttaaatatatacagtttattgtatatcaacttagtcagtaaagcagtttttaaaaatcctaagcatattattgtcaaactgcttggaaa

SEQ ID NO: 31154 - DNA, 601 bp, Human
aaaaggtacctactatatgatatcattaacctaagactccagaaaaaatgcaaactaataaatagtgacagaaaggagatcagtggttgcttgtgaatagagtggggtagggtaggctgggaggaaaggattacaaagacacatgggaaattcttgggagtcgtggatatgttctttgtcttgattatgctgatggttttgtagacgtttatgcagtttcaaaacttatcaaatcgtacaccttaaatatatacagtttattgtatatcaacttagtcagtaaagcagtttttaaaaatcytaagcatattattgtcaaactgcttggaaataaagagaagaatcttaaaagcatccagagagaaaagacacaaattctatactttaagtatgtgcaatttttttatgtcagttgtttttgaataaacattttaaaattagtttcaaaaaattagggtgtttaagaatgcctgtagagatggtaaagctaaagaaaatgtggaagtggttatctctggtgcggagggaaggttttgggatcagggaggaatagggaattcaaagttaatggaaatgttcagcttctaaatatggatagtag

SEQ ID NO: 31155 - DNA, 601 bp, Human
gtttttagaaaacaaaatacctgaaatgtactatcatctctaacaacaaaaaattttataacattcacagcaaatatttaagtctataagattatctctctctgtgtttctcatcactttacaatcttaggcacttgctattacatatttattttagaaagcagaagtttcaaaaatcgctttctaaatataaaattaaattataatagataatatttttgagcctacatacacgggagatttggatatatcagtctcttaagaacctctcgtatatcctgaaaaatttactttaaattamcccagtatgggctgcacactgtggcttacacctgtaatcccagcactttgggaggccaaggcaagtggattgcctgagcccaggagttcaagaccagcctgggcaaaacagtgaaacctcatctctacaaaaaatacaaaacttagctgggcatggtggcacacacagtagtcccagctactctggaggctgaagaggggaatcacttgagtctgggaagttgaggcttcagtaagctgtgatcacacccctgcgctccagcctaggcgataggacgagaccatgtctcagaaaaaaaaa

SEQ ID NO: 31156 - DNA, 601 bp, Human
taaattataatagataatatttttgagcctacatacacgggagatttggatatatcagtctcttaagaacctctcgtatatcctgaaaaatttactttaaattaccccagtatgggctgcacactgtggcttacacctgtaatcccagcactttgggaggccaaggcaagtggattgcctgagcccaggagttcaagaccagcctgggcaaaacagtgaaacctcatctctacaaaaaatacaaaacttagctgggcatggtggcacacacagtagtcccagctactctggaggctgaagwggggaatcacttgagtctgggaagttgaggcttcagtaagctgtgatcacacccctgcgctccagcctaggcgataggacgagaccatgtctcagaaaaaaaaaaaatgctacctcagtataataatgtaagtactatcagaaagtaagcgttcttgtctccgtcatcgtctctaattttatctgttgtaccaaatgtgcaaactctgagtaatactgactttaaaaatttacaatttcattgtaaaaatgaaattgcatcttaactctctcctatttacaaaactcatatgtatatata

SEQ ID NO: 31157 - DNA, 601 bp, Human
tttcttccttatcaaccccaccaaaactttctactataaatcccggttttggctgcttaaactgctggtaagtccagaaacttgtgtaccacttttagagtggcatattggttattgacttcctctaagataaaaccaaggctgctaggttgtacaactgcagaggccgtggttcacattatagtttatgtgagtggaggccctgggaaaaagtactcacgtatattttcctcctgagatcgagtatcaggtggccaaatattgagatgattttgtaaattataaacattttttacttcgyttaactagctgtgataagatgtagaactttgtaagtttccttcccccaaaaaaatgtggtaaaagaattattttcctgttaagttgatgtgagtatcaaccgaacattttattttaggaaagatttgttctctaaaagcagtaggaatatcttaccagattatcaagtttaatttgaaaaattgactttgggctgggcgcggtggctcacgcctgtaatcctagcactttaggaagccaaggcgggtggatcatctgaggtcaggagtttgagaccagcctgaccaacatggtgaaaccc

SEQ ID NO: 31158 - DNA, 601 bp, Human
tttggctgcttaaactgctggtaagtccagaaacttgtgtaccacttttagagtggcatattggttattgacttcctctaagataaaaccaaggctgctaggttgtacaactgcagaggccgtggttcacattatagtttatgtgagtggaggccctgggaaaaagtactcacgtatattttcctcctgagatcgagtatcaggtggccaaatattgagatgattttgtaaattataaacattttttacttcgcttaactagctgtgataagatgtagaactttgtaagtttccttccccmaaaaaaatgtggtaaaagaattattttcctgttaagttgatgtgagtatcaaccgaacattttattttaggaaagatttgttctctaaaagcagtaggaatatcttaccagattatcaagtttaatttgaaaaattgactttgggctgggcgcggtggctcacgcctgtaatcctagcactttaggaagccaaggcgggtggatcatctgaggtcaggagtttgagaccagcctgaccaacatggtgaaaccccgtctctactaaaaatacaaaattagctgggggtggtggcccatgcc

SEQ ID NO: 31159 - DNA, 601 bp, Human
ggtgcagtggctcacgcctgtcgtcccagcactttgggaggccgaggtgggtggatcacctgaagtccggagttcaagaccagcctggctaacatggcaaaaccccatctctaccaaaaatataaaaattagccgagtgaggtggcacgtgcctgtaatcccagctactcaggaggctgaggcaggagaatcgcttgaacccaggaagtggaagttgcagtgagccaagatggtgctgctgcactccagcctggacgacagagtgagactccttctcaaaaaaaaaaaaaaaaaaaaaaargggggtctcctttgttgcccaggcttgtctcaaacctcctggcttcaagtgttcctcccgccttggcctcccaaagtgctgggattacaggcatgagccactgtgcctggccataaaattatttttaaatgagactttggaagattcagaaaactcaggttttactatgattacgtaattacagtaacaggataatatagttgtgtacattgtgtgctaagtgggcatttccccagtgtatcctttgtttaaatagcaagctgtgattcatgcatgactagttactcctattagcagaat

SEQ ID NO: 31160 - DNA, 601 bp, Human
ttttctctgtatttccagggtattttgtgtgtatctctataatatggtgctataattatacctttatgtatttatttgcccaactagactgtggatcattaaggcctgtaagccgcagtgcctgacatttaataaatacttgataagtctttgttaaatacatgaatgactgtaattatattcttcccttcattggttgtattatataacatttactactcccttctttcttccttttttcattttctctttttgtaaattttcccttcttcccagttttttttttaaattttcatgtcastcctatcctttttcagtcccatcccaccatcccttttttccttatttaatgcattatctccctcttctgctcttatggagattttctgaattagccaggttttgaggatggggttggcagagtatgagagtaatgatagtctgtctcatgtcagttataaagaaatttgtcctaggctaccagtttcataatagttcatgattagagatggatttagacttcctgatcttttggtgttatatcctaaattattctatatttctgtcactttgaatcctttaagtccattctgcacactag

SEQ ID NO: 31161 - DNA, 601 bp, Human
cctcttcctcacaaaaagtttgctttatcgggcgcttatggttgcaaatggtatagattgtctctctggtttgttggactcatggaaagattatgagagtggttaagagactgagccatggaatgaaagtatatcagcaccagaaaataatgtctcaaagcctgtatgatgtcccacagacacctggtctagcttccaaagctccaagaaagtacccgtcataggtagttgacatccaggattgagtcataatgtgaccatttatctccctgacataataaaaataaatatttagagaaasagaagacagatccagccaagtctgagaagagagttacagattcccaagtagaatatgtctatgaaatgaatataactagataatcagagctagagattagattcattttctcaaaacttctacttactcggaatttcttctttcaggagtcacatttcctactgtataagatagaaaggggtcctttaggatgaggattaaggcttccttcatcccatcttcacttcacacagcgcttatcaagacaatctgcacaatttgagcctatttctggtaattgcattggtacctacttccctt

SEQ ID NO: 31162 - DNA, 601 bp, Human
atatcagcaccagaaaataatgtctcaaagcctgtatgatgtcccacagacacctggtctagcttccaaagctccaagaaagtacccgtcataggtagttgacatccaggattgagtcataatgtgaccatttatctccctgacataataaaaataaatatttagagaaacagaagacagatccagccaagtctgagaagagagttacagattcccaagtagaatatgtctatgaaatgaatataactagataatcagagctagagattagattcattttctcaaaacttctacttactcrgaatttcttctttcaggagtcacatttcctactgtataagatagaaaggggtcctttaggatgaggattaaggcttccttcatcccatcttcacttcacacagcgcttatcaagacaatctgcacaatttgagcctatttctggtaattgcattggtacctacttcccttctctgcaatgccaagatttccctttgtagtgataaacaggcttccacagaatatgttaggaagagtctgtgtcggtcttctgtaaaatggggatatgaatagttcctagctcatggaattgttatgaaga

SEQ ID NO: 31163 - DNA, 601 bp, Human
cctactgtataagatagaaaggggtcctttaggatgaggattaaggcttccttcatcccatcttcacttcacacagcgcttatcaagacaatctgcacaatttgagcctatttctggtaattgcattggtacctacttcccttctctgcaatgccaagatttccctttgtagtgataaacaggcttccacagaatatgttaggaagagtctgtgtcggtcttctgtaaaatggggatatgaatagttcctagctcatggaattgttatgaagatgagttaatgcttgcataaagccttgargaaaatacactgcatgagttactgcccaatacatttaatacatttatcatgtgttcagaacagtgggaagagggctgatttttgtggtataatttcaagatgtacacagtcattaccatgtcattagtgaaaagaaagtggctttggttagataatgaggcatgcctcagatggagtaccatcctttcctacttatcctctgtaagcaaagaagagttttgtattcagttagctaagatggagaacagtctagaaattatagcacttgcctctccagcaaaacttcctaactttagagcc

SEQ ID NO: 31164 - DNA, 601 bp, Human
tccaatacatgctgttttggttactgtagccttgtagtatagtttgaagtcaggtagcatgatgcctccagctttgttctttttgcttaggattgtcttggctatgtgggctcttttttggttccatacgaagtttgaagtagttttttacaattctgtgaagaaaatcaatggcagtttgatagggatagcattgaatctataaattactttgggcagtatggcattttcacaatattgattcttcctatccatgagcatgagtgttttcccatttgtttgtatcctctcttatttcctygagcagtggttcgtagttctctttgaagaggtccttcacatcccttgtaagttgtattcctaggtattttattctctttgtagcaattgtgaatgggagttcactcatgatttggctctctgtttgtctgttattggaagcactaaacatggaaagaaacaactggtaccagccactgcaaaaacataccaaaatgtaaagaccatcgacaattatgaagaaactgcatcaattaatgggcaaaataactaggtagtgtcataatgacagcatcaaattcacacataacaatattaacct

SEQ ID NO: 31165 - DNA, 601 bp, Human
tacagagccaacccgttttttcctccttctattagtatactcatcttctaattttcttacagttttatcacactccaaagaaagtgattcctggacagatatccataaatctgagagagcaaatttccccactagttcccccacaacatattttaccttctctccttgacttatctatcactaaaaagcttgagaatagactgggcgcagtggctcacacctgtaatcctagcagtgtaggaggctgaggtgggcagataacttgaggtcagaagtttgagaacagcctgggcaacatggygaaaccccatgtctactaaaaatacaaaattagctgggtgtggtggtatgcacctgtaatcccagctactcaaaaggctgagatgagagaatccctggaaccgggaggcagaggttgcagtgagctgagattgtgccactgcactccagcctggaccacagagcgagactcagtctcaaaaaaaaaaagaaaatcttgagaatataatagttgcaaagaagaaagtgattctgaaggttttttgcttttttagacttggtattagctacactatatggctaaatgatgtgaacaagttac

SEQ ID NO: 31166 - DNA, 601 bp, Human
aagcttgagaatagactgggcgcagtggctcacacctgtaatcctagcagtgtaggaggctgaggtgggcagataacttgaggtcagaagtttgagaacagcctgggcaacatggcgaaaccccatgtctactaaaaatacaaaattagctgggtgtggtggtatgcacctgtaatcccagctactcaaaaggctgagatgagagaatccctggaaccgggaggcagaggttgcagtgagctgagattgtgccactgcactccagcctggaccacagagcgagactcagtctcaaaaaaaaaaagaaaatcttgagaatataatagttgcaaagaagaaagtgattctgaaggttttttgcttttttagacttggtattagctacactatatggctaaatgatgtgaacaagttactttttttcaatggtaatttttcttctttgaaatcttcacagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatact

SEQ ID NO: 31167 - DNA, 601 bp, Human
acttaggtataccactagctaatcctgttgcagtacagacccaacctctaattatattactctaatataattagaaaaataattaacaaaaatactaattcattcggtcagcaaaaatatattagatgtttactatatgctaggtactataggaaatcaaaacaaagtaaaattctcattctcaaggaaagccataaactatgttcagataagtaaacaaattgcaatacaatgcgataaagactggaatggaagaataaataacttactgtagtttatgatttgtttttgaacatggaakgccctcagtctgaaacactctctctcgtctgctttgtaaacacctgttcctcctctttaaaagtcagtttaagtgttactttctccaagaagcctttctttatttttcctagcatagtcagctattcatcttaatctttttttaccctatataaactaccattatagcagttatcacactgtattataataatgtgcttaggtgtccatattcttcacttccaagcataattactggtctatagtagacttaatgtttctgggatgaatgaataaatacttgactaaatgaaaagtgtca

SEQ ID NO: 31168 - DNA, 601 bp, Human
gcaatacaatgcgataaagactggaatggaagaataaataacttactgtagtttatgatttgtttttgaacatggaatgccctcagtctgaaacactctctctcgtctgctttgtaaacacctgttcctcctctttaaaagtcagtttaagtgttactttctccaagaagcctttctttatttttcctagcatagtcagctattcatcttaatctttttttaccctatataaactaccattatagcagttatcacactgtattataataatgtgcttaggtgtccatattcttcacttccmagcataattactggtctatagtagacttaatgtttctgggatgaatgaataaatacttgactaaatgaaaagtgtcatgaaaagacaaaggagaaggagtggctgactctgcttgattgcatcaagaagacttctcctttcatttatttcatctaatatttgttaaaatcaagtgccatttcaatcagaaaacatagataattctttaggaataattctttaggaattattttaggattttttctatgtattaataaaaagacaagaggggctgaattaaaaagtcaaaaaatcaaaaat

SEQ ID NO: 31169 - DNA, 601 bp, Human
tctctctcgtctgctttgtaaacacctgttcctcctctttaaaagtcagtttaagtgttactttctccaagaagcctttctttatttttcctagcatagtcagctattcatcttaatctttttttaccctatataaactaccattatagcagttatcacactgtattataataatgtgcttaggtgtccatattcttcacttccaagcataattactggtctatagtagacttaatgtttctgggatgaatgaataaatacttgactaaatgaaaagtgtcatgaaaagacaaaggagaargagtggctgactctgcttgattgcatcaagaagacttctcctttcatttatttcatctaatatttgttaaaatcaagtgccatttcaatcagaaaacatagataattctttaggaataattctttaggaattattttaggattttttctatgtattaataaaaagacaagaggggctgaattaaaaagtcaaaaaatcaaaaatatctgtactcagatattttagtaaaggataaataccatgattagaccttgaaagaaattaaacaatgaactggtaatcctgaatgtgaatgtaaat

SEQ ID NO: 31170 - DNA, 601 bp, Human
acaaaaggcagatagttggaataaaattcatccagcttgaaaagtgtggaatccagtggagcttcattaaaaatttagaacacaggtatatgaaccttaaaatcagttcttagggattaacagttcttaaaatcagttcttaggaatgcataatattaagcaccacatcccaggtccaggaacaatttttgtcatctttatattcacacttaatttttctgtgtctcttgacctcaaagataagtgtattcctcctgaaagacttccacatttttggtgacaccagtttccacattggtcatggtgaatagcttaagactgactctgaaaggcacatgaaattgcagttcttcagttaagcctaataataaagtgaatgtggatttacccaaaaattgcattatcactatattgcgaggaaggagagggaacagtgagccatgtgaatgtgttaaaatcctcataataatcctcattaaatttatcataatcatcagtcagtgaataatatctaaaattgagtaatcaagatataacactatacacatattagtttattttttttttttaatttttttttttttattatactctaagtttt

SEQ ID NO: 31171 - DNA, 601 bp, Human
ttttggtgacaccagtttccacattggtcatggtgaatagcttaagactgactctgaaaggcacatgaaattgcagttcttcagttaagcctaataataaagtgaatgtggatttacccaaaaattgcattatcactatattgcgaggaaggagagggaacagtgagccatgtgaatgtgttaaaatcctcataataatcctcattaaatttatcataatcatcagtcagtgaataatatctaaaattgagtaatcaagatataacactatacacatattagtttattttttttttttaatttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttccattcccacctatgagtgagaatatgcggtgtttggttttttgttcttgcgatagtttactgagaatgatggtttccaatt

SEQ ID NO: 31172 - DNA, 601 bp, Human
taagcaagcctgggcaatggcgggcgccccctcccccagcctcgttgccgccttgccgtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctygcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccccggattattcttattacacatattagtttaatacatggaggctaagtagaagaagtagctacaaattttgaaaatgttcggtctctagggatggaaagagaaggtggccaggggactttttttttttttagaat

SEQ ID NO: 31173 - DNA, 601 bp, Human
cagaaatcacccgtcttctgcgtcgctcacgctgggagctgtagaccggagctgttcctattcggccatcttggctcctcccccggattattcttattacacatattagtttaatacatggaggctaagtagaagaagtagctacaaattttgaaaatgttcggtctctagggatggaaagagaaggtggccaggggactttttttttttttagaatagcattctcacaatgactagtattactttgtttaaaaattttttaagtaaaataaatattatggcttaatacatagtagttccycttcccaaaaatttcacattctttaaatacatatatttaaagagctgatttccttgagattaataatgagcaaatctatgaattatatagttctgctctattggcaatttgtgtacttaagacttttgtgtagctaaaactggactggactcctaaatcctgggtgctagtacctgcaagtattacttgagcaccgtcttccccatgtaaaaatagaacatttcttaaattcaaccacggttgtgaaatccaagcttaatttcattcacatcaaaaagcaaggcaaaactttcttcaaat

SEQ ID NO: 31174 - DNA, 601 bp, Human
tcgctcacgctgggagctgtagaccggagctgttcctattcggccatcttggctcctcccccggattattcttattacacatattagtttaatacatggaggctaagtagaagaagtagctacaaattttgaaaatgttcggtctctagggatggaaagagaaggtggccaggggactttttttttttttagaatagcattctcacaatgactagtattactttgtttaaaaattttttaagtaaaataaatattatggcttaatacatagtagttcctcttcccaaaaatttcacattcwttaaatacatatatttaaagagctgatttccttgagattaataatgagcaaatctatgaattatatagttctgctctattggcaatttgtgtacttaagacttttgtgtagctaaaactggactggactcctaaatcctgggtgctagtacctgcaagtattacttgagcaccgtcttccccatgtaaaaatagaacatttcttaaattcaaccacggttgtgaaatccaagcttaatttcattcacatcaaaaagcaaggcaaaactttcttcaaatacagggtaaggcaaatggagaa

SEQ ID NO: 31175 - DNA, 601 bp, Human
cagaggttaattcttacaaagttaaaataaccattgatgatgacttaaaagcttctttagaacggggttccattgaaaggataagtggaaattgggaggtaaaatggcttaaaacagaaatcaatcattttttgcaatttggcagtctgagttattcagcccagccttctcactgaaaacaataaaaatgctagataaaatgtgtttaaatctggccaggtgcactggctcactcctgtaatcccaacactttgggaggccgaggccggtggatcacctgaggtcaggagttcaagaccarcctggccaacatggtgaaacgctgtctctgctaaaaatacaaaaattagctgggcatggtggtgggcacctgtaatcccagctactcgggaggctgaggcaggagaatcgcttgaatccaggaggcagaggttgcagtgagccaagactgcactgttgcactccaacctgggcaacaagagcaaaactccgtctcaaaaaaaaaagtgtttaaatattctaaaaaaaaatcagacaagataatccaaaatctaaatgaaaacaggagccccaagataaacagagcactaacactaccttt

SEQ ID NO: 31176 - DNA, 601 bp, Human
tttttgaacagaatgtaattgaaaatgtgataaaagagaaaaatgtaaaatgcagctagggccatgcttacaaggaaatgtgtaactttacatgtatatatcagaaaagtatatagctcaggaaataagaaagatttaaaaaacagcaaatcccaaaagaaagtagaagtaaatataaagaacgtaaattaatggaacagaaaacaaacacacaatacagaaaattattaatgataaagccaaacttaatttccttaaaatgccaaatactgttgataaagtacttaagactgataaagcraaaaagaaaaggaagtacaaattatgaatatcaaaaaacctaaagacatttatttaaagagtaagactatcttatgagcaactttatatcaataaatttaaaaatttagatgaatggacaaattactgaaaaagcagtgtgccaaaaccaataaagaagaaatagaaaatctgtattaaagaaattaaattcatgttaaaatactttgcacaaagaaaacgccaggcccaggaattctttcaaatatttgaggaagaaatattaaccaattttatacaaaactcttccagaaaaaaaaag

SEQ ID NO: 31177 - DNA, 601 bp, Human
ctttacatgtatatatcagaaaagtatatagctcaggaaataagaaagatttaaaaaacagcaaatcccaaaagaaagtagaagtaaatataaagaacgtaaattaatggaacagaaaacaaacacacaatacagaaaattattaatgataaagccaaacttaatttccttaaaatgccaaatactgttgataaagtacttaagactgataaagcaaaaaagaaaaggaagtacaaattatgaatatcaaaaaacctaaagacatttatttaaagagtaagactatcttatgagcaacttyatatcaataaatttaaaaatttagatgaatggacaaattactgaaaaagcagtgtgccaaaaccaataaagaagaaatagaaaatctgtattaaagaaattaaattcatgttaaaatactttgcacaaagaaaacgccaggcccaggaattctttcaaatatttgaggaagaaatattaaccaattttatacaaaactcttccagaaaaaaaaagagcataaaaggaaacactttctagtttgttctctgcagccagcataactttgatatataagcctacaatgacattttaataaaaa

SEQ ID NO: 31178 - DNA, 601 bp, Human
agagaaagcatgactctggaatccacctgccatcagagctctctccagaccagtgctccttcccttcctcaccttcctgaatgcctcggcctggcacctgaactccccatcgctgctgccaccttcccccacccacttctttctctttcatgtgtgctacttcatcaattttttaaaagaaattctagtaaaaaaagaaaaatacctcatgacgattttctttttaaaatcatttgcttactaactaaatcaaatgttctatcccatttaaaacaaacaaaaaaaccatctttagatcagytttctctctccaactactgcccatctttctgctgtcctttatagcaaaactcttcaagaggcgtctgcacttgctgtctccactctcacttctctcccattctctttttcattcaagtatgtattcccaatactcaaactaaaccacttttgttaataatctataataataatattgtagtgcctactatgtagctgacagcgttctaagccttttacctttattaaatcctcacaacaatcttaggaagtaggtgctgttatcatgtcttttactgatgacactgaagcataggttaag

SEQ ID NO: 31179 - DNA, 601 bp, Human
acctcatgacgattttctttttaaaatcatttgcttactaactaaatcaaatgttctatcccatttaaaacaaacaaaaaaaccatctttagatcagctttctctctccaactactgcccatctttctgctgtcctttatagcaaaactcttcaagaggcgtctgcacttgctgtctccactctcacttctctcccattctctttttcattcaagtatgtattcccaatactcaaactaaaccacttttgttaataatctataataataatattgtagtgcctactatgtagctgacagcrttctaagccttttacctttattaaatcctcacaacaatcttaggaagtaggtgctgttatcatgtcttttactgatgacactgaagcataggttaagtaactcatccaaggtcattacagctagcaagtggtagagccatgatttgaatctagacagtctcccagagcctgtgcttttagatcgtactgcccattttgctaaatccccttgtcagttctctgtacttatttaccttactttacttcccagcaaagcactttcttcacttgacttctcagaaactacagtctcctgtctca

SEQ ID NO: 31180 - DNA, 601 bp, Human
atatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaycttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattg

SEQ ID NO: 31181 - DNA, 601 bp, Human
gatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacayagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcataacaaggaatcccacacttcacaccaccggctgaatttcatggaaga

SEQ ID NO: 31182 - DNA, 601 bp, Human
gccctgagggggtcctggggacttcggagactgggggcttccacctccagcctctccagggctcccggccggggcagcagagggtgtgcccggcctccccgccggcatcccgagtacagggggtaccagccacaggttcggagaacttgtccggcgctacacaccacggcgcccccgcggcgactctcgcgctccggggctcttaccttggccgtgactgccgccaggcagagggagacacggaagaacagggtggcgcggcggcgccgccgcctacgaggcgcagggggtccgggtcagrgtcccggcaggcgctgccctactcggagcggcggtgccaagcacagagttcgggactgcccccggctccaaatgccgcggcgagggtccgggtcccccaagctgagcactgtcccttcttcctcttcctccggggccgctgcctggagctgctcccggcccgggggactcttccgagccaggggcgccccgcatgggcaggggcctgggtcagcctcgggttgggtccagggagcgaccgccggggccgactccacctcccgcgctccaagccgattcgtcccttcagggcagggcctgc

SEQ ID NO: 31183 - DNA, 601 bp, Human
agctaccagtgccacaggaagatgaaaatttaaatgagtgatcctggtagactcaaagtcagactggagccctctgcctttcctaggacgtcaaaatgaggaataggtttttaaaaaatgactatttgttggctgggtgcagagactcatgcctgtaatcccagcactttgggaggctgaggcaggcggatcatctgaggtcaggagttcaaaaccagcctggccaacgtggagaaaccccatctctactaaaaatacaaaaattagcctggtgtggtgctgcacgcctgtaatcctagcracttgggaggctgaggcaggagaattgcttgaacccaggaggcggaggttgccgtgagccgagactgtaccactgcattccagcctgggtgacagagcgagactccacctcaaaaataaaataaaataataaaaatgaatatttgctaacagtttggtagagttcaaggagtttctgaggctgcctgcatagcaaggtggttttcttgcagtttattctttctatttaagtgcatttcccttgagtaaagggacactaggacagcatctaagcaaaaggctcagattaaaggttagactc

SEQ ID NO: 31184 - DNA, 601 bp, Human
tattgctgggtggctgtgggcaggtcccttcccctttctgggtctctgctgccccatctggaaaagaaacctgttggactagatgatgaccctaagggccttttggtcctggcactgcatggccctatgtgccttctggcctgatggccaggcccctgcaggtccttacctgaggtactcatagagcccatacatgggcaggaagtcaatgtcagacaggaacatgtagggagtgctgatgtgcttcatggccacgttgcgcagcaggttcacggggtagaactggccctccttgtacacratgtggtagcccacgttgtggcggctcataagcacctcagagccctgtgcgtagcggaggaactgctgggcctcggcgtctgacaggtagagggccaggctgatgggcccctcccagtgcttgcagatggcctccagcatctggagcctggaagagacagggagggtgagccgcgggacctgggccatccatgcatcatccgccgggcctgttgtggggctctgcctccagtgacacttgatcaaccagctgtggatcaaatccctgctttcaacgttgactcactcagttcctttacct

SEQ ID NO: 31185 - DNA, 601 bp, Human
aaacatgcctacccttccatctgaacacataacgtctgtcatccatgcacaaaaaagtacatggcacgtaccggcatggggagaggagggagattacaaggacgttgtctggagaaagcggtgctttcctggcctcacaatggactaaggcgagcgacaaacttccagatcgatagctttggcatctgggtttcccaggagaaagaaggccttcgagcacccccagagtacagcagctagagccactcacctgaatgtgaagagggtccccatgtccagcattgacagcaactccgctttygacttggggaaggacagccggtagcgcagtgtctcgaacgcggggacaatcattgctttcttggtgttggcaagatcgagctggatgacagacttcctgaaaagaggggacaggcagagagacagagtccctgtgacaccaggccaaggtctttcccccatgagggcggggtggtcattggcccggggaagtgtgggaaagaaagctcaggtcatcctctcaattaaagatggggaaactgggccaggtgcgatggctcacgtctgtaatcccagcctttgagaggccgaggcaggagga

SEQ ID NO: 31186 - DNA, 601 bp, Human
tgagaaaatataaagagtctggcgcagtattgacatctaagaggaattcaataaatgctagttttataacaaagtggttaaaagcaatggttctggaggctgcctgcctgggttccaattctgtcattcaacaggtatgggtacattaactacttggcacctttgtttccttctcttggcaaaacggacacagcaatatctacttcatagatttatgatgattatgtgacttaattcacatacagtactcagagtagtttctgatatatggtaactcctcaaaaaaaaaaaaaaaaaaaaagagaaagagaaaattctctttattatttctccttgtttgcttcccagatatgatgtcaattcctggtggtcttgctctcagtgatattgacagccatgttattggtcatccacctttagaatctaaactctcagaaaattataatgtgaaaaggaagggaaaacaatgggggagacggcgccattgcactccattgtagggacagctgggtcagttctagtcatctggctgaggaggcagctttgatcagtttagcctggacactggcagcttgcagaaaggctgggcagcacagggtgc

SEQ ID NO: 31187 - DNA, 601 bp, Human
gtgaaaagagcatgggcttgggtgttttcgagctgagttcttccttttactgacgttgtggctgggagcaggttttattaactctgttgaggttttgatcatttgtaaaatagggataaaaatgcagctcacacagtggtgagtatgaagtgtgcctgtgtaagtgcctggtgggtccagtgtctgacacttgcttatcagagtgtgtaataggccagtcactgcatatctagtaaagggtcattttagttccttgtatgatgatataagtttaaattttttttatataaaatgtacattktgggaaattttggaaatacacaaatgaaaaaaatttaaagtgacccatagttcttttctactaggcctaaccatcattaatgagaaatgagagctttgtgtttttcttcctttttttttttttttttttttttggagacatgattttactgtgtcacctaggctggaatgcagtggagtgatctcagctcgctgcagcctccacctcctgggctcaagtgatcctcccacctcagcctcccaagtagctgggaccacaggagcgcaccaccatgcctggctaatttttttgtagagacag

SEQ ID NO: 31188 - DNA, 601 bp, Human
cagacactgagtttgtttcaccttcatcccagcttccaaatgctaagttggtaaagtaattcgccctctgtctaatgctctcccaagcctcctaaccccactaaggcaatcctagggatgttcacatctttgtggtgacagtaatttgtggctaataattcctgagcttgcacaattacagtatgctgatttttccgtggcaggaatttgatagtgcaatatacacagccctttttctctttctttgaagtattagtctcagccgaacttcattatttgcccttatccataatttctaggrccctgttgctttagattattaagatatcagataaagtaatccatttttaaaataaatgtgacattttacagtgtggatgaaatgctaccacgtttggtgtttgctgagaactactttactttgcataaaaaagtccattattacatggtcggtgacacttaggctttcatttgtttttgaacagcatgatgtagaaataaataaaattatatccacaactgcatcaaagacagaaacaccaatagtgtctaagtctctgagttcttctttggatgacaccgaagttaagaaggttatgga

SEQ ID NO: 31189 - DNA, 601 bp, Human
taaaagtatgagttttcttctcttttactctgacagtgaggtagatataggagaactgacagcatttgggaaatggcatcatcttcttcctttgcagtgattttgatttgcctcagtcagtaatttctttagtgtgtagtaaattgtgaagctgacactactttttggctaaaaatctaagctatgcctgaagcttctcgagtgtatttctcttctgaaacagagttctgtgctatttaaagtggtaaataggtagaaatagcttctatataacctaataaaataaatggtttagtttgcygggtttttttttaagccagtcggacaccaccagttgtttatcactgtgcagtgatacgggccatgccccatgagcagaatatccttaaaatatgatcagaccaatctcaacattagaagattctttatcctgccaaacactgccttcttgttttgtgttggtttattctgtcatctggccaacaaatttactgagggtctaatatgtgcccggcactgtggattcaaacacgaacagcccctgcccttgaggagctctctgttgttgggatagcagggagagacatagacagaagtgatt

SEQ ID NO: 31190 - DNA, 601 bp, Human
ggaagaaaaaatttttcatttcttacatttccatgtagtttggggacaaggggagggtggggaatatggtcaaatatctttatatgtatgaaaaagaatgttgcttcttcaatgagaaatctatgcattaagtagaaaatatttgagatgagtgtatgaaggccagtcacattttaatattccaaatatcatttgatccagcagtctggatgtaactcattaagtaccagctatctacagagctctgcatttgaaagcttccagatgtcccacttttaggtttttttttttttttttttttaatatggagtctcactctgtcaccccaggctaatttttgtaattttagtagagacgaggttttaccatgttgaccaaggggtagtcttgaactcctgagctcaggtgatccacccgcctcagcctcccaaagtacagggattacaagcatgagccaccgtgcccagttgactttgtagattcttttatttatatatttatgtcttgggaaatgcctgtgattttaaaaatcgatgatttgatcaaggaaggctattcattagaggcaggaaggacagagaggttggggttgaagagaagc

SEQ ID NO: 31191 - DNA, 601 bp, Human
aagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcataggsagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatg

SEQ ID NO: 31192 - DNA, 601 bp, Human
tgcaaagactaagttacttatcttttctgactctgctcttcttaacagaagacagaaccctcctcccactttcaaggtgttacaactgaactcaaggtgcagctggagtaacaccctcctgcacaagtgtccggtcagcacccctttcccacctcgagggccccgcctgagcccagagacaccgcgaacaacaaagatggcttgggcagagttggagtttatttgctgcagttccttggcgctagtttacaaggcaaaaacaaacaaacaaaaacaattagaataattatttcttaaaaascctgtcaacaactttcagtcatttctttatatttttgtattttgacaaaacttcttttaaacaaatacaaaataatctaaaaggagaaaaactatacatagattatttacacctctgataaatagactaatactgacccaggtgcctctctgtctaggaaacacttgagaaccaggccagggcccgggccagctggacaggctccagcaccggcccaaacacgcccagacctcggcaggcaccacctggttctcccacccagaaagttcaggtttccagcctggaccctcttctgtcacc

SEQ ID NO: 31193 - DNA, 601 bp, Human
ccagagatgctcgccaaccctaaaggatcagaggagccgtggcgacgcggccctgtgaaaacccgcagctcctccacctgcctcctcggggctgcgccctgcaccgccctggtccagggtcctgtggaggggcggggcgagacggccagccagccagccacctgctctgcctggactggcatgctggccctggcggagtggcaggagctgccctgagagtccctgagagaacggcaggaaaatgctgcgtgtcacggctcccttcatactgtaatgaggaggggcagggccagctcacacrgcgcctgcaggggaagacagagatgcgagaggcagcccggccacccccctcactccagtgcaccccacggagcagataaaggcccatcttcccctctagggggcccaccacaaaatgcatccagagtagtccagttagggctggttttgaggcagaaaaagctgaagccctacggggatcggggaagtcctactccttcctctagaacgaggactggagtctggggaagaggaagaaaacccaaaatgaaacaggttatccggaacctctgtcccgataaccttcctcacagttttggtt

SEQ ID NO: 31194 - DNA, 601 bp, Human
tgactcacgactttaacttcaagccagtaacatcctgacagcccaaaacaaaggaaaactaaacgggaggtgtcccaagggtataaactacatagcccactcctgcgtgcttgccgctgccattgcaggaggggcaacttctacaccccatgtgacattcactaagtgaaacgataaagcagacagacggcacaggaagaagtgatttcgagtctcatctttggcttgaacaatataataaaaaattagactaaataaaagcctgatcacgcttttcagttttttggttttgagttttttwaaaaaaatctttgaaatgcccatcccctttctcccctcaaaatatctcagcaaaaatactcactggttttttggagtcctccacttcccggatactcagattctctaaagggatgattccacggggctccttatcctacagaacagttgaagagaggaagtttaagatcacagtttaaggacacacactgtcagattcctcgccggtgactcagccgaactttcctgctttctcccaggacatgaagttcataaatcagcctgagggaactccttacattctaaacaagaataacaccaa

SEQ ID NO: 31195 - DNA, 601 bp, Human
tatgtgctagtgtcctgaaaacaaaatctcccgggtcctgggtgagaatcaaagcagaattcctctatcaaggaagaatcaactcgtactgagaggtggcctcaggagccttttccgttctgggcttctcacctggagcttataacagaaacagctggcaaatacagccatggcaaaacaagctctggcggtggtggctgggaggctggcaagggcctcccttggttctttttagtatttctcagcacaaaacactggggtcatggctaggcacaggggctcacgtctataatcccagcaytctgggaggtcaaggtgggtgggtcgcttgaggtcaggagttcaagaccagccggccaacatggtgaatccccatctctactaaaagtataaaaattagccaggggtggtggcacatgcctatagttccagctactcaggaggctgaagcatgagagtcacttgaactgggaggtggaggttgcagtgagccaagattgcaccactgcactcccgcctgggtgacacagggagactccctctcaaaaaaaaagaaaaaaaaaagaaaaaaaaaaaagttggggttggggccgtgaagtta

SEQ ID NO: 31196 - DNA, 601 bp, Human
gtgggtcgcttgaggtcaggagttcaagaccagccggccaacatggtgaatccccatctctactaaaagtataaaaattagccaggggtggtggcacatgcctatagttccagctactcaggaggctgaagcatgagagtcacttgaactgggaggtggaggttgcagtgagccaagattgcaccactgcactcccgcctgggtgacacagggagactccctctcaaaaaaaaagaaaaaaaaaagaaaaaaaaaaaagttggggttggggccgtgaagttatgctgagacagacatgaargaaggaaaaatttccccaagcctatctgaatgaagctacacctgctgtcaaatcgggaccacaggctttctcttcctccacctctctcccatcaagggaacattttctgaacatgaaccactcaaaacttatccctaaggccttgacctgtgaagctatgcatggcattctagaaacacttcttgtgcctgctcttttgctaagacttaacctacagacaataccgcttctccaatcttcctaaatagcaaggatcatggggcataaatctcatacctccgatcatgctttctctcttgc

SEQ ID NO: 31197 - DNA, 601 bp, Human
acggggaacatttccacgtggaaagaaaagcagacatgaaacaagcagacagatcaatgtgcgcctaggacagtccctgtggaactcacaggaccacctcccactgcacggctcctcaggcctcctgtgacctccccgagacatcaaggccggatgccatcttcccctacagttgagaacaacctgacaagtccctgaagcatctcagtaactgtgcgtgtttggggttgttctttttaagtgtagctactgctcagggaatgcttaggcacaaacctgaggggtcttgggctaagaaaayatgtttccccaaaaaaaccagcaaatggagaggagacaccaaaaccataaccaggagaccgattcggggctttaacgaggactcgctgaaaaagcgagggagcaaaacaaaacataacaacagagccgaggctgttaatacccttctctgatccccaggaaactaaacacgaggacttcagggagggttttttggtttggacttgtttttttcaccttcactcggtatcattttgagtttaggaaataccatttccccttttcgtgcaaaggcaaatgtcttaagtatcatctaatttag

SEQ ID NO: 31198 - DNA, 601 bp, Human
aaacaaaataaccaaaaataacgaaatcagaaaatgctgcagtaatgacagtggcctagcagagcgagcgagcaggctgagggttacatacctcctggagtttggggcaaggaaaaggagagccaaaatcatggaaacatacaaatgagggagaaaagaaaattaaaacaaagaaattaaacccgattccttaatcttaaagtgcaatgtatcagtcacattcatgcctgcctggggagagagctgaactaaaaacactcaacgggcaaatgatcccactactgtctggcacgtgaacgasgggctcttacatgccacgttccacctcatcaaggcaagatttgaggcactactggaaacctggccccaaagatgccacaaatcggcttttacaaagccaatgtttactagtatatccagaatcagagcaaagaaagctaaggttatttcagggaaaattaaatgtctttcttgagatggctgtcactttttaaagtgtgtgtaagaatgcacacacatatacccatgagtacacatgtactgatgtgtatacacaagaatacacattcttatggctatatgcatacacagacatatacac

SEQ ID NO: 31199 - DNA, 601 bp, Human
tgctaatgtgagaacccaactcatcaaaggctaaagcagaaggcaacagaggaaagtaccctgctagtgtccaaaaaaaaaaaaaaaaaaaggacatcattatgtccagagagtctagagctctatgttctgaaaccattaataaagtaaacacatgtggacatgaatgtgtatgaaaaccctactaaagtctttcctattgattaccctgtcaccttcacggcaaggcatgaccacaaatctcagcaatacaagctcatcacttctggcaaagggaagagaaatgcattttcagcttttytaaatgaacaaaataattaatgtggctgattcagattgaaaaggaggggaaaaaaaaaagaaaaaaaaaaaaccactgcccaagaatgagtaagagtgctgtggattgagctgcagccaagggctctaggcttgccatgcacactgcctgtgggggagccagatgcagaaggaagtgacgatgcactggggtgggggcaggagcgccaggtacaaatctgtgggatgggaagtagaaagatggacaaggtcggccaccctcccagtggttatggggacagggaaggcaaacggaccaggt

SEQ ID NO: 31200 - DNA, 601 bp, Human
aaaaaaaaaaaaaaaaggacatcattatgtccagagagtctagagctctatgttctgaaaccattaataaagtaaacacatgtggacatgaatgtgtatgaaaaccctactaaagtctttcctattgattaccctgtcaccttcacggcaaggcatgaccacaaatctcagcaatacaagctcatcacttctggcaaagggaagagaaatgcattttcagcttttctaaatgaacaaaataattaatgtggctgattcagattgaaaaggaggggaaaaaaaaaagaaaaaaaaaaaaccrctgcccaagaatgagtaagagtgctgtggattgagctgcagccaagggctctaggcttgccatgcacactgcctgtgggggagccagatgcagaaggaagtgacgatgcactggggtgggggcaggagcgccaggtacaaatctgtgggatgggaagtagaaagatggacaaggtcggccaccctcccagtggttatggggacagggaaggcaaacggaccaggtgctcagggaactgccttgaaacaaaacctggtcaaccaattcaagggtaaaaatgtggagcacagacacatgtgg

SEQ ID NO: 31201 - DNA, 601 bp, Human
ggagcacagacacatgtgggcaatatttatggtggagtaagtctgtccccagtagtctctgtgtcccatgggggcaatgactatgaagtcacttcccttttggaagccgacctttgttagaacagaactcataccaaagtctctctggagtcctctataagccaccccctttcctacatggtgcgtgtgtgtccatgaatgtgtgtgaacatgcatgcgcgtgcacacacacgcacgcgcacacatgcacacgcacaaacacgcacacgcgcacacacgcacgcacgcacacacgcacacrcaccgcctttcttcctaagtctcagctttaggagccctgactcagaggtgcgcttaccgagtttcaatagccagccttctcggtctggattgaagaaagtgtgagtgaggtcattcccgtcgtcttctgggattttaaagggttcattttttatgctctcatagagattctgggataaaagatgacaatttatgtctctgattctagaaatattttttcctcctcccctttctcttcattcattccacaagcattcatgtgcctatagtaagccaagcctgctagatgctgagactagaa

SEQ ID NO: 31202 - DNA, 601 bp, Human
tgcccaggctggtctcaaactcctagcctcaagcaatcctctcacctcggcctcccacccaaggtgctgacattaccagtgtgagccactgcatgcagctaaaacatggtttttaatagctgtgtatttcgtagttcagaggtaccacaatttaaattcatagtgccttaatgtcagactttcaggttatttccaacattttactattataactatcattgagtaaacgttcctaggcatgaatctcagcccttttgttttagaaattatctggtgccaagaaaataatccagtgtaaaaygcccatcataaactaggatgaatgatcgtatttacccgtggactggaacacgccattattgcactgacaatatcgctgggcaaacgcctccatcatccggtcgatcttctgggcctctccgggtagccggaagctccacaggaactgcctgagtgggtaaagacagagtgttccagaacttggggaggcaatttatttctctatgaattgttaaactgccaatgattttttttttctttttttttttgagatggagtctcactctgtcacccaggctggagtgcagtggcgtgatcttgg

SEQ ID NO: 31203 - DNA, 601 bp, Human
ggccaggctggtctcaaactcctggcctcaagtgatccacccgcctcagcctcccaaagtgctgggagtacaggtgtgagccacggtgcctgaccactgccaatgattttttaacatcaaagtgcaaagggaaccctgctgggctgcagccttctgttactgtaactctgaacagatgcaaagttgccatccacaccactgttaccttaatcaaaagtaaaatttttcttaggaaaaagtgaaaaattaggagggaaacaatccctactgaggagtggtttccctcctcagaataatatayaagactgaaacatagataatgctcattttaaacaaacgctatttccggaaacaatatgggtggcagaaaaagagaagattgtcttgtcaaagcattaacaatcgatccctttaagtcaaagaaagaaagacccacagctgacaggtttaattgtggattgtttccatccagctaaatgatagcacaaaagatgaagtcattatttacacctacagcagtgaaaatacagaatgacagtttcttaaaaggcatgaggtaacagatttaataaaaaattaaggtttacttttttctttccaa

SEQ ID NO: 31204 - DNA, 601 bp, Human
aggtcaggagttcaagaccagcccagccaacatggtgaaaccctgtctctactaaaaatacaaaaattagccaggcatggtggtgggcacctgtaatcccagctactcgggaggctgaagcaggagaatcacttgaatttgggagttggaggttggagtgagtggagatccaccactgcactctagcccgggtgacagagtgagactccgtctccaaaaaaaaaaaaaaaaaaaaaaactttatcagggtataatttacttataatactcctactgtaggtacatatttgaatttttagtrtacttactaagttgtgcaacatcaccataatccagttttagaacattttcatctcccctacagaattcctcacacctttttacagttaatccttacttctacctccatccccaggcaactattaatctattgtctgtctccacagatttgcctattctggacatatcatacaaacagaatcataaaagatgtggattttcagatctggcttctttcattagcataatgttgtcaaggtcatggtgctggagcgtgggccagtactacatgccttcttgctgctgggtcatcttccatggt

SEQ ID NO: 31205 - DNA, 601 bp, Human
taaaagatgtggattttcagatctggcttctttcattagcataatgttgtcaaggtcatggtgctggagcgtgggccagtactacatgccttcttgctgctgggtcatcttccatggtatggataaaccacatctgtttatccattcaccagatgatggacacttaggctgtttacagtttgggacaattatgcagaaggctgctatcagcatttgcatatatgtctttgtgtggacacgttttcattttccttgggtagatacccaggggtggacactgctgggtcatacggtacatctrtatttaactttttaagaagttgctaaataataggcagttttcttgactgtatcagaatgaaaaatgcagattcacagaccaagcttctcaaagtctggtccaccaaccagcagccttgggagcatatcagacgtgaagacgctccgctcgtttatacatacacgtcacctggggcctcaacaaaacagattctgactctatgtctgagaaggggcctgtgcttctgctgtatgtttaacatgatcccatgtgtggagtctgagtagcaaggccctggaccggctgagtaactcagaagta

SEQ ID NO: 31206 - DNA, 601 bp, Human
gactgtatcagaatgaaaaatgcagattcacagaccaagcttctcaaagtctggtccaccaaccagcagccttgggagcatatcagacgtgaagacgctccgctcgtttatacatacacgtcacctggggcctcaacaaaacagattctgactctatgtctgagaaggggcctgtgcttctgctgtatgtttaacatgatcccatgtgtggagtctgagtagcaaggccctggaccggctgagtaactcagaagtacaaggggcagaacctaggaatttgaatttttaaaacctcctgcartaattctggtatgcacccaaatttaagaaccactgccatcaatatcaatagtaattttataatctccgagagcaaaaaagttgctcggaaataaaatcataaaatgttattgccttaaagaacacatgtgttctctagctaaatccatggagggaagaaaatattcctaagtgttttgagggttggtgttttttgtgtttttgtttttgttacaggcagggtcttgctctgtcacccaggctggagtacagtggtgtgactgtggctcaccgcaacctttaactcctgagctcaagtgat

SEQ ID NO: 31207 - DNA, 601 bp, Human
tgactctatgtctgagaaggggcctgtgcttctgctgtatgtttaacatgatcccatgtgtggagtctgagtagcaaggccctggaccggctgagtaactcagaagtacaaggggcagaacctaggaatttgaatttttaaaacctcctgcagtaattctggtatgcacccaaatttaagaaccactgccatcaatatcaatagtaattttataatctccgagagcaaaaaagttgctcggaaataaaatcataaaatgttattgccttaaagaacacatgtgttctctagctaaatccayggagggaagaaaatattcctaagtgttttgagggttggtgttttttgtgtttttgtttttgttacaggcagggtcttgctctgtcacccaggctggagtacagtggtgtgactgtggctcaccgcaacctttaactcctgagctcaagtgatcctccggcctcagcctcctgagtaactaggactacaagcagatactaccacaactggctactttttaaaatattttgtagagacagagtcttgctatgtaacccaggctggtcttaaactcctggcctcaagcaatcctcctaccttg

SEQ ID NO: 31208 - DNA, 601 bp, Human
agagactggccgtggtgagctggctgccttctgtggaggactcagcctcactataccctgaaggcactgcccacaggagtctaaaacaacaaatcaaacagtcctacgaagccagacaggaagacttaggcttagaaaaatacagacatgtagtgaattggaaacagctcatttattgcattaagcagtcagaaaacggtctgggaaccccattcaaaactaaactctcaaagtcactaacatttcatgaaaataaaaggaaaaaaaaaagcagagtccttgtccttttatactatcatckcatttctacattttcttcccttaagcattaggaaggtgcaaataagctcacgattatcctcagacatgactggacactccagccctttgaaatcgtatcagcagcattcattaagcttttcctttacacaaaggaaaaacagaaactttaaaatgcacaccgacagtggacaacagaggggagtaattcacataaaaatttaggagcagtttaaggctttctgggacctttgaagttctccagttcaatttttttttttttttttgagacggagtctcgctctgtcaccaggctggagtg

SEQ ID NO: 31209 - DNA, 601 bp, Human
agttctccagttcaatttttttttttttttttgagacggagtctcgctctgtcaccaggctggagtgcagtggcgcgatctcagctcactgcaacctccacctcccgggttcaagcaattctcctgcctcagcctcccgagtagctgggactacaggtgtgcaccaccacacccgtctaatttttgtattttgagtagagacagggtttcaccatgttggccaggatggtctcgatctcttgacctcgtgatccacctgcctcggcctcccaaagtgctgggattacagccgtgagccacygcgcccggcctccagttcaattttttaaacactggaagaagctcctatgttcaggaggccttgcggtgaaggatggaaggcagacattatgggtgtgtatgtgcttgctagaattagaaagacacaaagctgactttttccttcaatgtgccacgtaagcataattaaggcctgggtgctttaaggaattacaaccacagaagccacctggcagcagggcagactcacctttcctctgtggatcccaggttttcaatttcattagctacttctgctatctcatccttcagcctctataaa

SEQ ID NO: 31210 - DNA, 601 bp, Human
aaaactgcttaagattactattgttatgagttttgtgacagtgtctagtcaagttcattgatttacaccttagagttacttatttatcttcaatattcctggaaaggaagataaggcattcttatttgagggagacagtaacagtaagaaaagaaaaaaaaaagaattcttaaaaataagtttgccaaaatttaaaaaatcaaatcaaagcattgtagtaaagtcagagcaatctcccagaaagatagaaaggaaagaaaaagaattgaaaaacgagagagaaataatacataataggagwtccaaaaagaaaggaaaataataggaagacaaattatcaaagaaataatataaaaatattttggagaaatgaagggtaagatattccatactgataggactgctcccagcaagagaagaaaaacaaagctccaagatgctctttgtaaaatttaaaaatacaaaaagatcccaaaagtctccagaaaaaactggtccatgaacagtaactgccatcaggatggtcaacagacttctcaaaagcagcactggaagagagaagacaatggcatgggaattttggaaacccccccttagcgtg

SEQ ID NO: 31211 - DNA, 601 bp, Human
gaaagagagaaaagagttacaaaaaaaaaaaaaaggccttttgctttctccctggaatgaaatacgtcactatcactgggagaaaactacaatatacaatctacagaagtacttaaaatcaattatctttaaggaactagagaacagcaaactgctgcggggaacagacctctcagcatgatttcccaagagacatctagagagcagcacacccttatccttgcacacagacatggcagtcccacttgcaaccatgtgagaacacctgctcccgtccctcccctggctgagcccgatctamagggagtgtgaaagtacaccagggaatcccctccactatggcacagccaggggtgttccaaaccgctgcgtgctgctactagcatccacagagcagaggggtgggagtaatgttttcttaccacctcacactgtagaaactgagatttacccactcaacttacttttgtaatacagctcattctaaacctttaagttagtcattcccagcctgtgggctgcagccccgggggagccctggagctattattacattaggtccattatctttagagtcagcaaattaaactgcatacagggc

SEQ ID NO: 31212 - DNA, 601 bp, Human
ggcaaacccacccccttacagtttttcaaacaaaacactgaatagaattctgacatatcaaaaagactgaaagaaagcttgggctgtgccttctgaagccaagaagagcccaaagtccaacttttcaagtcccacagtgatctctgagcagcctctttataatcttggattctgagaaacagagcttgaagaccccaatgccagaacaaactgaaaatcgggatattaatatcctcccagtgagttctcacaattcagaaactggtgaggctatgcttgcaggtgtcagtaatcattaggracagctgcaggaggcagggaactcacagcctctcttccaaacagaacagaacaacaaaaaaatctattttccaagccaaactcaagtcacgtatttattaccaggaactcaaagagaatgaaccgagcatctattttgtatctacacaggtgcatttacagtcttcacacataacacttaaatcacatttgaattataaatagtaaacattaaagacaaaacttttgatgttttaaatttatcaagacttaaagacatttgtctctgtattctgaatcaagcacattctttcctcaaatg

SEQ ID NO: 31213 - DNA, 601 bp, Human
gtgcgatctcggctcactgcagcttccacatcccaggttcaagcaaatctcacgcctcagcctccggagtagctgggattacaggcatgttccaccatgcccggctaatttttgtatttttagtagggatgaggtttcatcatgttggccaggctggtctcaaactcctggcctcaagtgatctgcccacctcagcctcccaaagtgctgggattacaggtatgaaccttagatccctgaattagtttgttcccaggaactcttttccatactgttacctactgaatcatatgtagtttayagtcagtctactaatatctttaagtaggaaatactcatgtgatacacctgtctcctggaaaatgagaagaaaacaaacaaaaaatttaaaatccatctggtatagatcactagaaacaggagaaaaatacttcatttttcctatcctaaactgttctactagtatgctacccagagcacacctgaggggtgtgctacattctgtacaaacaactatctgagcatgaacctccatgctatcccacagcctcggtgactgagtatgcttctttttctattagcattcaatatacacactcag

SEQ ID NO: 31214 - DNA, 601 bp, Human
aaagtcaatgtcacaggtacacttcacttttaatgacctgcatagcattctcatgttcttctttagatacaagcttgccccagaaggtgtccaacctgcgcagatcttctacttaaacctgcagcattcaagaatacctaggaattgctgaaattactagtggttttttgtttgtttgtgttgcccagtctggagcgcagtgggcgcgatcttggctcactgcaacctctgcctcccgggttcaagcaattctcctgcctcagcctcccgagtagctgggattacaagcctgcaccaccaygcccggctaatttttttatttttagtagagacggggtctcaacaggttggccagccaaaattactagttttgaaagatctcagttctaattaatttgccatcaactaactgcattggtatttttctcatttaaaaaaggggcctcaaatattaagaatcaagttgatgacagatgtttaacataaatctagttatttcttatttccctctctctccactgttccaatatgagaatggaacattatcagtaagcaggcagggacgggtagggggagaaaccatttaactaaatatttagtg

SEQ ID NO: 31215 - DNA, 601 bp, Human
gtttccccataacgtctctcttggctcagaagcctgaggaccatgaggctaccccagcaataccgacccaacatccaagacctccttcctgcccccgcacaatggctgccaactgtactggaactatatactgagggggacttactgctgggcttcagcgccaatggctggcatattcaaggaattcccgaatcaaaacaactgtgaagctagctcaggggtttacttttaggatggaaaagtgctatgaaaagtaaaaggagcaaaagaggttagatggtgagtacatatcccaccactraccttatctaaagcatatccatgtgataacatgtagcttagtaagtcaagcctgcccttcttgattttgaatttggccacgagttggccacctatgacataatgtcaatgagctgtaaaagcagttaaggccaattacagatatttgagggaagaaattattaaatggctgcagagtcccaattaaagacagtgcatattaattaaagacaattagactgagtgatgagctgaacatataaggataaataaaaagtaaagttctagctcctaatacaataatctcttcaatgaagtattt

SEQ ID NO: 31216 - DNA, 601 bp, Human
tcccttaatgctgatgggatagcaaaaacaagagacaatggctgctatgaggctgatgttttcatgataataattaatcacagcatatctatctggcaaatggtaggaactaaagaggtctggtgcccctgccagcccaactttgggtcccattcctttttggtttccccataacgtctctcttggctcagaagcctgaggaccatgaggctaccccagcaataccgacccaacatccaagacctccttcctgcccccgcacaatggctgccaactgtactggaactatatactgaggggsacttactgctgggcttcagcgccaatggctggcatattcaaggaattcccgaatcaaaacaactgtgaagctagctcaggggtttacttttaggatggaaaagtgctatgaaaagtaaaaggagcaaaagaggttagatggtgagtacatatcccaccactgaccttatctaaagcatatccatgtgataacatgtagcttagtaagtcaagcctgcccttcttgattttgaatttggccacgagttggccacctatgacataatgtcaatgagctgtaaaagcagttaaggccaattac

SEQ ID NO: 31217 - DNA, 601 bp, Human
atcaaacgaaaataatatttaaccatgtattttacgttaccaggatcatagatggcagaaatttttaaattattcaaaaagtttcatttataaagagaacaaaaaatgatttagtaaaattgaagatgtctaaactatgaactcccccattcattttcccttaatgctgatgggatagcaaaaacaagagacaatggctgctatgaggctgatgttttcatgataataattaatcacagcatatctatctggcaaatggtaggaactaaagaggtctggtgcccctgccagcccaactttsggtcccattcctttttggtttccccataacgtctctcttggctcagaagcctgaggaccatgaggctaccccagcaataccgacccaacatccaagacctccttcctgcccccgcacaatggctgccaactgtactggaactatatactgagggggacttactgctgggcttcagcgccaatggctggcatattcaaggaattcccgaatcaaaacaactgtgaagctagctcaggggtttacttttaggatggaaaagtgctatgaaaagtaaaaggagcaaaagaggttagatggtga

SEQ ID NO: 31218 - DNA, 601 bp, Human
agaaaagatgatgtaagcagcacagacatttgtctttatcaaccagagaaatttgttctcatataaaaagtaaaagaaaaaacatgtacatggaaatgaaaatagtttcttagtacgttaatctttcttctaatatgaaataaaaaatctaatggaactctcaaacccaacacttaaaaacaccatttatataaaatgttttagtgtaatacaagaataaatgaatgatcatcaatcatcactaattcaaatcctctatttcttggatacaaactttgtcatacaatctagatctccttayaatttagattttgcccttgaaaaacctaaagtgttttcaaaattacttttctcagcaacttcctagctgagctagctttattattattgtgaattttctaataaaattgaaattaaagcaagttttctacagatcataaattccaaaatcattagattttcaaaaaaacacaacagtgaaagtatatctaaccaaaatacctctgtgttactctataatctggattttttaaatatacaatctaaactggttgtaacagaatattgtgaaagaatattaaatccatgatttactaaaatt

SEQ ID NO: 31219 - DNA, 601 bp, Human
gtgataaatcagatgtggtgactacaaagactactttggtggcaatatggagggcagactggagaagaccaaaaattgactcagggagctagttaggcaattagtacagtcgttgagaaaacaggtaatggtagcttaaactaacaggaggataaaggagaagagaagtacatgggttttcaatacatctaagaggtaagctagcagggtttggctatcaattgggcatgaaaagtaagggaggggaatgtatcataagagtaacgtctcggttttagagtagatcctaaataataacttyctggattttgaattgaatttaaaagacatttcacttgaatatctactatcttacacatggtttctctgtcctagagatattttcagaaatataatagaaaccaaaatcttcacactccagccatagcatacaaaaaacctcaatcatacatgatattgccccaaaatacacatgaagtttgataattaatatatttttcatttagtcaaaatgcagaattaagtttttgatacattttaaaatttatttcagtggtaggataatattcagtttaaaatgaaactggtaacaaaccataac

SEQ ID NO: 31220 - DNA, 601 bp, Human
ggaaaaagcccttgctgcatgctgctatggtcttataaagctgagaggtagaaggggctctgaagcgttttctaaagattgtggcctttaacctatgaacatcatgagaaattgagagtgataaatcagatgtggtgactacaaagactactttggtggcaatatggagggcagactggagaagaccaaaaattgactcagggagctagttaggcaattagtacagtcgttgagaaaacaggtaatggtagcttaaactaacaggaggataaaggagaagagaagtacatgggttttcaayacatctaagaggtaagctagcagggtttggctatcaattgggcatgaaaagtaagggaggggaatgtatcataagagtaacgtctcggttttagagtagatcctaaataataacttcctggattttgaattgaatttaaaagacatttcacttgaatatctactatcttacacatggtttctctgtcctagagatattttcagaaatataatagaaaccaaaatcttcacactccagccatagcatacaaaaaacctcaatcatacatgatattgccccaaaatacacatgaagtttgat

SEQ ID NO: 31221 - DNA, 601 bp, Human
tgtctatcatttatactgttacttacctattcaaaactaaggaaataaagcctagcagaccttttagtagaaactgacaagcagagtcaatggaacacagagaccagaaaaagacctgcatacatatgacgtgtatatattaagtgattttcaacaaagatgctaaagcaattcaatggcgaaaacagtctttgcaacaagtggtgatgaaacaactaaacgaaacttcactcttagctcatatcatatctaaagattaactcaatgattagcctaagtgtaagagctaaaactattaagyttctggaagaaagagaaaatcatacagaacaatttctcaaatataatacaaaaagcccaagctataaaaacaaaaatcaatacattggacttcatcaaaatttaaaacttttcaaaaaacagtcaaaagaataaaaaggcaagccatagactatatttgcaaaacttatgtcttacaaaagacttgtatttaaaatacataaataattcttacaactcagtaaaaacaaagacaacccaattaaaatatgagaaaaagatctgaacagaaacttcaccatagaaggtatgtgggaagcaa

SEQ ID NO: 31222 - DNA, 601 bp, Human
ttaaaaacagagacaggctgcagtgactcatgcctgtagtcccagcactttgggaggccgaggagggtggatcacaaggtcaggagatcgagaccatcctggccaaccctgtctctactaaaaatacaaaaattagctgggtgtggtggcacatgcctgtaatcccagttactcgggaggctgaggcacgagaatcacttgaacccaggaggcagaggttgcagtgagccgagatcacgccactgcactccagcctggcgacagagcgagactccatcacaaaacaaacaaacaaacaaamaaaaaaaaaaccagagacagctctctcacctctccacacattatggggaattgaagtttacacaaaggaaactagcactttcctagatcagtaaaactgatctagaaatctacaactacagctccatgaaagtagatgagaatttccacttgttaggtaaaacaagtcagatttcacagtacagattgttacattaaaaagtacataaggcacaaaacttaaagaatgatttatacacacagaagtatggtatgttatattaaataccaagcatttccacggagaaaaagcagaggtaaa

SEQ ID NO: 31223 - DNA, 601 bp, Human
caatctccttactttagtgcagtgcttcagcctaccttctgtgacagcactgagacagaggtgtgtccagcaaattgactctagtcttgtcacatcaccctctacaagcatgtgggtttgcacatcctctgttctgctaggcatcagcactccatctgcttcctgacttaaccgaaacgtgtgaaaatctctcacccacgactttctgtccttgaggtttaataacttttcaaaagttttcttctttcactctcattttaggagtttggaaagaagcagtgaacccatgtccatcctctayatttaactagaattcctgagctgctcttcaactgcttagcactccctgggtacctgtctagcagaaaaattacttttctatttcaaatatggtgaagatgtttctagctcaaaatctcactctatcaaatacacagtcctgaattaatattgatcaagcctgagattaagacttaaaaggtttgaaaataaaaacgcagaccttagttgccttgcaaagattgtttcatcacatacaccaaataactggtgctgaattctcaggaccatatgcctttaaaaacagagacaggctgcagtg

SEQ ID NO: 31224 - DNA, 601 bp, Human
agtgccatggagacactgcagaatgatttactactgccggtccttctgggccagcaaaagaaggggacttgtctggtttgttcactgccacatcccttttgttgaataaatgaaaccgggctgcagggacctgataaagtgacaggctggccttttcttttggagaccttcaaatatcagatctggactctttttcctggagataattcatttctctagcgaagacaccactatgccctgccacagctggaggggtggggagattcacacctggctgttggcttcaaaaggccagacgggraaaggcctggggtccctagggtcagcatgcagatttactcaaccccccggttttatgccctaccacacaggtgcgtcagcactctcagcagcttcctgctacactttttccacaggataaactggaaaaagtttctacaagatacaacagagtaatgacctggcagtacaagtaaagatgagcaactgggaatgtggctgttttgtagtcaaacttttaaacaatctccttactttagtgcagtgcttcagcctaccttctgtgacagcactgagacagaggtgtgtccagcaaattgac

SEQ ID NO: 31225 - DNA, 601 bp, Human
tcataatttttggttaaatcaagactttacattattaggactatgtaaatatttaatatttcttcagtgctgagtgaactgttttcttttgcaaactgggagtaactacagttttctatataactattatattattactttgtactgaaggcccaagaaatatgccctacacctattaataattgatgtaatcattcaaacacatcaaatcatctatcaattctttctccatctctcaagcccaactctcccttgccctctccagaccatgtgtgcatatcacctgggtcgtcttcattcyctaaatcacctacgccttttccttggctttctcaatttcctgaggcacattcttcaagagcttgctaagtaaagacccatggagaatacacttttagccaattaaggactgaaaatgccattagtctactctcacatttgtcaatttggctgggtaaaaaattccaggaaaaaaaaatttcccagtattgctgagaatgttcataggtttctgattcataatcattggtcatttttcctagaattcccagtatccctcatcctttgcctatgaaagccctgagatcctggcaggaagaga

SEQ ID NO: 31226 - DNA, 601 bp, Human
catctccatccaagagcaatacatttcaactcttcccatttattccggtatttatctacatattttgaggaaatgagagttctgatatttcttgcttctttcactttaagacactgtctcttgacttcttatcatggtagtggaggagttaaaccaccacacctcctgcccctacctctattctcccaatatagttttatcataatttttggttaaatcaagactttacattattaggactatgtaaatatttaatatttcttcagtgctgagtgaactgttttcttttgcaaactgggartaactacagttttctatataactattatattattactttgtactgaaggcccaagaaatatgccctacacctattaataattgatgtaatcattcaaacacatcaaatcatctatcaattctttctccatctctcaagcccaactctcccttgccctctccagaccatgtgtgcatatcacctgggtcgtcttcattctctaaatcacctacgccttttccttggctttctcaatttcctgaggcacattcttcaagagcttgctaagtaaagacccatggagaatacacttttagccaa

SEQ ID NO: 31227 - DNA, 601 bp, Human
cgtggaagattacacagtcccagacactgtctttcatggcctctttgaagcccacattgaaaagcatcgcacggttaaaaggttgtgtgccagtcttcatggagcagaccgagagaaaaaaatagaaatgtactcacacttcatcatctttttttttttttttcttttttttggtatttttagtagagatggggtttcaccatgttggccaggctggtctcgaactactgacctcgtgatccacccacctcagcctcccaaggtgctgggattgcaggtgtgagccaccgcgcccggcccycatctgacttttttctattatttttcaaacttgttgcatcatgatcaaatgattacaataattagacccaaatgaaatagacaaataataaatatacttcaggattttcaaatacactgtttaaatttacttactatattattttataatttaataacatagaagaaaacagtatctagtccattggtacatcagcacatttaaataatttgtatttctgctctacttcaaatacatcaggatatagattacttgtggcgagaaaaaaaaagtcattaaaaataatataagttttatttt

SEQ ID NO: 31228 - DNA, 601 bp, Human
tgcaattatatcgtacaatatcaggaatagtgcacactacttacatatacatgtatttatccagctttgcagcaaaatgacgtggcatttctccacatccgtaatagttccggtcattttcaggtagatgatccacatcgtggaagattacacagtcccagacactgtctttcatggcctctttgaagcccacattgaaaagcatcgcacggttaaaaggttgtgtgccagtcttcatggagcagaccgagagaaaaaaatagaaatgtactcacacttcatcatctttttttttttttttcttttttttggtatttttagtagagatggggtttcaccatgttggccaggctggtctcgaactactgacctcgtgatccacccacctcagcctcccaaggtgctgggattgcaggtgtgagccaccgcgcccggcccccatctgacttttttctattatttttcaaacttgttgcatcatgatcaaatgattacaataattagacccaaatgaaatagacaaataataaatatacttcaggattttcaaatacactgtttaaatttacttactatattattttataatttaataacatag

SEQ ID NO: 31229 - DNA, 601 bp, Human
gaggaggaagaggaagaagaagaaagaaacaagcattcttttcctgcttgtgtcagactttttgcttctctgtactctagattagcaccaggcaaaactgtgacacaggcaacatcttcctgccctaagcaacaaacagattttctctctactcccattaggccaatgaaaactgtgatccttttcccatattagacttgcattctttcatgtccttttaagttactatctcagctctgataactgttcattttaaattatctccaattagagaaggaaaagatttgggttttttttttttattattaaagggcaggtcaagaatgcacaccttaggaagaagataaacagcagaagagagggctttgtggccctccaaaccatcactgggggagagcaggcaggagtcaagatgagttatgcacctaccacacagcaggcacagagcacatgtgatctcacagcagctctatggatggaatctattatcccagtgaacaaggaatacaccttcagagatgcaagtgactaacctataagtcctggaactgtaagtgtgagaacccaagtttaaatctgtgtgtgcttgaccacagaaacc

SEQ ID NO: 31230 - DNA, 601 bp, Human
tatcccatcccaaagaatgttcttggaatggataagtactacaatttacctaatataaataagatttataaaaattctattagtgaacaatttgtacctcaacatacctgttccaaaggtcatcatcttctcctccccatccccagaaggcattaggaaaaccattgatctttctaaattgttccactgtcagcccacttacaccaccaaaaaattctttatatggaagactagaaaagaaagacacagtattctaaaaataaaatcataataatttcccatgtgaaatgaaggtttcagycttttatgtgctttgcaaaatatgcccttatattctatatagacaattatgttagaaaatgtaaagtacaccaagacataaaacatttttatattctagtgaaacaagtacatgtacatgtgttatgttaaatgtaaagcacttatggaaacctaaatttaatatttagtatacaaataagactcaaaataaaatctgtaaggctcaaaacccagtgcccccaaattgtatattttcacagcaaaagtaaacatgattaaatatatttataatggtcaatgcatgtcagatgttcctaaa

SEQ ID NO: 31231 - DNA, 601 bp, Human
ctgcttgagctccacctcctgtcggatcagcgaatggcattagattttcagaggaacacaaaccctattgtaaactgcacatgtgagggatctaggttgtatgctccttatgagaatctaatgcctgatgatctgaggtggaatggtttcctcccgaaaccatcctcctgggtccttggaaaaattatcttccaggagactggtccctggtgccaaaaaagttggggaccgctgctctaattatatgctgccaataatttcagaaagcagacttaatgaaaaaaaaagagaaatataaaayagggtttagaaacctcaaacatatcccatcccaaagaatgttcttggaatggataagtactacaatttacctaatataaataagatttataaaaattctattagtgaacaatttgtacctcaacatacctgttccaaaggtcatcatcttctcctccccatccccagaaggcattaggaaaaccattgatctttctaaattgttccactgtcagcccacttacaccaccaaaaaattctttatatggaagactagaaaagaaagacacagtattctaaaaataaaatcataataatttcc

SEQ ID NO: 31232 - DNA, 601 bp, Human
cttaatgccctttacaatttctggttcttgtgcataatttaagaatctctaaaccattattctaaattagcaattttactactcaagaaatgccacctgaaaaaattattttgcacttttacaattagacatctttaataaataaaacattatgctttatgttacgtaaatacttttacataaatagttaaccgggctctttaacgtaaatatgtgtatttattaatgtatatatacgtatatctcttaaaaacaagcatcaaaaatgcttccttttgtaaagattcccttcagcaaaaartacttcccttccattatgaaaattcccttcagcagcttttttggggttcaatgcatttttatttacctttcatttattcaacagctttggaaaccttggtatctgaagatgacattcaacttaccgtcctaaaaactggacttcacctctatggtgatgaggaattgacttgtattttcctaagtctccctctggtctggttacattatatccagcatagtgaactctacaatgccatatatggaaatgaaaatatagagaaataaaatatgaaaatgggttatgtgagttcaattttaa

SEQ ID NO: 31233 - DNA, 601 bp, Human
gacagttccttcatttcacacaagggttaacctttgtttagtgatgtaaatttagtgagtttttttcatgcaaataaaaaatgtctataaaagtccaataaaggtataaccgattacatgcaaaactgcaacacatctaatttttaaacaatttgcacacattaatttatatcacatatatacaaaatatgtttaaacggaaataaaagcattctcttgaattaaattatagattttagtataaaaattttctcttcggagggagctctcttaacttccgatcttaagtagtggcttcccrtttctgcggtgctcgccacaggggtgtgtctcagagcagggaggacgggtgagagaagggtgactgtatatagtcccactctgtaaacactgtggactgctggctcttctcagagaaaagggcactgtgacacagccaatcactgacctccactaagagcgcgctccaagtttatgatccagcattgtggtctaccttgccacgacagccacttcttttaatagtcttcgattggagctaactctggcatgaggtttacagatatgtttgtatacaacctatcaaccagtatttttggcc

SEQ ID NO: 31234 - DNA, 601 bp, Human
gtcccctgcacacctcatgctgaaatgtaatccccaatgatggaggtggggcctacaggaggtgtttggttcacaggggcagatccctcacaaatggcttgctgctgttgcggtaggttctcctctattagctcccacaagagctggttgttaagaagagcctggccctgccctcctctcacctgccacattgcttcctctcaccatacacacaggcttccccttccccttccaccaagagtggaagcagcctgaggccctcaccagaagcagacgctggcatcacacttcttgaatagtytgcagaaccataagccaaataaatcctttttctttgtaaattatccaacctcaagtactcttttatagcaacacaaacagactgagtcatattgttaacaaaaatgaacgaggattcatttggcaagagcttttttagcagtaaagtaaaactcagccaaatccctcttttacaatgcgcttttcccattgaaaataattattgcaaccgaatttacctctcttgggaggagacattctaatcagaccacctctttactaaaaatatacctgagtcatttacactgctgttcctcttggc

SEQ ID NO: 31235 - DNA, 601 bp, Human
gtccagcaacgggtggggttataccttatccccttggagttccaaatataacttcttactcttctaaagcatgtacctactgaatgaggaaaatgctgagagaaaaacaagcctgttgaatttctacagccacagttttactttttaatttaaatctaatctatttcaaacctggacatgttcttgaagggcaaagaaggcagctgcttttacatttagaaaatggaaaaacaagccgggcgcggtgatctctgcattttgggaggccaaggcggatggatcacccaaggtcaggagttcsagaccagcctgaccaacatggtgaaactgtgtctcttactaaaaatacaaaaaattagccaggcacggtggcatgcgcctgtagctccggctactcaggaggctgaggcaggagaattgcttgaactcaaaaggtggaggctgcagtgagccgagatcccgccactgcactccagcccgggcaacagagcgagactttgtctcaaaaaagaaaatgggaaaacaggccaggcacagtggctcacatctgtaatcccagcactttgagaggccaaggcaggtggatcacctgagttcagga

SEQ ID NO: 31236 - DNA, 601 bp, Human
tatttttcttctgattactaaattaataatatgtcactgttttaagaatcctcaaatacacaacaactctattgcaaaaatcttccagaaacttactctacatcttgggaggggtggcttaatttcctgatttcttgtttaaaaatttttaaataaaactttaattaaaataaagtctacttggaaggccaaggtggggtgctcacttgaggtcaggagttcgagatcagcctggccaatatggtgaaaccccatctctgctaaaaaaaaaaaaaaaaaaaacacaaaaattagccgggcrtggtggcaggtacttgtaatctcagctactcaggaggctgaggaaggagaatcgcttgaacccaggaggcagaggttacagtgagctgagatcacacggttgcactccagcctgggcaacaacagcaaaactccatcataaacaaacaaacaaacaaagtctgcttttcagtagcaatagaggccttttaaaatgaaagagacagaggaaattaattgctcacgacctggtaaaactatgtgcagttatcgtgaggagcccttgtttttctcccctgctagctgtccagcaacgggtggg

SEQ ID NO: 31237 - DNA, 601 bp, Human
ggctggaaacatgtattggcacagtcaatacattcactagaaggcaatgaaattcccaaaagtattacactaagtatattttcataaacaaatcaacaaaaacgaagataataatcattctggtcaatgactgacccaagccctagagctagaacctaatcaggaaactagaatttaaaaaacatgaggcaagagacaagatatcactaactctaatgattctactatttggagtttctttgaagatagataaattcctttctacttccttcaaacaatgatacagtaagcctggtagcamctagcatgaaacaaaaaaaaagcatttatttttcttctgattactaaattaataatatgtcactgttttaagaatcctcaaatacacaacaactctattgcaaaaatcttccagaaacttactctacatcttgggaggggtggcttaatttcctgatttcttgtttaaaaatttttaaataaaactttaattaaaataaagtctacttggaaggccaaggtggggtgctcacttgaggtcaggagttcgagatcagcctggccaatatggtgaaaccccatctctgctaaaaaaaaaaaa

SEQ ID NO: 31238 - DNA, 601 bp, Human
aactaagaaagaagagaaagaggctggggcatatgtaatccccatcttttcaaatactgtggtcatgccaggtatccccaggttgaggagcctctgttttgccatctctggggttattaagtctccagctcttgccaggatggggaaatgggtctgggtatctgactgctttttaacagctttcaatctccctttattttagttgccacctttgctcctacttcccatattgctagttcctgagcttctgggggatcctggggtggttgctggttctcctgttgctgctttgagcagtcasttttcttgggtttgttaagtcttttatcagtggttcttctgctttctacctaccaaggttttttgctgtggtctccttttgtgttctcattctcaagggtttataatttaaaaaccctcacatatgtatgcccctttagagtcacgttagtggatatgaagagtgtgatggcagatgtctttttcctaggggactgtacttgtagagtaggaggagggtcctccaacctcattttctacagatgaataactggaacaacatacacagaactcagaccaggagccctggctaatgcatgac

SEQ ID NO: 31239 - DNA, 601 bp, Human
tcagcatttatatgcagtattcacctctgtcagcctctacggctggtcgtgatgtttctgttttcagtcttacctaccgacctcccacttatccccttccttctgccacccctgccacacgatccccttccattccccagtctcccatcggtcacatatcatagctgtggttaggacaatcttcagtctttgtattacgatgctgctgttaagtactagtcgtcgctgagaaatgtggaaagttatgcatcttgtttttctgtttgctcagttttatatgcaatgattctaattcaacacyacgcctttcaccaagacatttcctcctaagacatacattaggtattctctcaacttcatcctcccagaggaggtgtggcagcttctggccttcttccatgccaaatgtgcttggggggaggtattctctcggtgatgattcctcccttctgtactctgtgctgcctttctggagaatacagaacaggagttggatgtgagacctcccagtcctctgtctcatcttttctatccagttttccgtcttgccatttatctgccctactttccaagagatttcctcaactttactcaaccttcc

SEQ ID NO: 31240 - DNA, 601 bp, Human
gcctgcaggcaccaacaaaaccataatacaagaggcctttgttcatgagccaacaaagctctctcctggattcaagtgtgcccagtactgggcaacagacatctcaaaccaggagcacagaattgctctctgctcccccttcaaacctcaggcaactcgatcctaagatttcagttttattggctcttcacaccaacagtggattagcttgcagcaacctaaactgctgtctcagaagagaaaaaagaaaggaaaagaaaggactactcacttgttcaaccacataaaatgcaaactgcargcgctggcgctggagcatgggaagcaggtgtctgaacaggactgggaggtgctcgtggcggttccggaaggggataaggatcgccacctggagtggattacagcaaaagaagcacagttaggactctcagctttcactccttagcaggacacccctgatgaattgctgaccaacccatgggagttctgggaggctggctatcttgtcctcagctttctctaaacaaagatctatgttggcaagttggcccttggacctagatgaatgtgattcttacatataccatatcttatagtacat

SEQ ID NO: 31241 - DNA, 601 bp, Human
gctccagggtgaccacttaacagcaactcagactgtgagactcaaaagtgtgcccatagagagaggtgagcatgcaaaagaccctcagactgacgatcagtgtattcagggaaatctgtcaaccttttgtttatctatggatatagcacctctagttcaaggatcacatacttcaaaatgcctacagaagccaagtcagtaatgtaaacatataaagtaggcccggcaagagaaaaccacagtaggacagtcatgttccatctaaaggcaaataaaatatatgcaggaccaaaaaaaaaaagatttacagactgaatttgccatgcggtcttcttcagtttgtgacctctatatctggttccctaccaatatttttaagattaaaacaaaaccaaaccctcaggcttagagaagtttgcaaatgtcccaggccacttggttgattaacagcagacatgacaagcactgaggtctcttgactccaaggccacatcctctgtgctgtaccttgctgcagctctttatcttaaggggaacttcctgggtctggagcctgcaggcaccaacaaaaccataatacaagaggcctttgttcatgagc

SEQ ID NO: 31242 - DNA, 601 bp, Human
ggaaaatctttgctgtctttcctgtgcctaaagacgagtttattagaaccaactggaaaagatcactgggctagtgtaaccaggtccaacaccacaaatcaactcacagtgtggctcagaagtcactggacctctggcatgggcacagtggctcacgcctgtaatcccagcactttggaaaaccaaggtgggcggatcaggagttcgagaccagcctggccaacatggtgaaaccccatccctactgaaaatacaaaaacattagctaggcgtagtggcgcatgcctgtaatcccagctayttgggaggctgaggtaggagaatagcttgaacccgggaggcggaggctgcagtgagccaagatcgcaccattgtactccagtttgggcgacagagcaagactccatctccaaaaaaaagaaaaagaaaaagtcactggacctctggccccaatttctttaaaaatgtaagtgatagcaaacgcaagcttctctctcccaaggctactgaaggcagaaatgcaaccgtgtaccagcatttagaagagtaccccgctccacaaagggaagagacaacactaccatttctactccttaccact

SEQ ID NO: 31243 - DNA, 601 bp, Human
ttgctttctcctgccaaacagtgctccaattgtatggatacacacattttgtttatccatccatcagttgatgggcatctaggttgcagctaattagatttccttttcacatcgctcaccatcctttcagatttaacctctttaattaagaagaaatgatactcacagatacatatacttatccaatttggttgcaaaatgcctcggcatctgtccacatccataatagttgcgatcactttccggtatgtgatctacatcatgaaaaatcaaacagtcccaatccaagtctttcattgcytcttgaaagccaacgttgaaaagcatggctcgattaaagggttgggtaccaacctaaaagaaacagaactttatctttaaaagaatcttgaaggaaaatctttgctgtctttcctgtgcctaaagacgagtttattagaaccaactggaaaagatcactgggctagtgtaaccaggtccaacaccacaaatcaactcacagtgtggctcagaagtcactggacctctggcatgggcacagtggctcacgcctgtaatcccagcactttggaaaaccaaggtgggcggatcaggagttcga

SEQ ID NO: 31244 - DNA, 601 bp, Human
tgttcacttgccactttttaaacacaaaataaactcaatgaaatggtaacatgttacttattgttgtgggtaatttatttttatactcatttgtattttataatgaacgtattatttattagaagaaaaaattgctaaattataatttgttgattttcgcatgtcaaaggagaaaaatgaaaatagctgctttgttgggatatacagtttgttttttaagatattaagatatttttaaattaagattaaagatattttctaaaaacttggatgtgtgtggtgtgtgtgtgtgtgtgtgtggattttttaagacaggtctcactctgtcacccaagctagagtgcagtggcacagctctctgtggcctcgaactcccgggctcaagtgatcctcccacctcggccttccaaagtgctgggattacaggtgtgagccatcacagctggtcaatttcatttttttccttaaccttttaaactgtagctactagaacatgttaaattacacacatggcttgcattatattcctatcggatagtattggtctgcagtctaaggtagcatttctagaagacaccgaaagaacggcagaggtacctgt

SEQ ID NO: 31245 - DNA, 601 bp, Human
aaaagaaaagaaaagtacggaaagaaatggttacttccagggaataaaatagaatcaaaatggggattaatacttagacacttgtatcatctaatttttttttttttaagagacagggtccactgtgttgcccaggctggagtacagtgaggtgatcatggttcagtgcagcctcaatctcccaggctcaattagtcctcccatctcagcctcctgagtagctgggactacaggcgtgtgccaccacaacaggctaattttttttattttttgtagagacaaggtctcactgttgcccagrctggtcttgaactcctgggctcaagtgatcctcaagcctaggccttgtgaagaggtgggattacaggtgtgagccacagtgctcagcctatcatttgaatttttattagcaaaatagtccttgtaattaacaacaaacacatacttttcaaaagccaagctacaaaggaaacagataccaggtagtattttgcatttgttccttatgaggttactgtttacttactccataaaaatattactttattccactcacacacaggattgttcacccaagcttgtacagtacaagccttatgtg

SEQ ID NO: 31246 - DNA, 601 bp, Human
ccagcctggccaaaatggtgaaaccccatctctacttaaaaaaaaaaaaaaaaattagccaggcgtggtggtgcaggtctgtaatcccagctactcaggaggctgagacaggagaatcacttgaacccgggaggcaaaggttgcagtgagcaaaattgcaccagcttgggtaacagaaagaaaatctgtctcaaaaaagaaaagaaaagtacggaaagaaatggttacttccagggaataaaatagaatcaaaatggggattaatacttagacacttgtatcatctaatttttttttttttaagagacagggtccactgtgttgcccaggctggagtacagtgaggtgatcatggttcagtgcagcctcaatctcccaggctcaattagtcctcccatctcagcctcctgagtagctgggactacaggcgtgtgccaccacaacaggctaattttttttattttttgtagagacaaggtctcactgttgcccaggctggtcttgaactcctgggctcaagtgatcctcaagcctaggccttgtgaagaggtgggattacaggtgtgagccacagtgctcagcctatcatttgaatttttat

SEQ ID NO: 31247 - DNA, 601 bp, Human
gctgggctaggtggctcgtgcctgtaatcccagcactttgggaggccgaggtgggcagatcatttgaggtcaggagttcgagaccagcctggccaaaatggtgaaaccccatctctacttaaaaaaaaaaaaaaaaattagccaggcgtggtggtgcaggtctgtaatcccagctactcaggaggctgagacaggagaatcacttgaacccgggaggcaaaggttgcagtgagcaaaattgcaccagcttgggtaacagaaagaaaatctgtctcaaaaaagaaaagaaaagtacggaaakaaatggttacttccagggaataaaatagaatcaaaatggggattaatacttagacacttgtatcatctaatttttttttttttaagagacagggtccactgtgttgcccaggctggagtacagtgaggtgatcatggttcagtgcagcctcaatctcccaggctcaattagtcctcccatctcagcctcctgagtagctgggactacaggcgtgtgccaccacaacaggctaattttttttattttttgtagagacaaggtctcactgttgcccaggctggtcttgaactcctgggctca

SEQ ID NO: 31248 - DNA, 601 bp, Human
ctgatgaaaagacagaacacgaagcctggagagccagagatgtgtgtgcagcgagccccgaagggcctgctttaggcaggaagcagcctgctctaacagcagcctcccgcttagcggagagtgggatgagcacatgcgcggccgacagggaagagtgaatccagagcagaagtcaagggcaagactcgtggggggggggaagaaagggacagaagccagctcccagcaataaaggtcgggttattttgttcttttgtgacatgccctatatccactccctcgccaaagtgacagcaattckggagatgacattcttcaactgcattttaactgagttcctgcacttgccaaccaagtaagtggcctaatacataaatcctcaatttgaattggagccagctagaaaattaaattttaaaaaggcattttacatggcttatttacaattatacttcttcaagaagtgattgttatatatttatgtctatttatctttcccaaacaccctcccctccaccctcaatccccacccaaagaaggtaatttttaaaaaaaatgaaaccaaagagaacaccagagatctagaagaatggtgtggagt

SEQ ID NO: 31249 - DNA, 601 bp, Human
gagttgccttgagacttggggaaagggagaactctaccctttggacagacaccctcctcacctgcctctcccctcattccagctcttctccaagcttcaggcagtgaaggctgagatccatgacctccaagaagaacacatcaaggagcgccaagagctagagcagactcagaatgagctcaccagggagctgaaactcaagtaagtgccaggccttccatagtgcccccaagccacttgctgagtcattgatctcgtttgtttagttagaaacagccctggctgggcttggtggcctacrcctgtaatcccagtgttttgggaagcggaggcgggcagatcacctgatgtcaggagttcgagaccagcctgaccaacatggtgaaaccccgtctctactaagaaatacaaaaattagctgggcgtggtggtgcatgcctgtagtcctagctacttgggaggctgagataggagaatcgcttgaacccgggaagtggagattgcggtgagttgatatcgtgccactgcactccagcctgggcgacggagtgagaaaaaaacacaaaaaaagaaatagccctgaggacaggtccttctccag

SEQ ID NO: 31250 - DNA, 601 bp, Human
agaactctaccctttggacagacaccctcctcacctgcctctcccctcattccagctcttctccaagcttcaggcagtgaaggctgagatccatgacctccaagaagaacacatcaaggagcgccaagagctagagcagactcagaatgagctcaccagggagctgaaactcaagtaagtgccaggccttccatagtgcccccaagccacttgctgagtcattgatctcgtttgtttagttagaaacagccctggctgggcttggtggcctacgcctgtaatcccagtgttttgggaagcrgaggcgggcagatcacctgatgtcaggagttcgagaccagcctgaccaacatggtgaaaccccgtctctactaagaaatacaaaaattagctgggcgtggtggtgcatgcctgtagtcctagctacttgggaggctgagataggagaatcgcttgaacccgggaagtggagattgcggtgagttgatatcgtgccactgcactccagcctgggcgacggagtgagaaaaaaacacaaaaaaagaaatagccctgaggacaggtccttctccagctcatctcctgccaccccatgttctgt

SEQ ID NO: 31251 - DNA, 601 bp, Human
cgccaagagctagagcagactcagaatgagctcaccagggagctgaaactcaagtaagtgccaggccttccatagtgcccccaagccacttgctgagtcattgatctcgtttgtttagttagaaacagccctggctgggcttggtggcctacgcctgtaatcccagtgttttgggaagcggaggcgggcagatcacctgatgtcaggagttcgagaccagcctgaccaacatggtgaaaccccgtctctactaagaaatacaaaaattagctgggcgtggtggtgcatgcctgtagtcctagctacttgggaggctgagataggagaatcgcttgaacccgggaagtggagattgcggtgagttgatatcgtgccactgcactccagcctgggcgacggagtgagaaaaaaacacaaaaaaagaaatagccctgaggacaggtccttctccagctcatctcctgccaccccatgttctgttcattcctgaaaaagtcactttccatctctggatcccatctgttaactgaatgacttcatcaggtgatctccaagttcccttctaaccctaccttctcgaagcttttaaagattctggtct

SEQ ID NO: 31252 - DNA, 601 bp, Human
aatcagtccgggcatggtggctcatgcctgtaatcccagcatttgggaggccgaggcaggtggatcacctgaggccaggagttcaagaccagcctggccaacatggtgaaaccccgtctctactaaaaatccaaaaattagctgggtgtgatggcgtgtacctgtaatcccagttactcaggaggctgaggcaggagaatctcttgaacctgggaggcggaggttgcagtgagctgagatcacaccactttactcaagcctgggtgacacagcgagattcttgtctcaaaaaaaaaaaaaattaaaaaatgataaagtatacaaatcagtgtttttttaaaagcatatatatgcatagggctataaaaccaccactacaatctaattttagaacatttttattactctcctctaaaagaaactctaccagttagtagtcactcctcattaccccctttcccaacccgaagtaatcactaatctgcttcctgtctctatggctttgcctattctggccatctcatataaatggaatcacacactgtgtggcctttttggcctggtgtcttttgcttagcatgacgctttcaaggatcgtcca

SEQ ID NO: 31253 - DNA, 601 bp, Human
tatcatagacatcctaacgagtgtgaaatggtacttcattatagttttgatttgcatatttctctgatgactaatgatgttgagcatcctttcacgggcttattggccatttgtatgtctttggagaaatatctatacaaatcctttaccccattttaaaatggggttgtttcatatatatatatgtatatatttcgtatatatatgaaatatatatatttcatacacacacacacacacacatatgtgtatatatatagtttttttttgttttgtttttgttttttttttttttttttttggagttggagtctcgctctgtcatccaggctggaatgcaatggcgtgaacttgactcattgcaacctctgcctcctgggttcaagcgattctcatgcctcagcctcccgaatagctgggaatacaggcacccgccaccatgcccggctgatttttgtatttttagtagagatggggtgtcaccatgttgcccaggctggtcttgaactcctaacctcaggtgatccacctgccttggcatcccaaagtgcttggattacaggcatgagccaccatgtccagccaataattaagttttaag

SEQ ID NO: 31254 - DNA, 601 bp, Human
tttgttttttttttttttttttttggagttggagtctcgctctgtcatccaggctggaatgcaatggcgtgaacttgactcattgcaacctctgcctcctgggttcaagcgattctcatgcctcagcctcccgaatagctgggaatacaggcacccgccaccatgcccggctgatttttgtatttttagtagagatggggtgtcaccatgttgcccaggctggtcttgaactcctaacctcaggtgatccacctgccttggcatcccaaagtgcttggattacaggcatgagccaccatgtccagccaataattaagttttaagagttttttttgagacagagtctgggtctgtcacccaggctggagtgcaatggcatgatcttagctcactgcagcctctgcctcctgggttcaagtgattgtcctgcttcagcctcccgagtagctgggactataggcatgtgccaccatgcccagctaatttttgtatttttagtagagacggggttttaccatcttggccaggctggtctggaactcctgacctcaggtgatccacccgcctcagcctcccaaaatgctaggattacaggcgtgag

SEQ ID NO: 31255 - DNA, 601 bp, Human
ttttagtagagatggggtgtcaccatgttgcccaggctggtcttgaactcctaacctcaggtgatccacctgccttggcatcccaaagtgcttggattacaggcatgagccaccatgtccagccaataattaagttttaagagttttttttgagacagagtctgggtctgtcacccaggctggagtgcaatggcatgatcttagctcactgcagcctctgcctcctgggttcaagtgattgtcctgcttcagcctcccgagtagctgggactataggcatgtgccaccatgcccagctaakttttgtatttttagtagagacggggttttaccatcttggccaggctggtctggaactcctgacctcaggtgatccacccgcctcagcctcccaaaatgctaggattacaggcgtgagccactgtgcccggctgagttttaagagttctttatattaatatattatgaataccactttctcatgagattcatgatttgaagatgctttctgttattctgagttgtttttaaactttcttgatggtattacttatagcacaaaagatttccgttgtgatatagcccaatttaattgtatttt

SEQ ID NO: 31256 - DNA, 601 bp, Human
atttattagcaataaagtattcttaaagtctatactttttgtagacaaaatggtattatacatttaatagactacagtatagtgtaagcataacttttatatgcactgggaaaccaaaaaattgtgttacttgctttattgtgatacttactttattggagtagtctggaaccaaacccacagtatctctgaggtatgcctctacattttaaggtcagcttgtcaatttctgcaaacaaagccagctgggattttgatattgatcacattgaatctgtagatcaatttgggcaatattgtmatcttaacagtattaagtattcagatccatgaacatgagatgtctttccatttatttattatttctttaatttttctcgagaatgttttgtagttttcagtgtataattcttacacttttgttaaatttatacctaagggttttttgggtgctatggtatatgacattgttttcttaattttatttttggaatattaattactagtatataaaaatactggctgggcatggtggctcacacgtgtaatcccagcactttgagaggcccaggtggacggatcacctgaagtcaggagtttg

SEQ ID NO: 31257 - DNA, 601 bp, Human
tagacaaaatggtattatacatttaatagactacagtatagtgtaagcataacttttatatgcactgggaaaccaaaaaattgtgttacttgctttattgtgatacttactttattggagtagtctggaaccaaacccacagtatctctgaggtatgcctctacattttaaggtcagcttgtcaatttctgcaaacaaagccagctgggattttgatattgatcacattgaatctgtagatcaatttgggcaatattgtaatcttaacagtattaagtattcagatccatgaacatgagawgtctttccatttatttattatttctttaatttttctcgagaatgttttgtagttttcagtgtataattcttacacttttgttaaatttatacctaagggttttttgggtgctatggtatatgacattgttttcttaattttatttttggaatattaattactagtatataaaaatactggctgggcatggtggctcacacgtgtaatcccagcactttgagaggcccaggtggacggatcacctgaagtcaggagtttgagaccagcccggccaacatggtgaaaccctgtctctacaaa

SEQ ID NO: 31258 - DNA, 601 bp, Human
ccaagattgtgccactgcactccagctggggcaacaagagcgaaactccatctcaaaaagtatatatatacatatttttcatagttgacttgttgaaaagactgaatcagatagcctgtagaaatatcccacattgtaggcgggagtggtggcatgtgcctgtagttccagctacttgggaagctgaggcaggaggattgcttgagcccaggagttcaaggctgcagtgagccaagattatgccactgcattccagtctgggtgaccgagtgagacaccaactcaaaagaaaaaaaaaaaagaagaaatatactacattctggatttgttggtctctttcttcatggtgtcaattaacttgtatctctatcccctttatttagctctaactgaaagctatctctgaagcacgggttcccaaccttggctacaaactgagaagttttaaaaattaatgatgtctgagccccacctcagagattctgatttaattggtctagggcagtagtccttaaactttagcaggcatcagaattacctgaagggattgttaaacacagattgctgggtatcacacccggagtctgattcagaaaggctg

SEQ ID NO: 31259 - DNA, 601 bp, Human
ggttccaggtattgcttctgctggtttggtgaatgcactttgagaactcttggtctctcatgaggtctgggcaagatatttttcaaaactctgtaggtaacgttaatgtgcagcctggcctgagaaatgtggagctaatagtttcagccaacagatgatctttgtctggatccattatttcattagtggggttacaaaatgaccatgcctggccaaagaagaagttttcaaagggattcttttaatgatcaaattttaaatttggaaaagagcccttaaaattaaatgtaggcaaggtgcrgtggctcatgcctataatcccagcacttttggaggctgaggtgggcaaattgcctgagctcaggagctcaagaccagcctgggcaacatggtgaaaccctgtctctactaaaaatacaaaaaaattagctgggcatggagacatgtgtctatagtctcagctactccgggggctgaggcacgagaatcgcttgaacctgggagacgaaggttgcagtgggctgagattgcgccactttactccagcctgggcgacaaagtgagactctgtctccagaaaaactaattaattaattaaatg

SEQ ID NO: 31260 - DNA, 601 bp, Human
tgtctgtatctcagctctttgtatgatgttaggcccatcgtacttgctgagtaaatgtttgctatgtgccttgactcttacctgattactcaccatgcatgagaccagatagctgacacttcatatgtattctgtatctgttttcacctgttatgtgtgctcttacaggcatcttattatagaaaactttatccctctggaagaaaaaagtaaaattatgaatagagccttctttgatgaagaggaagatcattggaaactacatcctataaccagactggagtaagtcactattaacttyaagtatattttcaagtatgagggaggaaaagaatgttgataacaagagccctctggtcaacaaaggggtttgataagaacacagtttggcttatttaaactcaaaacccactgcattactgattttctagctgccatagatccaccaggtaaaagtttgatcatgagtgtggttttaggaattgggagactttgtcactagtgagtgagcaagtgacctttccaaagttcctgcatttctgtttctccagctgtgaagtgaagtatgctaggtcacgtaaggggcaattcagagctgtta

SEQ ID NO: 31261 - DNA, 601 bp, Human
atgccacgacacccagctagtttttgtatttttagtggagacagggtttcaccatgttggccaagttggtcttgaatgcctgacctcaggtgatccacccacctcggcctcccagagtgctgggattacaggcatgtgccaacacgctcagctaatttttgtatatttagtagagacggggtttcaccatgttggccaggctgctctcgaactcctgacctcaggtgatccacccgccttagcctcccaaagtgctgggattacaggcgtgagccaccgcactggccttttttttcttttyttttttttttttgaggcaggatctcactgtgtcacccaagctggagtgctgtagcacagtcatagctcgctgtatcctcagactcctcggctcaagtgatcctcctgccttggcctcccaaagcactgggatgaccatgcccagctgagcacttgctgtgtgctgggcattgtacccagcacttgactgctttctctaattaagtttccccatcttctctatgcattcagtcctgttgcttaaaggtcaagtagtggggcaagtggctgaactaggatacacaacgtattaagttataga

SEQ ID NO: 31262 - DNA, 601 bp, Human
ctgtagcacagtcatagctcgctgtatcctcagactcctcggctcaagtgatcctcctgccttggcctcccaaagcactgggatgaccatgcccagctgagcacttgctgtgtgctgggcattgtacccagcacttgactgctttctctaattaagtttccccatcttctctatgcattcagtcctgttgcttaaaggtcaagtagtggggcaagtggctgaactaggatacacaacgtattaagttatagagtaatttacaccagaagtatatatatgatataaaatttgatgtaaaatrtattgaaatgtaaactgtttttctctggttggtggaagcacactcaatgttttttttctttttgctcatctgtattttataactatcaatagggaacttgtattatttttatagtgaaagattttcacttgaaatatttttagatgtttctgagtctctcttggcagccagagccaaacagaagattacggttagttagctctttgggtgccattcttcctggctttgagttatttaaaagaaagaaagcaaaagcaaaaaattaggtggagttaggtgttgtaaaacggcatcacttct

SEQ ID NO: 31263 - DNA, 601 bp, Human
ctgtgccagtgtagtggttttacagttgaacttgtcgttttcaggccattgaagaatggcctgaaatgaaatgttaatgacatctgatgtgtcagggacagagatggggacatgtaatataaacatgtgtttgacttttgcaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcraaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttcttta

SEQ ID NO: 31264 - DNA, 601 bp, Human
ggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacrtctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggtaagttgcatgtatacactcagaaatcgggcatgca

SEQ ID NO: 31265 - DNA, 601 bp, Human
caagctcaggcctcaggagctctgagctctccacctcccactgtgatggtacctgtgggagttttaaagcaccctggagcagaaggtaggggatcatgtgctattctctctctttttcctcacgaagttcctctgaaaaggtgctgatatgactttacagcacaagtcttaaaaaacactgcagataagtctctttgggtggttattaaaatggaacaacaaggtgagaaatgtgtcaagactatttctgggcaagtagagaataatatttgtgttgcttggtattttagaggcacctcakaatatatgtcagtctcctctccaacttaagaatggagtaattacactgcttgtccttaaaaagaggtgcagaatttgaagtcaatctgtaaattcctagcctacctcatgcctgtcttaatgttctttgtaggagtttagtaagtgataaaaatgagagttcttctttccgaccagcccattcaagtattgctttttggagtatacattgccattttctcttttcatttttaatctgtccatataaaaatatgaacatttttgtgttagggacatagactttaaatctagaactttaatt

SEQ ID NO: 31266 - DNA, 601 bp, Human
agggacatagactttaaatctagaactttaattctgattatatcatatgataggtagaaaattacaggctcaacttacattggtttattatatctttatgatgataatattgtcagatgaaaggcactgtgtaagtgcaggggattatgaatagtaaaaataacatttatttccttaaaatgatcttatcaagtttcccttggtaattaaaatcagtcttccttcattaattttatcttttcatctattaatattcccttccccttgctaaataacccacctttccttttgaagatcatagacttctattgacattatcatactcttccccattttttctcttttcagatcatcccttagtcatactccttgtatttttatgaatttaggctttcttaaaatctttattctcttcatttgttgtttttgttgttcttccctagtctctgtgtgttttggctgtttgaattgatttctaaaactggacttaaagggatcatttcatcagactcagttttccagctttttccctgtctttttactaaaacacaaattacttttgcactgccagatcagtctttttcttcttcagttacacttc

SEQ ID NO: 31267 - DNA, 601 bp, Human
ccatcctggctaacaggtgaaaccccatctctactaaaaatacaaaaattagccaggcgtggtggcacgcacctgtaatcccagctactcgggaggctgaggcaggagaattgcttgaacctgggaagcagaggttgtagatgatgccattgcactccagcctgggcgatagagtgagactccttctcaaaaaaaaaaaaaaaaaaaatgaacttcaagatttattttattacatagtaaatgaaaaatgatgacattttatcaaagttgatttttttcccttttttattgtggaaaaatrttaacatatataacaaatgatttacaattttaacaatttttaagtgaattcattggcatcaagtacattcacattgttttgcaactatcaccactgttttcaaagttaatttttaaaagcaatataaattagaccttaagtagttcccaaggtattaaagattaagaaattatgaaataatattgaagttttgtttcttttgccactacagttttttaaaaatatttttctcttatggcaaaagaaacctgggtaaaggaagctttaatgcaggttttaaggcctcttctgtcattacca

SEQ ID NO: 31268 - DNA, 601 bp, Human
tcattgtggttttgatttgcatttctctgatgattagtgtgaaattttattgctgacatatatggatcagtatacaattactacatttttagaaggtggcttattaattaacctctcctgaactttgtcctaggcttttaactggtctccttgccttcagtctttctttccttcattttgtcttccacactgttgccagttatgtttttaaacatagatattatcttatattgcttttacttagaaatatttaatggattcccaatgtctttagtgtaaattacttaccttagcaagcaatttttttttttttttttttttttgagatggagtctcactctgtcgccaggctggagtgcagtggtacagcctcagctcaccacaacctccgcctcccgggttcaagcagttctcctgcctcagtctcctgagtagctgggactacaggtgcatgccaccatgcccggctaattgttgtatttttagtagagacagggtttcactatgttgaccaggctggtcttgaactcttgacctggtgatttgcccacctcggcctcccaaagtgctgggattacaggcgtgagctaccatgcccggt

SEQ ID NO: 31269 - DNA, 601 bp, Human
ggctcactgcaacctccatctcctgggttcaagcaattcttgtgcctcagcctccccagtagctggaattacaggcacgaaacaccatgcccagctagtttttgtatttttagtagaggcgcatgttggccaggctggtctcaaactcatgacctcgagtgatccacccacctcagcctcccaaagtgccttttgcctgttttttaattgggttgtctttttgctgctaggttaaatttgttatatattctggatattaactccttttcagatgtatggtttgcagatattttccatttckgtaggttgtgtcttcactctgttaatagtttccttttctgtgcaaaatctttttagtttgatgtaattccatttgtctatttttgcttttattgcctgtgcttttgggatcttatctaaaaattcattgcctagcccaatattgtgaagcatttgccctgttttcttctaatagtttcatagttttgggtttaaatttaagtctttaatccgtttttagttgatttttgtatatggggagaggtgggggtctagtttcattcttctgcatgtggatatatccacttttccaagtactatt

SEQ ID NO: 31270 - DNA, 601 bp, Human
tgtgaactgcaggcaactacaaactggattcagggtttgtgaggaccgcgggacgaggctgcagtggtcatggggaccatgggtccccagcttaccctttccccattagaagtagtccttcctgactccaggccactccttgcagggaggcagtgcggcagaggcagagtgcttcgctcccgtctctgtggtgctatctggggcatctggtgctccacaggaatttcagcactcccctggtgctctccagcatacttccacagccactccagttgaaatatagtttgtttattgttgtttyggtcccttttgttgagtagaggggagcaagagccagacaactccagtcaaccatcttgctgatgtcactgtcgtttagagagaacaataagaaaaaaaagtcttggctgggcgtagtggctcatgcctgtaatctcagtactttgggaggccaaggcaggcggatcacgatgtcaggagtttgagaccagcctggctgatatggtgtaaccccgtctctactaaaactacaaaacttagctgggcatggtggcacatgcctgtaaatgccagctactcaggaggctgagccaggagaatc

SEQ ID NO: 31271 - DNA, 601 bp, Human
tttccaaccatattcttcaggattatgttgactccccaagtggccagactcagagttgcaaatgggatatgtgttattgagggaacaattttgaaaatatgcccttaggagggagggatagcattaggagaaatacctaatgtaaatgacgagttgatgggtgcagcaaaactaacatggcatgtgtatacgtatgtaacaaacctgcatgttgtgcacatgtaccctagaacttaaagtataataattaaaaaaaaaaaaaaaaatatgcccttaggatattgacaagggccagctctgrcatttgaaggcacgactaggccccataatgagagtatgtttaggtaaatttgaagcttgttggatgaccattcccacagaatgctaattaacttgacaggattctgaaggaggtttcagtgctattcagaatgtggtctccacaccccagattcactaatcaaaatttgcattttaacgagatctctgtgtgattcaagtgcacattcgactttgagaagcattgctcaagaggcgttacccaaagtgttttctcaggcaccatggtgttaaaaacttcacatgaaaaaataagtcttgt

SEQ ID NO: 31272 - DNA, 601 bp, Human
actcgggaggctgaggcaggagaatggcgtgaacccaggaggtggagcttgcagtgagcagagatagcaccgctgcacgtcagcctgggtgacagagcgagactccgtctcaaaaaaaaaaaaaaaaacttagcagataaaatagttggcaaccatatttctatcttcagaatatatttgatctaaaaaaatctgaaaatcaatggattagattgggggtggcaaactttttttgtgaagggccaaatgataaatattttagactttgcaagctgtggtttttgtcaacaactattcggcgctagtattatagtgcaaaaactgccatagacaataagtaaatgaatggacatggctgtgtttcaataaaattttatttacaaaagcaggctggaggccaggcaggctatagcttgccaaccccctgacctcaaccattaagattccttttcttgtaagatacttggattcttaattagaggaagaacaaaacaaaatgggggagtgtatcttaaaacctagttcccaaagctgttgtaagcatcagaattgttggttacatgtttattgtggaatatagatttgattttttaaaattttc

SEQ ID NO: 31273 - DNA, 601 bp, Human
tcttttatattttgcctttttttttttttttttgagacagagtctcgctctgtcgcccagacggcagtgcagtggcgcaatctcggctcactgcaagctccgcctcccgggtacacaccattctcctgcctcagcctcctgagtagctgggattacaggcgcccgctaccacgcccgactaatttttttttttgtatttttagtagagatgaggtttcaccgtgttagccaggatggtctcgatctcctgacctcgcaatccgcccgtcttggcctcccaaagtgccttttttttttttttgagacggagtctcgctcttgtcacccaggctggattgcaatggtgcaatctcggctgactgcaacctctgcctcctgggttcaggcgattctcctgcctcagctttctgagtagctgggactacaggcatgtgccactacacccagctaacttttgtatttttagtagacagggtttcaccatgttggccaggctggtctcaaactcctgaccttgtgatctgcccgcctcggcctcccaaagtactgggattacaggtgtgagccaccgcacccggccttatattttgcctttatatag

SEQ ID NO: 31274 - DNA, 601 bp, Human
gagtctttaaataagtgacggatttctgtttgcgaaataggcaaacaggctcgtaaatttgcctttatgcgcggagttcctgggacccgggatgggctgggcagcttcgggaggtttggtaaggaaaatgttctgcgtctggtgaaactgacgcgcgttgatttggctttaggacacctaagggagatcccaggatattggaagggaggggtggaaatccacggttctcccgctctcgctgcaccccacacacttccgccagcctcccaacctggtttaaacatcagggcttggatgcagrcttggggccccctaagccggagctgggagcctcagatacggaggtaaaagagcggggagtcgagctggcctagcgtcctccttcccgctctttcagcaggaaccaagcggtgctacttgaaggaggcggcgacgcgtgggggccgggatccgcccaataacaacttctttcgaggcgccgcacctcgaaagaagccggcctgcaccatccccagtccggggcagccgtttagagactcgatgcctatttatctttccctcgtccctggatgagctttcgtcagtttaccacaggcccccg

SEQ ID NO: 31275 - DNA, 601 bp, Human
tttcaagtttggtttcgtgtttatcaaaagaagaggagcaggaacagaggctttccacctagcagaagccatgggagtcggtgagggaccccggttgagacatgacacaggcttcagatgatttcagaaaatgttttattaatcaagagcatagacactgctttggcgaagggaggggggctgtgagtggtcacacagacttgaggtagaaaagggttggggatggcaggatgaacaaacacctgagcacaacaggcatggtaggtagtttaaatacataaaaactttccaacacagggawagcttttatttagatagaaacaaaaaggaaggaaaagaaggaagaaaagagagagacagagaaagagagaaagtgtttcccttggaactaaacaggaagtgcagcgacaaaaagaaaaataaaataaaaccaccacgattcgaagaacaaagggcagcctttcatcttcctgcgtctggttctctttctcaggcagaaaagaattgattccttattgcattttaattagagaagacggcgtcggggcggatcatatggagggacaagagagaaagagccagatagggaaatggagatagg

SEQ ID NO: 31276 - DNA, 601 bp, Human
agcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtrttagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtatta

SEQ ID NO: 31277 - DNA, 601 bp, Human
ctgcttgttttccggtgcaggtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagyaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtatt

SEQ ID NO: 31278 - DNA, 601 bp, Human
ccactgcactccagcctgggcgacagaaggagactccgtctcaaaaaaaaaaaaaaaaaacttgcaaaccctcatgaggagcctgtccccagccctgttttccagcctctgcctgcatgggaggggcagtgagtcagccacgtgtttgctttgccgcctctgcctgtgtgctctccaagctgcgggtttcacatgcagtaaacggcatcaagacattgacagaaggtgtatgggcagtcttacactgtctcagcgacttcagggccaaaactgtcttttgtgattttgcctcttttggaartggaagccacctaccgaaattgtgttttaccagagccccaggagctcatagtcaaggctttgtgacatcagagttgttaggaaggttaaccgggcaagataaacgacagaccaaaaattgtcccctcaggccagtgtggagtttctttatcagacatgtgtgcaccccttcccgccttatctcggcatctgtgagcctgtcatttgaatgatgtaaaatccatacatgttgtactgagaccttaaaagtgatctagttcagtgtcatgtattaaaaaataaagtgatctagaatccagga

SEQ ID NO: 31279 - DNA, 601 bp, Human
atcctggctaacacagtgaaaccccgtctctaccaaaaaatacaaaaaaaaattagccgggcgtggtggcgggcgcctgtagtcccagctactcacgaggctgaggcaggagaatggtgtgagcctgggaggcggagcttgcagtgagccgatattgcaccactgcactccagcctgggcgacagaaggagactccgtctcaaaaaaaaaaaaaaaaaacttgcaaaccctcatgaggagcctgtccccagccctgttttccagcctctgcctgcatgggaggggcagtgagtcagccacrtgtttgctttgccgcctctgcctgtgtgctctccaagctgcgggtttcacatgcagtaaacggcatcaagacattgacagaaggtgtatgggcagtcttacactgtctcagcgacttcagggccaaaactgtcttttgtgattttgcctcttttggaaatggaagccacctaccgaaattgtgttttaccagagccccaggagctcatagtcaaggctttgtgacatcagagttgttaggaaggttaaccgggcaagataaacgacagaccaaaaattgtcccctcaggccagtgtggag

SEQ ID NO: 31280 - DNA, 601 bp, Human
aagaatatgctcacgcaaattgcgtgtatttaatcctataatacatatcttaccaagggagatttgttgttgttgttttcttgggtgactgtcgttcaaaccaactcactggccgtgtttaagtgaaaaagctttaacaacctagcgtgagccctgtcatttttgctcttgagtaaattgagaaatgcccttgcttgtcctgcacatccaaccacctggaatggagaacaccgaaggtagggaaaggatctccagggatgagcaggcctggagccggcggggctgcggaggaagaccggcygcaatgagtgagtgctgagcagagagaagggccgttctcggctggtatcaggcccaagagagtcaacaaaggggggacgaaagggagacagggaagagaacagtggtggggctgtaagttgacctccaggtggcagaaaataaagttggaagaattgactgggacagacagccagggccctgcaggaagggcgggagaggaagcctgcggacacctgccctttgtgattgaaccgcagacaccaggcctggcggggtcgcttgcctccgctgcccaagctaaggctccgctaagctggtc

SEQ ID NO: 31281 - DNA, 601 bp, Human
atctctatttaactttcctcggcatttcccatctctctggatggttccaggataactttcttttaatagttggacaactttgaccacatcatggggtgatgtaggttgtctacagggagtccctgtgcactcagccatctcagagcaacgtgctagctggtcaggttcccaccgcctgcatctgtgtgaatcggttatttgggtagaagtttgaaacctctcattttgaaactactgaaaatagtgtgtttatataagaatatgctcacgcaaattgcgtgtatttaatcctataatacawatcttaccaagggagatttgttgttgttgttttcttgggtgactgtcgttcaaaccaactcactggccgtgtttaagtgaaaaagctttaacaacctagcgtgagccctgtcatttttgctcttgagtaaattgagaaatgcccttgcttgtcctgcacatccaaccacctggaatggagaacaccgaaggtagggaaaggatctccagggatgagcaggcctggagccggcggggctgcggaggaagaccggccgcaatgagtgagtgctgagcagagagaagggccgttctcggctgg

SEQ ID NO: 31282 - DNA, 601 bp, Human
ggggacttcagagactggcctgagggagcaggtggtaaaacctctgccacagcagtccccataaggctgaagattcctggatcccctctgctcatactgggccagtttcctcgccacccgtcctgctgtactctggccaaactaaaaagacatctctatttaactttcctcggcatttcccatctctctggatggttccaggataactttcttttaatagttggacaactttgaccacatcatggggtgatgtaggttgtctacagggagtccctgtgcactcagccatctcagagcaacstgctagctggtcaggttcccaccgcctgcatctgtgtgaatcggttatttgggtagaagtttgaaacctctcattttgaaactactgaaaatagtgtgtttatataagaatatgctcacgcaaattgcgtgtatttaatcctataatacatatcttaccaagggagatttgttgttgttgttttcttgggtgactgtcgttcaaaccaactcactggccgtgtttaagtgaaaaagctttaacaacctagcgtgagccctgtcatttttgctcttgagtaaattgagaaatgcccttgct

SEQ ID NO: 31283 - DNA, 601 bp, Human
ttttggaagtggagccctggagctgaatgctgctcaggggtagaggtgtcagagttcaccattcccagaaagggccgtgaggcttgaagtcatcacaggacgaatgcctgccctctggtcagccgtgtttctccctactctacaagccttggcagatctttactttacgcttcccctggagatgtactggtgcctcttgagctgctgctttcaactgggcagttttcacccccgacctcacccctggggaacaatgtctggagacaacttggttgtcacacatgaggagatggccgttagyagaggctggggtactgctcggcaccctccatagcccacgggacagccctgctcagcaccctgcatgtagcccccacaggacagcccccacaccaaacaacagtccagcccagaatgtccctagtgtccagggggagaaaccctgctctaactcaagagcgaagagcctgcatttcactcggcgtgaattctacactttctgagcagagtatctgacgaagcctctctacagaaagtgaataaacgttgttcagatgacttcgacaactcttgttgaaagtgactatgcagatgatgtaaa

SEQ ID NO: 31284 - DNA, 601 bp, Human
tgccttatcttctagcaaggggggcttacgtgttctgatagggatgggtgggccatgtccgtaggctcgggatcagaggaagctggacttcagagttgggggcattcacccagaagcgcctataccaagttctagggtacctccccacccctcacaagctgacagaccctcctccagtggctgattaacctgggtggagcttgtccactcttgctgacaagtccaggggctaaggccaagtctcagccctctctgcctcttgctcccggctgcccctctgcttgcacccatgtccctgccyctcacctgtgagagtgttagcacgtggacggctgcctgtgccaggtactgtggcttctccacctggcctgttggggggtggtccctcattgccagctggggagccgtgcagtttctaaacctctctcttcaccctcggtctgtccactcccctcgtcacaaggtggtttctctggaagctaagatagatttgggaagcagggtctggtagattaggtgccagcgtccatggaagggcagaaaggaagcaggattgggcagagctgactgacagggagctctggaaccacgtggcctcacg

SEQ ID NO: 31285 - DNA, 601 bp, Human
tgagaatccaggccctcgtgttttctcacagctcccacctgcacccttggctgggtcgtgcagcccgtttcagggaagaggcgagttacaggcctgacgccaggagaggggatggggcaggttttggggggcagtgttgccttgctgagagatatttgccttatcttctagcaaggggggcttacgtgttctgatagggatgggtgggccatgtccgtaggctcgggatcagaggaagctggacttcagagttgggggcattcacccagaagcgcctataccaagttctagggtacctccmcacccctcacaagctgacagaccctcctccagtggctgattaacctgggtggagcttgtccactcttgctgacaagtccaggggctaaggccaagtctcagccctctctgcctcttgctcccggctgcccctctgcttgcacccatgtccctgcccctcacctgtgagagtgttagcacgtggacggctgcctgtgccaggtactgtggcttctccacctggcctgttggggggtggtccctcattgccagctggggagccgtgcagtttctaaacctctctcttcaccctcggtctgtc

SEQ ID NO: 31286 - DNA, 601 bp, Human
acgtcagtgaatctcctgtccagcttgtggttgggccccaggtcaggcgccctgagaatccaggccctcgtgttttctcacagctcccacctgcacccttggctgggtcgtgcagcccgtttcagggaagaggcgagttacaggcctgacgccaggagaggggatggggcaggttttggggggcagtgttgccttgctgagagatatttgccttatcttctagcaaggggggcttacgtgttctgatagggatgggtgggccatgtccgtaggctcgggatcagaggaagctggacttcaragttgggggcattcacccagaagcgcctataccaagttctagggtacctccccacccctcacaagctgacagaccctcctccagtggctgattaacctgggtggagcttgtccactcttgctgacaagtccaggggctaaggccaagtctcagccctctctgcctcttgctcccggctgcccctctgcttgcacccatgtccctgcccctcacctgtgagagtgttagcacgtggacggctgcctgtgccaggtactgtggcttctccacctggcctgttggggggtggtccctcattgc

SEQ ID NO: 31287 - DNA, 601 bp, Human
ggtggtcactccccacatgtggtcatgtggggtcccgtggtcgggcgctttgcctctcccagtcccagccagcactccaggcatgcccttccctgctgtggatggccccaccggctgtgctgccctcctccctctggcactgaccacaggctccatatgcatcttgtcccacccctccctactcagccctggcctttcagcctcactcagcagggcccccacctccctcgtgcttccagtagccatcccagcagccaggtcagaccatctcctgggaacctagcagggccaaatcagtatsgcaggagagcccccacgtcagtgaatctcctgtccagcttgtggttgggccccaggtcaggcgccctgagaatccaggccctcgtgttttctcacagctcccacctgcacccttggctgggtcgtgcagcccgtttcagggaagaggcgagttacaggcctgacgccaggagaggggatggggcaggttttggggggcagtgttgccttgctgagagatatttgccttatcttctagcaaggggggcttacgtgttctgatagggatgggtgggccatgtccgtaggctcgggatcagag

SEQ ID NO: 31288 - DNA, 601 bp, Human
gtggtggtcactccccacatgtggtcatgtggggtcccgtggtcgggcgctttgcctctcccagtcccagccagcactccaggcatgcccttccctgctgtggatggccccaccggctgtgctgccctcctccctctggcactgaccacaggctccatatgcatcttgtcccacccctccctactcagccctggcctttcagcctcactcagcagggcccccacctccctcgtgcttccagtagccatcccagcagccaggtcagaccatctcctgggaacctagcagggccaaatcagtwtcgcaggagagcccccacgtcagtgaatctcctgtccagcttgtggttgggccccaggtcaggcgccctgagaatccaggccctcgtgttttctcacagctcccacctgcacccttggctgggtcgtgcagcccgtttcagggaagaggcgagttacaggcctgacgccaggagaggggatggggcaggttttggggggcagtgttgccttgctgagagatatttgccttatcttctagcaaggggggcttacgtgttctgatagggatgggtgggccatgtccgtaggctcgggatcag

SEQ ID NO: 31289 - DNA, 601 bp, Human
gggcgcaggtactcaagggtctgggggtgacgcaggggtctaggctgccggcccatgccctctggagcttgccaagcccagctgtgcatctgccgcgggccctgcctgaccttgcgcctgtggggctgatggaactcagctcgtggtggtcactccccacatgtggtcatgtggggtcccgtggtcgggcgctttgcctctcccagtcccagccagcactccaggcatgcccttccctgctgtggatggccccaccggctgtgctgccctcctccctctggcactgaccacaggctccatrtgcatcttgtcccacccctccctactcagccctggcctttcagcctcactcagcagggcccccacctccctcgtgcttccagtagccatcccagcagccaggtcagaccatctcctgggaacctagcagggccaaatcagtatcgcaggagagcccccacgtcagtgaatctcctgtccagcttgtggttgggccccaggtcaggcgccctgagaatccaggccctcgtgttttctcacagctcccacctgcacccttggctgggtcgtgcagcccgtttcagggaagaggcgagttaca

SEQ ID NO: 31290 - DNA, 601 bp, Human
ctgacatggtctttgctgtgaggctggtgttctggtcacaacgcaccaccctgaggcaccccatgctggtggactagaccttccatagccacagagagtgatgctgcctgaggatctgcaggtgggacaggcagactcagacccagaggatatgcccatgcctgttggagccgtcagcgtgctgcccagcgcccacaggcgggcctccctgggaatggtgtcttgtgggccgatcacattggcatctcctgctggcaggctggacactcagtagcaacagcgactgcatcagcctttggtragtcagagactgtgctgttgaggcccctctggccagccctgggtggccagcgaccaccagccatctctcaaagctgttcagtgccccctccatggcggatgctctcaggtggacattaatgtgagacagcaacctgcacgcttcccattcctccacccaccacacgcctctgtccaggacacccacccctgctggcagctagtgttattctaaccttgatccacttttttttctacaccagggggtgaccaggtgcatctgcccccagtgggggcattttcctcaccacattctctttga

SEQ ID NO: 31291 - DNA, 601 bp, Human
ggagaagacgtggaaagactgaggaaccgtctcagactggaggagaccaaggggacacgacagctcagaacatcagggacccaggatgggctcctgggccagagaaaggacaagagtgggaaggctggtgaaattcacatcatgtttgtagttgagtgactagcacattgtcagtggctttggtcatcttaagatgttatgtgacattttttaacctagggagagctgcctgaaggtttatgggaactctgtactacttttatcatcttcctgcatctaaacgtacttgaaaaccagaacrtttaaaataaaggaatacaagagaggaggaggaaggtgactaggccagactgtgtcccccagtgccgcactggtctcagagctgccctgctcctcaccttctcacaccccagggtagttcccctcacccatagctcccacctctgctggcttcagcagccgcccaaatgctaaaacactcacccccaagggatctgtggcctgctcactgtgcccagctcagagttgctgcacttgtccacttaactgctatagttgatcaggagaggaacaagcggcaccggcctgcatcccatttccc

SEQ ID NO: 31292 - DNA, 601 bp, Human
gtaactttacagtaaagaaacctggcagctaccaccttgccgagtggtcagagttcacagaaataagacaaaagccaacatgaagcactgaggggaacacagccttcgtcgctgcgtgggatttctcctgaaggtgcagcagctcagtctcatcatgaggaacgtcaggcccagactggggggcagtctgcagacacccgcagtgctccaccaaagcgccaaggtcggagaagacgtggaaagactgaggaaccgtctcagactggaggagaccaaggggacacgacagctcagaacatcwgggacccaggatgggctcctgggccagagaaaggacaagagtgggaaggctggtgaaattcacatcatgtttgtagttgagtgactagcacattgtcagtggctttggtcatcttaagatgttatgtgacattttttaacctagggagagctgcctgaaggtttatgggaactctgtactacttttatcatcttcctgcatctaaacgtacttgaaaaccagaacgtttaaaataaaggaatacaagagaggaggaggaaggtgactaggccagactgtgtcccccagtgccgcactggt

SEQ ID NO: 31293 - DNA, 601 bp, Human
agtaactttacagtaaagaaacctggcagctaccaccttgccgagtggtcagagttcacagaaataagacaaaagccaacatgaagcactgaggggaacacagccttcgtcgctgcgtgggatttctcctgaaggtgcagcagctcagtctcatcatgaggaacgtcaggcccagactggggggcagtctgcagacacccgcagtgctccaccaaagcgccaaggtcggagaagacgtggaaagactgaggaaccgtctcagactggaggagaccaaggggacacgacagctcagaacatyagggacccaggatgggctcctgggccagagaaaggacaagagtgggaaggctggtgaaattcacatcatgtttgtagttgagtgactagcacattgtcagtggctttggtcatcttaagatgttatgtgacattttttaacctagggagagctgcctgaaggtttatgggaactctgtactacttttatcatcttcctgcatctaaacgtacttgaaaaccagaacgtttaaaataaaggaatacaagagaggaggaggaaggtgactaggccagactgtgtcccccagtgccgcactgg

SEQ ID NO: 31294 - DNA, 601 bp, Human
ttgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgtgagtacctttttaaaaaaaaaaaaaaaaagtcattctagaaagcttcctgaagaaatctagtttggttattgtttttctaaagctgtacagtgtgtcattctgtggggactttccatcttgtaattcakatttgggttcatagacgttgttgacctttgttgcatcattccctagagaaggacttcattcactgaggagcctaccactttgcataattcacatggatatctactgttagtaaatacccaatcagtaacccaaccaacaatttgcaattgaaaagttcttcacctaataacttaaaagctgcacttttaagagaaggcaattttaagagggagcaaagttacataggattagagggttgtcgtccatataattgtgtgtttttatttctttaactgtttaatccgttcattatagtagtt

SEQ ID NO: 31295 - DNA, 601 bp, Human
ggttttaaattgctgaattgtagagagcatctagattgttattttcagtattaaagatgggggtcaggtttagaatccagcaagtgaaaagctgtccttactctgcacttctgatctagaactcagcctgcactgaagggactatcttgtgtttcttcttttctccactgtgtgaaatcataacaagaaacaacctctgagcataagatcagcttctagtatttaggggaagaaaatgcacattcctaaagtggtatgacaccaagctaccctacattgaaaagcagcctacttttccagyctgatctaaagcaaatcccaaaatagcatgggcttgatttattaaacctctgtcctgtgcagaggctgccccacgcctgaccccactgtcctccgaactcctgctgcagccgtaccctccagccctcagtggagcaggatgtgggtacaggcctgagccctgtgctgtttgctcttcttgtttgcgggtcgcatgtcttgagccagcctgtgacactcttgtctctgtatcccccagactgttcagtccacttccacataaactcaggaaatagcaattattgccagataatcagtgagc

SEQ ID NO: 31296 - DNA, 601 bp, Human
tgtagttcttctaggcttatttcaagagtctgcttaaaaggttgtctgacactctgatcattaaaccccagtgtgatctttctaagaatgcctcaggctctctcatttagaaagacttagtgcaactcattcatttgaatgagttaattcttgctcaatgcaaagatcccacaaaccttgggggctaggctgaggtccagccgctaaactctgcaattcctcactctcctgttcatacacacacagacacaaccctcctcacctccctgacctgcccctgccaaaaaatatgagtcatccrtcagtgtctcggggagttgagtggggagctatctcagatgctgagtcatgattttcagagaagatctgaacagattgctgtggttttaaattgctgaattgtagagagcatctagattgttattttcagtattaaagatgggggtcaggtttagaatccagcaagtgaaaagctgtccttactctgcacttctgatctagaactcagcctgcactgaagggactatcttgtgtttcttcttttctccactgtgtgaaatcataacaagaaacaacctctgagcataagatcagcttctag

SEQ ID NO: 31297 - DNA, 601 bp, Human
caatatctattaatattttagaagcagatttttttatacaaatatatgggcatggaggcaaggatatatgaaataattccttttactgtttttctgtagaattaccttcttattaccttgactttgatcatcgcttttatgttaatttattgccccatccgtggtttccagatgtcagcctgggcaacggctataacagtttgccttctgttccataaggcagatgaaattggagctactcagattttggaaacagctgttccttatcattgagagacagttcagcagttttaccttttcrtgagtcatcagttactgggcctaggaaatgtatttccatcttgtgtcattgaccccatatcttcaaaagatgacacaactgaaatagcttcatgtagttcttctaggcttatttcaagagtctgcttaaaaggttgtctgacactctgatcattaaaccccagtgtgatctttctaagaatgcctcaggctctctcatttagaaagacttagtgcaactcattcatttgaatgagttaattcttgctcaatgcaaagatcccacaaaccttgggggctaggctgaggtccagccgctaaa

SEQ ID NO: 31298 - DNA, 601 bp, Human
tgatttgcagctcccttggttaagcctttatggtcctgggaagtttctactaggcagagaaagcatttctgtaaaggttttcttttttaaaacaaaacgagtctctgtgtgcaccacatccatttctggcatctcagggctcactattcagaatggccagttcccattccctgaaaagggaaggggctctttgctccagagcatgctggttcattcataccccgtccagaaagagccaccagcttcaggtgaagtcaccattccaggcaaaagtaaaaataaaatttcagttccaaaaaaygccttcagcctatcaaaatctaagtttcgacttaccaatatctattaatattttagaagcagatttttttatacaaatatatgggcatggaggcaaggatatatgaaataattccttttactgtttttctgtagaattaccttcttattaccttgactttgatcatcgcttttatgttaatttattgccccatccgtggtttccagatgtcagcctgggcaacggctataacagtttgccttctgttccataaggcagatgaaattggagctactcagattttggaaacagctgttcctt

SEQ ID NO: 31299 - DNA, 601 bp, Human
gccattcaaatgagagagacctcagccatggaaagcagcacactggctgcccaacttcaggtccctgctgcctccttctccccaaacgttcctttgacagtccctacatcttatgtgattttccagctgtttgatatttccagattagtaaatgtcctttaaaggaagagttttgtttaattataaagtctttttagactaattatgtggcaaatatcagcctccttccctgccatacccaacaacagccttgaattcaattccaaagaaacaaatttaacttcagtacgttgcatggcamacatttgagtgttcatacattttgatttcaagtttaaaacacacttggctgaagcccacagaagcaggggctacttgggagaggaccgtcccaggcttgaaggcagcccctgcctcgcctctggttccttgtgccttgatttgcagctcccttggttaagcctttatggtcctgggaagtttctactaggcagagaaagcatttctgtaaaggttttcttttttaaaacaaaacgagtctctgtgtgcaccacatccatttctggcatctcagggctcactattcagaatggccagttcc

SEQ ID NO: 31300 - DNA, 601 bp, Human
caaacgaaggtgccattcaaatgagagagacctcagccatggaaagcagcacactggctgcccaacttcaggtccctgctgcctccttctccccaaacgttcctttgacagtccctacatcttatgtgattttccagctgtttgatatttccagattagtaaatgtcctttaaaggaagagttttgtttaattataaagtctttttagactaattatgtggcaaatatcagcctccttccctgccatacccaacaacagccttgaattcaattccaaagaaacaaatttaacttcagtacrttgcatggcaaacatttgagtgttcatacattttgatttcaagtttaaaacacacttggctgaagcccacagaagcaggggctacttgggagaggaccgtcccaggcttgaaggcagcccctgcctcgcctctggttccttgtgccttgatttgcagctcccttggttaagcctttatggtcctgggaagtttctactaggcagagaaagcatttctgtaaaggttttcttttttaaaacaaaacgagtctctgtgtgcaccacatccatttctggcatctcagggctcactattcagaa

SEQ ID NO: 31301 - DNA, 601 bp, Human
gaccaggagacttctctccccaaaagtgaggtttcttcttcctcccacagagggagaccgggggccctgcccaagcagtgccccaggggcaagaggatttgggagagaacaaagtgagccagtaaacatgccccatgaccctgacctgtaccccattagtccttcaaacgaaggtgccattcaaatgagagagacctcagccatggaaagcagcacactggctgcccaacttcaggtccctgctgcctccttctccccaaacgttcctttgacagtccctacatcttatgtgattttccarctgtttgatatttccagattagtaaatgtcctttaaaggaagagttttgtttaattataaagtctttttagactaattatgtggcaaatatcagcctccttccctgccatacccaacaacagccttgaattcaattccaaagaaacaaatttaacttcagtacgttgcatggcaaacatttgagtgttcatacattttgatttcaagtttaaaacacacttggctgaagcccacagaagcaggggctacttgggagaggaccgtcccaggcttgaaggcagcccctgcctcgcctctggt

SEQ ID NO: 31302 - DNA, 601 bp, Human
tttatgtggataaaagctcttcctgtgtatatttttcatttctctggtgtcttgtctcatgttccttaaaacttggaggcaaaggacttcatcgtagcaagtttccaaaggaaaagcgggaagcaaacaggaagatgaggtttcatattaggtcaccaggtatctagagcagctgactttgtgacgaggattcgtggtttgcagtttgcagggtaattgcaacaaaaatattctgcacctttgtggttagaacaaaattctttcaagttcatggacagcattaggcttttgaagtctgccrgaaccagtagctgccactgggttttaaggaccaggagacttctctccccaaaagtgaggtttcttcttcctcccacagagggagaccgggggccctgcccaagcagtgccccaggggcaagaggatttgggagagaacaaagtgagccagtaaacatgccccatgaccctgacctgtaccccattagtccttcaaacgaaggtgccattcaaatgagagagacctcagccatggaaagcagcacactggctgcccaacttcaggtccctgctgcctccttctccccaaacgttcctttga

SEQ ID NO: 31303 - DNA, 601 bp, Human
tccatgtataattagaagtgtctgatttttcggagatgaattttatttaaaatggatgaaacctagtcatcaacatgaaagttggctatgcttctctactcacctccctaaaatgacatatccccaggtggcccccataaaccctttgtgcttgcctttttaacttacagaggatgaaaaatgaaagaaaacgtagactggcaaaatggcagtaaagtaagttggatcttttccaaaatcccagatttctggagggctgaagttgaactacttttgatagttactaggctccagctgagcwctgcccttggtgcactgggctttctagcacctaaacccttctagagcttgcacagcaggattggtgtggtgggtaggggggctcttttttctgttttgttgagtctggggtaggcagggacgtctttctttgactgacacccaagatggctctgatgggcaccaaacagcccatcacaggagtcctggaacccacacctctgggttgaaggggattgccttagcctctcatgacatatttaatcattttcagaattactatattttctcatatgatgtacacatgtatttaggaggttat

SEQ ID NO: 31304 - DNA, 601 bp, Human
gcaacttgcttttttcatgtgacaatatgactttgagatatttctatttccttggttgttggattttcctctgctatatgataacatatatcagcaaaactttctctaaaaccacttaattcgtctaaaatcatatcccctcatttatcatgctaatcactccatgtataattagaagtgtctgatttttcggagatgaattttatttaaaatggatgaaacctagtcatcaacatgaaagttggctatgcttctctactcacctccctaaaatgacatatccccaggtggcccccataarccctttgtgcttgcctttttaacttacagaggatgaaaaatgaaagaaaacgtagactggcaaaatggcagtaaagtaagttggatcttttccaaaatcccagatttctggagggctgaagttgaactacttttgatagttactaggctccagctgagcactgcccttggtgcactgggctttctagcacctaaacccttctagagcttgcacagcaggattggtgtggtgggtaggggggctcttttttctgttttgttgagtctggggtaggcagggacgtctttctttgactgacac

SEQ ID NO: 31305 - DNA, 601 bp, Human
atggagagttttgttttttggttttttttgttgttttttttttttgtttctttaaatacaagtagtgcacattcttgttcagtttcatcctaagttccaactggacagagaaccagatagtaggaaataaaaagcggaagtcctccttgtccctcactcccctcaaggtatccaacattcattggtgtgtcttccccaacctttttctgaacattttgttataattttcagtttaattttttagacttacttttaaactcagaagtaaaaattgtatatacttatagtgtacaacatggtrtattgaaacacgaatacattgtggaatggttaaatcaagctaattagcatatgcattacctcacatacttactattttgtgtgtgtggtgagaacacttaaaatctactctcagcaattttcaagtataaaaatacattaactgtggtcaccatgatgtacaatagatgtcttgatctaagcattttcaaatttttatttcatatatacacacaaatagtatcaatttagttctgttgttgctttgcaacttgcttttttcatgtgacaatatgactttgagatatttctatttccttgg

SEQ ID NO: 31306 - DNA, 601 bp, Human
taaattgtctaggctttatgatgagatagctccgtaacaccacatggagagttttgttttttggttttttttgttgttttttttttttgtttctttaaatacaagtagtgcacattcttgttcagtttcatcctaagttccaactggacagagaaccagatagtaggaaataaaaagcggaagtcctccttgtccctcactcccctcaaggtatccaacattcattggtgtgtcttccccaacctttttctgaacattttgttataattttcagtttaattttttagacttacttttaaaytcagaagtaaaaattgtatatacttatagtgtacaacatggtgtattgaaacacgaatacattgtggaatggttaaatcaagctaattagcatatgcattacctcacatacttactattttgtgtgtgtggtgagaacacttaaaatctactctcagcaattttcaagtataaaaatacattaactgtggtcaccatgatgtacaatagatgtcttgatctaagcattttcaaatttttatttcatatatacacacaaatagtatcaatttagttctgttgttgctttgcaacttgcttt

SEQ ID NO: 31307 - DNA, 601 bp, Human
tgccttgggcaaaatcttttctatgggcctgccatgaattactacttgccttgggcagataactgatttcaaggttggtttaaaccctgcaagtgttcggagaatgttctgatgattagagtagatgatcatgggtagccagagttcctattatttgtgccgtgagtatgttctgtcctcaacccctagataaagatctcttccaaatagtaagttaccatttgctcgactctgaagtaaattgtctaggctttatgatgagatagctccgtaacaccacatggagagttttgttttttgkttttttttgttgttttttttttttgtttctttaaatacaagtagtgcacattcttgttcagtttcatcctaagttccaactggacagagaaccagatagtaggaaataaaaagcggaagtcctccttgtccctcactcccctcaaggtatccaacattcattggtgtgtcttccccaacctttttctgaacattttgttataattttcagtttaattttttagacttacttttaaactcagaagtaaaaattgtatatacttatagtgtacaacatggtgtattgaaacacgaatacatt

SEQ ID NO: 31308 - DNA, 601 bp, Human
taaaccaatcctgatagaatgggcctgaccaagccttgagaataagatacacatcttctcccatggagagacacgagcagcaaaattaattaaatcatctgtctcttctatgggcctgccataaattactacttgccttgggcaaaatcttttctatgggcctgccatgaattactacttgccttgggcagataactgatttcaaggttggtttaaaccctgcaagtgttcggagaatgttctgatgattagagtagatgatcatgggtagccagagttcctattatttgtgccgtgagtrtgttctgtcctcaacccctagataaagatctcttccaaatagtaagttaccatttgctcgactctgaagtaaattgtctaggctttatgatgagatagctccgtaacaccacatggagagttttgttttttggttttttttgttgttttttttttttgtttctttaaatacaagtagtgcacattcttgttcagtttcatcctaagttccaactggacagagaaccagatagtaggaaataaaaagcggaagtcctccttgtccctcactcccctcaaggtatccaacattcattggtgt

SEQ ID NO: 31309 - DNA, 601 bp, Human
gtggacttgactttatttattttatacgacgtctgacagatgacaggaaaagagaaagcactaaaatggcagaagctatcaggtatgtaaaaatgatgttttttaaacattggttgggtgttttgtttttggtaaaccaatcctgatagaatgggcctgaccaagccttgagaataagatacacatcttctcccatggagagacacgagcagcaaaattaattaaatcatctgtctcttctatgggcctgccataaattactacttgccttgggcaaaatcttttctatgggcctgccatraattactacttgccttgggcagataactgatttcaaggttggtttaaaccctgcaagtgttcggagaatgttctgatgattagagtagatgatcatgggtagccagagttcctattatttgtgccgtgagtatgttctgtcctcaacccctagataaagatctcttccaaatagtaagttaccatttgctcgactctgaagtaaattgtctaggctttatgatgagatagctccgtaacaccacatggagagttttgttttttggttttttttgttgttttttttttttgtttctttaaa

SEQ ID NO: 31310 - DNA, 601 bp, Human
agttatgtagttatattttactccatccccagcatctcaatctctggttacagaaaatgagacatttgcaaattaattaaaatcatggtagatatcagtaactgtatcaggctatgatgcatttttcacagatgcagattctccagtaataaaatgcttttaggcagggtgcggtggctaatgcatgtaatcccagcactttgggaggccaaggcaggaggatcacttgagcccaggagttcaagaccatcctagacaacatagcaaaactccatctctacaaaaaaagttgaaaaatgarccaggcatgatggcacaagcctatagtcccagctacttgggaggctgaggcgggaggattgtttgagcccaggagttcaagaccaccctagacaacatagcaaaactccatctcttacaaaaaggttgaaaaatgagccaggcatgatagcacaagcctgtagtcccagctacttaggaggcggaggcgggaggattgtttgagcccaggagttcgagagcacagtgagccttgattaaaccactgcacgccaacctgagcaacagagtgagactctctccaaaaaaaaaaatgctttaa

SEQ ID NO: 31311 - DNA, 601 bp, Human
aacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtgagaggcgctcttgggctggcgtgggcttcgcgcttctccctgcctgatttccaggcctgcctggckgaactggctcttcctgtgctctttctaaacctccttttgggccatctcccgatgcccaccagaagggagggagcagaggggaagttgcgggctttgctccatgtcccacctccaatggccgtgaattcaggatgcttggcctgtgctgagtgtccatccccattctcccgggtgtgggtccacccaggcctctgtgcctctgtggttcacctcctgcctggaagctcttcatctggcgggcacggggctccatgaaggcacgtgggaaatgtgtgtgcacgcgctttgctttagctttca

SEQ ID NO: 31312 - DNA, 601 bp, Human
tcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgcygagagggccaggatggggagcaggcccaggatacacccactagtgcctcaggtgcccggccctgtgactgcagccatggccacaggcttagctgttaacgggaaaggtgagtgtctagggagctgctcaggctccgtggtgatcccagagggctcgggtccttctctagagatcaggccttgagctgggcagagtccggggcttctcacggcatctgctggagccttgcagagatttcgccttctcctttcttcgctggaagcctttgatatttctcttaattcggcaactagttttttc

SEQ ID NO: 31313 - DNA, 601 bp, Human
ttagaccttcatttccttgctggccaagttacactaccttaaatatctttttctacttttaggtctcgtgggctgcctaaactaaaagagtcacgttcccatgaatccttgctgagcccatgcagcacagtggaatgtctggatcttggtagaggggaacctgtatcagtgaaaccacttcatagtagcatccttggacaagacttctgctttgaggtaaaaataaagtgtagaaaaaaggaagagtagttaaacaacaattggattttatgtccagtaattttgcgatttcattgctgtrcagttgatgatttaattaactggttttcagttgctagaaattatctacttacagagaaaaagttagaaatcttttcatctaatcatatttgcagttaaagttattaaagatagctttgcattccttttggctttgcctcctttcagtaaaatttgattcttagtacattttcatcaggggacaagactaacaataacattacattactatgttaatttttagtattggtaaggatgtcactcatcatgttatttttctaaccacagcatcagtggttcaagatctgagaccatgtttttc

SEQ ID NO: 31314 - DNA, 601 bp, Human
gttacctacttaagtggaagtaaatgcttcagctgtaattctgcttctgagagagacaagtggatggaaaaccttcgcaggacagttcaacctaataaggtaatagtagcttcaagtatctaaaaaatgtataactttgtaagcagttaattgatagaaggtaagtgtggtagtaataccttaatttgtctatagcttgagagttttaaagcacatttatatgttatgccatttgtagtaagcccttattatatcaccataaagaagtatctgagactgggtaatttatcaagaaaagcartttaattggctcacggttctgcaggctttacaggaagcatggtgctgttatctgctcagcctctagtaaggcctcaggaaacttacagtcatggcagaaggcagaaggggagcaggcacatcacatggtgaaagcaggagcaagcgagagagagagtgtgtgtgtgagtgacttggggggaaggtgccacacacttttaaaccaccagatctcacaggaactcagtatcaggaagatggcaccaaggcatgaggaatctgcccccatgatccaaacacctcccaccaggccccacctcta

SEQ ID NO: 31315 - DNA, 601 bp, Human
tgcccccatgatccaaacacctcccaccaggccccacctctagcactggggattacaattcaacataaaatttgggcagggacaactatccaaactgtattatcattttaagctaaaagcagtcttactgcagatattattgccatggttctaccagcatggataaaaggactctgaaaagttaggtgaattggccatgtcagaagctagtacatgatagaagagggactagaatacgagcttcttaacagcttatctcttttatttgcagatattagactggttatatgaaaacttaccrttacaaaatgatattttcttaacccaagtaaataaaatagaatgaactatatataatatatataatgaactatatataattcttcaagattctaatgcatgcttgtttagagcttgctgttaacctaagcaatgagatagcaatccctttcattatttgttgactccccttaatagagtacctaatgaacattgccaacttaagaaaaaaatgtttttttttctgcaatgtcagctctgaaattcagctttgttgcctctttataggacaattgcaggcgagctgaaaatgttcttcgtt

SEQ ID NO: 31316 - DNA, 601 bp, Human
ttccctacctttcataaaccaagatatggatattgtagaaatccaaattagagaaatgtgctttactattggtcaaaacaagaagaattaagaagaaaacctattagatccagaaaagatgaagattataaaactaaacaagtaaaatggagagaccagcaaatatttaaagccaatttgcatgaaacatagataacacagccagctctttcttgtctgacaaaataaatggtaggattggcacgataaccctacagcatgttcaaggttccttatctttaatttagttctagagtgttgyatggtggttttcttcctcactgtattttatttaagtttaactgatgactgtatcctctaggcacagaaggaagtattccagaagcatattgagtattagcaagagtctttgtgggattaaaatctatatttagaataaaaatccaagggatatgatacaattggtagctgtttcatgatacacttatttcaccttggatagaagtaaaaactcaggaatattttttatttaaaggagaaatatgctggttgtgggaagaacaaaaactagttgagagagtctttgacctatgaaggatat

SEQ ID NO: 31317 - DNA, 601 bp, Human
tctgactgacttggtgatgtctgaggtggatcgttgtggagagcatgatgtcttgatcttcagagagaacactattgccaccaaatccattgaggaatacctcaagttggtgggacaacagtatcttcatgacgcactgggtatgaaagagaaaaacatctattttcttttatttacttttcagttttaagctatttcacccccatgagacgaattgagctcaaattctgcatgttatttagttctagctgactcaggtgttaaggtttgaatcatggctgtaagaagtctgcagtactcmccagtagagaaataataataaatgtagaaacagaaaccttgtcagcatacactgctaccccaggtccccagcttcatgattccaggatgcacagtaatatcagcagtgtccactgatagatctgaggtggtctgttttgcccaaagttttgggtgtttatatgatgatattattacctagtcttgagagtgttaccctgacatttgttatcatgcatgcaaaactctaatcaaaagtgaagaaactcttgccacttcccacaactcccccacaaatttctgcctttctctagaattttta

SEQ ID NO: 31318 - DNA, 601 bp, Human
tgacatttgttatcatgcatgcaaaactctaatcaaaagtgaagaaactcttgccacttcccacaactcccccacaaatttctgcctttctctagaatttttaacataactaatttttgtccaatcagtagttcttgctgactaggctacgcacttgcagttccagatttggtcatgaaattgaggcattaaccgctagagtaaggtactgtgctggtcactttaatatacatcatgatagagcagatgtgagttccttgaaggaaatagccctttgttttacctccatatccccactacstgcacacactgttgagcagcactgtccgatagaaatatgacccatgtgtgaatacttttatttatttttattttttgagtaattgtaaattttctagtagtcacagtattaaaaaggatgaagagaaacaggtgaaattgataacatatttcatttgacccagtatatccaaatactatttaatggtttagaagaataaaagttattaattaggtgttttacttttttattctttttgaaaatcagtgtgtatttcacatgtatcacacattttaatttgcacaagccatttctaatgct

SEQ ID NO: 31319 - DNA, 601 bp, Human
aggtgtagagtttggccagtttttacatgggatatttgacattgatttcttagttttaaatttaggtactctttaaatgaagtttaattgtggaaacacatagcacaggagacatagagaacatattgactacatatcttgggagaattgataacattttaaaacagtcttttactagttttggccatttcacctgacaaaaaattattcaaaagttgcatgatttttaaattaaaatactttttgtatggtgcacctactaagagccaggtaccatattagatgcttttcatgcattatstctgttcctcaccacaactctacaggatgattgctattaacactgttttacaaacaagacagctgaaactcagacgaattaagtgacttttccaggccccacagtcagttaaatgatggatccggatttgagcctagatctctgacctcaatgcctttaatttttctgtgcaccactttcctttctgtataccacattgtttcctgttctctaagcatttttcctcaaaattatcgcttctcatctcctgtcacgggtatttttaaaagctttcatttatccaaatactaaccactttga

SEQ ID NO: 31320 - DNA, 601 bp, Human
gatatttgacattgatttcttagttttaaatttaggtactctttaaatgaagtttaattgtggaaacacatagcacaggagacatagagaacatattgactacatatcttgggagaattgataacattttaaaacagtcttttactagttttggccatttcacctgacaaaaaattattcaaaagttgcatgatttttaaattaaaatactttttgtatggtgcacctactaagagccaggtaccatattagatgcttttcatgcattatgtctgttcctcaccacaactctacaggatgrttgctattaacactgttttacaaacaagacagctgaaactcagacgaattaagtgacttttccaggccccacagtcagttaaatgatggatccggatttgagcctagatctctgacctcaatgcctttaatttttctgtgcaccactttcctttctgtataccacattgtttcctgttctctaagcatttttcctcaaaattatcgcttctcatctcctgtcacgggtatttttaaaagctttcatttatccaaatactaaccactttgatagaaatgctctttctgctgctgatgctgc

SEQ ID NO: 31321 - DNA, 601 bp, Human
ttttttctttctacttttcattgtttcaaacttttttcagtaagtttatgatatttttataatttatagaaaataaatttaagaaatggctgggaaggaattcacatttacagaactgaccacagatttactcagtattgatgcttaaagacaagtttctgttagcaatgtattgaagaaaaaaattggaacttcagtgaacagattgttttctagtataagtggtggctttttagaggtgtactattttaattttgtataatttatatataagccaatgcagaaatatacatatttatcsatatttgagctaaaaatatttatattttattttggaacaggttttatggacttaaactaggccctgcagatagctagaatctagataggcaaaggagagaagtttttctctagtgcaagtaaatagcatgggcaaaagcttggagaagaaaaaaatgtgtaatatatttgggagactttgtagaagctagcagtattgaaggtttgtactggtgagcttttggtaggtaagtgagggctatattgcagagaaatttaaatcccagaactaaaaaaaaaaaaaaaaaaaggagttttggct

SEQ ID NO: 31322 - DNA, 601 bp, Human
gccctgttcccaaagttagagcaatccagagacaacagacacagcaggtaggtgtgagtgctgaaggggcctggcttctacttggtccatctgtttccttggttctttatacataaatcattgggaaatcctattgttaacaagatttcctcttaaaagcaacctttaaatggaaagaggaaaggaaaaatttgggaggcttctgcccaggtgtgactacagaatgtagtttgactcattacccttaagagtctaacaaacacgcagaggcccccttccttctcttcaagcagcagagctrctacctcagtttgcacttagagcaaatctatgatgttgaatgaataattagatacttaaaatctgtaggcaaaaccagctattattttggaaatctgaaaattaatccttcttaattttttttcttaagcttccagaataaaggtttgcattccgagccaagagtttaatatgactgctctccattccatccctcaactccttctggaaatacaaagtcccatgtggcttttcctggaaatagctagaaaaataaacacttgaacacctgtagagtcaaggtaaaggagagagtaaaaag

SEQ ID NO: 31323 - DNA, 601 bp, Human
aggagatggaacaatcattgaaaagaagcctttggtgcccttccaaaggattaggggaaaaacatagaatattctctaagtaataaattatattttagtaatgaattctaaagataatccagaataataaatgaataatattttattgagcatctgttgtgtatttaactagtcagtatcatttaaaagaactgtatgatatgatgcccattagattgactaattggaaaataagagcaacgcttataagaccaagaatatataaaagatagtatatagttttttcatttgaagaacataytacaacaaaaaaattcatgaaacaaaaatcacctctgtttcctttcaatctagcacaataactattttttatttattctatatttctagcctttttacaattttgtgaaggctttatcattaatagaaggaatagttaggattgatctattttgtcacttttatttttattattttgaccacctactgtatgccaagcaaagtgctaggatatattaggaagtggctgaaaataagatttgaccaacaaaatagtagaaatttctagaagttcattcacaattgcttagtgtgtacgggt

SEQ ID NO: 31324 - DNA, 601 bp, Human
tttgccattctgatatataaatgggcactttgtgagtttgtttagcactaatcagttttttggtttctgattgtgtctgggctaaacagatattttgaccatcaggttatgctttctttctcttatttaatcatcaaatagacttttatggcataaaagacttttatggcagaggtcatttattaatttcagcaggcaatttgttacctaccagtatttggaccactgggcaaattaacaattttaaggctttgactttctttagagggagaataaggatgcctcttggatatgatatatkcaactttctattcagaatagtttgcacttatacaaatgtatattctctttccccacccctagccttggcattagtaaaataatacttaaagctaagagcatttattagaaaactgagagatcacagttaatgtcttccaagaatagctgtttgtgaaacatagcacacgggtgagctgttaggggaaatgctaataactgtttctgatgcaggttcagtcacctgtggactctgccacaatgtccccagtagagaggacagcagcctgggttctgaacaatgggcagtatgaagaggatg

SEQ ID NO: 31325 - DNA, 601 bp, Human
gcagaggtcatttattaatttcagcaggcaatttgttacctaccagtatttggaccactgggcaaattaacaattttaaggctttgactttctttagagggagaataaggatgcctcttggatatgatatatgcaactttctattcagaatagtttgcacttatacaaatgtatattctctttccccacccctagccttggcattagtaaaataatacttaaagctaagagcatttattagaaaactgagagatcacagttaatgtcttccaagaatagctgtttgtgaaacatagcacaygggtgagctgttaggggaaatgctaataactgtttctgatgcaggttcagtcacctgtggactctgccacaatgtccccagtagagaggacagcagcctgggttctgaacaatgggcagtatgaagaggatgtggaagaaactgagcaaaatctagatgaagccaagcatgctgagaaggtagaacctagtctgcttcatcaactttctgatcccaaaatgacaggccactaaaaaggttatctagctaagaacataaactcatcccacccccatcttcacctctaccccttatgttaat

SEQ ID NO: 31326 - DNA, 601 bp, Human
tagcttgagcccaggaggtcaaggctgtggtgagccatatttgcgccagtgcactatagcctgagcgacaaagtgagaccctgtcttgaaaaaaaatgtaatagtcttaagcagagggagcttgggtgtgccacagttgtggttctgtacacaggctgacaggacagcctcatgattagctcctgaagatttctaccccaccccctaattttatattagggctaggtgactgggtataaagcagaagtcacctgctaggcataggaggtaaaagccagggagggaatctgatttattaggrctcaaatgctctggaaagtaaggactttctctcagttaaccaggagggtgtcatgtgtaggaatgggagaaatgctatcctcaaaccgtaagtcactgtcagactggtggtctgctaagctagttaatgttttcagtccatacttcaagacagtggttttgaaatggtttggttctctggactattttggtagaatccaggcacctttcataaatgaatatccagctccttccactgaccactcaacagcaaggaccacactctcaactaatgaatcaaatcatactgggattggttaaa

SEQ ID NO: 31327 - DNA, 601 bp, Human
gcttgatacctgtgttgcatagtctgaggtaacacatggtatcacttttacatgacagtctaatgtcccaagagattgttaataaaaagtcctgctatgctgaaagaaaaagagagagagaaaaaaataaacacagatccactgggctcaggggaagctgaacctgaccagtgtgcagaaagaggcagagacgttccatttgtctgggaagcaccatgcatacaactgtttgagagaaagcactggactagtcattcagtaaagaaagcgtgttacctcctgcctgtagcctgaataaagycatgattggtgtgttgtaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtg

SEQ ID NO: 31328 - DNA, 601 bp, Human
tgtacagaaaatatcactgtaatataccaaaaggaagttaataatgtagattacctttttgattattgctatttttattattgttttcctcttgttgaaagcactgcagttgttacaggaagtaaagtaggaactgttgtgtgagcgagacatgagcctgtaggttcagtaggtagagaccaagcatctatctgatagaagcacatggagtgcaataggacattgtgagaaggaatttttcagggattcatctactagtttaaaaaccccactctggccctcttgtcctttcagaaaacawgcaaataccaagatccatacaaaacaataatttattccactgatcaaccaagactggttctggttggacagctaatctgatttggggattcactgtttcagaggacacagacaaaagctgttgcatcaaaactggactttaggagtaatttctattgaactcctgtcaatatgtttatttcctctgtctacagcagatgggagtcttctcttttagacaggggctttttgtttttaaccccaattgtaataaagggtgttctttttcctctttagagtttacaaaactataaatatttgt

SEQ ID NO: 31329 - DNA, 601 bp, Human
gcctggtgttcactgacctccaacgccgaacactcttcgccatcttcaaggagaacaaacgcccgtcaaaggagatgcagatcaccatttcccagcagctgggcctggagctcacaaccgtcagcaacttcttcatgaacgcccggcgccgcagcctggagaagtggcaagacgatctgagcacagggggctcctcgtccacctccagcacgtgtaccaaagcatgatggaaggactctcacttgggcacaagtcacctccaaatgaggacaacagataccaaaagaaaacaaaggaaaaagacaccggattcctagctggggcccttcactggtgatttgaaagcacaattctcttgcaaagaaacttatattctagctgtaatcataggccaggtgttcttcttttgtttttaatggctatggagtccaagtgcaagctgaaaaattaatctcttagaaccagacactgttctctgagcatgctaagcatcccagaaacccaaatggggccttcctggagcgagttaattccagtatggtgtcaaccaagctcgggattgcttaaaatatcatccatcccacttcaggtcctgtcagct

SEQ ID NO: 31330 - DNA, 601 bp, Human
tgttcactgacctccaacgccgaacactcttcgccatcttcaaggagaacaaacgcccgtcaaaggagatgcagatcaccatttcccagcagctgggcctggagctcacaaccgtcagcaacttcttcatgaacgcccggcgccgcagcctggagaagtggcaagacgatctgagcacagggggctcctcgtccacctccagcacgtgtaccaaagcatgatggaaggactctcacttgggcacaagtcacctccaaatgaggacaacagataccaaaagaaaacaaaggaaaaagacacyggattcctagctggggcccttcactggtgatttgaaagcacaattctcttgcaaagaaacttatattctagctgtaatcataggccaggtgttcttcttttgtttttaatggctatggagtccaagtgcaagctgaaaaattaatctcttagaaccagacactgttctctgagcatgctaagcatcccagaaacccaaatggggccttcctggagcgagttaattccagtatggtgtcaaccaagctcgggattgcttaaaatatcatccatcccacttcaggtcctgtcagcttcttgc

SEQ ID NO: 31331 - DNA, 601 bp, Human
cctccaacgccgaacactcttcgccatcttcaaggagaacaaacgcccgtcaaaggagatgcagatcaccatttcccagcagctgggcctggagctcacaaccgtcagcaacttcttcatgaacgcccggcgccgcagcctggagaagtggcaagacgatctgagcacagggggctcctcgtccacctccagcacgtgtaccaaagcatgatggaaggactctcacttgggcacaagtcacctccaaatgaggacaacagataccaaaagaaaacaaaggaaaaagacaccggattcctarctggggcccttcactggtgatttgaaagcacaattctcttgcaaagaaacttatattctagctgtaatcataggccaggtgttcttcttttgtttttaatggctatggagtccaagtgcaagctgaaaaattaatctcttagaaccagacactgttctctgagcatgctaagcatcccagaaacccaaatggggccttcctggagcgagttaattccagtatggtgtcaaccaagctcgggattgcttaaaatatcatccatcccacttcaggtcctgtcagcttcttgcagtcagagtt

SEQ ID NO: 31332 - DNA, 601 bp, Human
tggaagagttaaaaccttgtgagacagttactttttatttatttttgagacagggtcttgctctgccatgtcagctcactgcagccaacctcctgggttcaggtgatcctcccgccttagcctcctaagtagctggaactacaagcacaagccaccatgcctggctaattttctaatttcttgtagagataggagtgataagggtctcactaggttgcccaggttggtctcgaactcctggcctcaagcagtcctcccaccttggtctcccaaagtgctgggattacaagtgtgagccacsatgcctggcctgaccatcactttttatatcaaactaattactttcccatttgttttaaagtgtcaactgtcttgactctaatcttgagtatacccattttcatgtatgctcgtgtgccaactttttgtttggtttgttctaaatgagattattttcaaaggatcatatcttggctttatttagttatacaaaagaagattgacaaaagtaccttgtgtgctttgtaacctttctgggtaactccttaaatgaacatacaagggtgcttgtttggccctgaattcagatttaatttgttag

SEQ ID NO: 31333 - DNA, 601 bp, Human
atctgttcaagaactactttgatggggaaggaaaagtgcggatgatcgtgtgtgtgaaccccaaggctgaagattatgaagaaaacttggtaattttaatgtatttgtcctataaagtcttgagtttttgtcgggaaaacagttacttggatgagcagaatgacattttgaatattttaaaaatggatagagaaccattgattgtagaagtaaactaggcttggtgtggtggcttatgcttataatcccaacatgttgggaagctgaggtgggacgatcaattgggcccacctgggaggtygaagctgcagtgagtcgtgttcatgccactgcactccagcctggtgacagactgtctcaaataaataaaaataagcaatctttgcttcatttagtaatttctgggacttggatatccttatttttttttaaactccatttgttttgtgttttagcaagtcatgagatttgcggaagtgactcaagaagttgaagtagcaagacctgtagacaaggcaatatgtggtttaacgcctgggaggagatacagaaaccagcctcgaggtccagttggaaatggtatgatttggtgttgtatcat

SEQ ID NO: 31334 - DNA, 601 bp, Human
agtaaactaggcttggtgtggtggcttatgcttataatcccaacatgttgggaagctgaggtgggacgatcaattgggcccacctgggaggtcgaagctgcagtgagtcgtgttcatgccactgcactccagcctggtgacagactgtctcaaataaataaaaataagcaatctttgcttcatttagtaatttctgggacttggatatccttatttttttttaaactccatttgttttgtgttttagcaagtcatgagatttgcggaagtgactcaagaagttgaagtagcaagacctgtmgacaaggcaatatgtggtttaacgcctgggaggagatacagaaaccagcctcgaggtccagttggaaatggtatgatttggtgttgtatcatttgtccactcattggtctgtctgtttctctcttttttaaaaaaaattatttcatttaagagaaatgtttacataccttctgaagaaccaagcacataataatttgaacaaaatttaaatgagcttattttgcatactatgattcttaggtaagtaaacttatgtcagctcaagaaattgcaatggttagttgcactggggctgtatgc

SEQ ID NO: 31335 - DNA, 601 bp, Human
ctctcttttttaaaaaaaattatttcatttaagagaaatgtttacataccttctgaagaaccaagcacataataatttgaacaaaatttaaatgagcttattttgcatactatgattcttaggtaagtaaacttatgtcagctcaagaaattgcaatggttagttgcactggggctgtatgcagtgttaaacttgtttaaataagctctttctctcctatgtaactttttgtaattttctataattcaatacagaaccattggttactgacgtggttttgcagagttttccacctttgccrtcatgcgaaattttggatatcaacgatgagcagacacttccaaggctgattgaagccttagagaaacgacataacttacgacaaatgatgattgatgagtttaacaaacaatgtaagggcaaaactatttgaaataattttatttaattattttttttttttgagacatagtttcactctgtaccccagggtggagtgcagtggcacaatctcggttcactgcaacctccgcctcctgggttcaagcgattctcctgccttagtctcccgagtagctgggactacaggcacatgccacca

SEQ ID NO: 31336 - DNA, 601 bp, Human
ataaatgattaaatgaaatggtataaaagtgccagcatcgggccttggacgtaacagatactcagtaaagcttaattggatctgtatttggtttacaaatcgattgtaaaagtataaactcaggattaatctcttacaatggggtagaaggaaataccgttttgttgggaagcattgcagcactgtgtaatgtatgtctgttctctcatttacagagggtcatttagaggtttggtgggggtacacattcataagagaagttagtctcaaccaatatagtttttttaaattctgaaaatagcctaaaaactaaattttagcccttaattttaggagaaagtaattttcacatgaagttagttgtaaatgtctttgggtgaggagcttgtttaacatgttttcatttctgagaatgggggtgggaattcagatgaaatgttagagaaaaaagtgctttctccatgatgtttctttccacaaatatgcttgcataagcaaattaaggaagactattttatagcgacatgaaatgtttatataccaaatattgaacatagtggtctaccttcctagattgagattttagagaaaacaactacta

SEQ ID NO: 31337 - DNA, 601 bp, Human
ttggtcattttcttagctgctcattttggaggaacagaatagcctgtgaaatgtatcattaattctccaaagggatgtagatagtattcccctacttctaatatttttcctcttcttagatggaaaaataattgttgcatcatgtttcccctttttcagtagtcgaaaacgaagatcttccacagtagcacctgcccaaccagatggtgcagagtctgaatggaccgatgtagaaacaagggtaggggaaaaattaaatatttgtctgcctactaaaattaggtttgtcatgttttaaacyccacagctctagatttttatgctctttgaaaatgctgaggtataatctcacattgccagtgcaccatgtaggcctattcctagaataacaagaatccacttcatcaggaactcccttgcaagtgttattcctgaggagaatctcttggaaagaacatgggaaggtaggggtcaggaggctaagctatggccttagccaccaactctctttgcaaacttatctaaaatgagataagttacctggatgacctaaagacctttctggctcacaacatttgtggcctgtgccagaaataaatta

SEQ ID NO: 31338 - DNA, 601 bp, Human
attggtggctcatgttcatattctgccaacgctcataaagctttctgaggctgaactgagagtacctctaaggagggaaggctaaaggcttaagttggagactagacagctttgtgtaaatcattgtttcctgacttgcttcttggtcttggtgtagcaataggtgttcactaaaataaataacactgaatgaaagaatttatagtagggaaggaatcataccttttcttcttctgttaaacttatactcaggagtctgacccagtctttttccatattttaataaaatcccttctttacraatacatacatatatgtatatcacatgttacatacatatatgtatataaaatgttatatgtatataacattttaaacatttacataccttactgagcaatttagaaaattgttgcagcaggataaagatgggaaatcctttctaaatttaatactaagataagcatattttataaaagttgtttgctttctcagagggacttgaattatctcatcataaaacagcagttctcaaaggcctcctaaagattgatttgctatgaatgtgttactaattgcaaagttcaactctaagtgctgg

SEQ ID NO: 31339 - DNA, 601 bp, Human
ctcataaagctttctgaggctgaactgagagtacctctaaggagggaaggctaaaggcttaagttggagactagacagctttgtgtaaatcattgtttcctgacttgcttcttggtcttggtgtagcaataggtgttcactaaaataaataacactgaatgaaagaatttatagtagggaaggaatcataccttttcttcttctgttaaacttatactcaggagtctgacccagtctttttccatattttaataaaatcccttctttacaaatacatacatatatgtatatcacatgttayatacatatatgtatataaaatgttatatgtatataacattttaaacatttacataccttactgagcaatttagaaaattgttgcagcaggataaagatgggaaatcctttctaaatttaatactaagataagcatattttataaaagttgtttgctttctcagagggacttgaattatctcatcataaaacagcagttctcaaaggcctcctaaagattgatttgctatgaatgtgttactaattgcaaagttcaactctaagtgctggttgttatgttttaggcgcaaaaagccatgaa

SEQ ID NO: 31340 - DNA, 601 bp, Human
tcacggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttctwaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaatacatagttgtgtgatggctgttcattcaacacgtcctcccagcacctggcacagtgccctgcatttacctggcactcattgtttgcgggatgaatt

SEQ ID NO: 31341 - DNA, 601 bp, Human
gaatatgaatgatacacaaggaaataaaatagggtgcttcctattttaggcaggctggaaggaagaggaggagccagccatactgagattcaggagattcaaggggagaaatgcccttttttttttttttttttttttttttgagagggagtcttcctctgttgcccaggctggagtgcagtggcacgatcttggctcactgcaacctccaccgccccgattcaagccattcttctgcctcagcctcccgagtagctgggatcacaggcgccagccaccatgcccagctaatttttggtakttttagtagaagcgggcgtttcaccatattggccacatatcggccaggctggtcttgaactcctgacctcaagtgatccacctgcatcggcctcccaaagtgctgggattacaggcgtgagccaccgcgcccgcacggagaaatgctcttggtaggggaaataacttgtgcaaaggcgccgccgccgtggtgagatccagcttggcgtgttaggggaaatgggcaccctcgttcctggaaaacggtaggcctgtgggtgaccagcttccctatctgtcttcccacagtgcggctgggatc

SEQ ID NO: 31342 - DNA, 601 bp, Human
gccaggctggtcttgaactcctgacctcaagtgatccacctgcatcggcctcccaaagtgctgggattacaggcgtgagccaccgcgcccgcacggagaaatgctcttggtaggggaaataacttgtgcaaaggcgccgccgccgtggtgagatccagcttggcgtgttaggggaaatgggcaccctcgttcctggaaaacggtaggcctgtgggtgaccagcttccctatctgtcttcccacagtgcggctgggatccggcggccacctgcacctgcgtatctctcgggccgcccttccygaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgc

SEQ ID NO: 31343 - DNA, 601 bp, Human
cccgcacggagaaatgctcttggtaggggaaataacttgtgcaaaggcgccgccgccgtggtgagatccagcttggcgtgttaggggaaatgggcaccctcgttcctggaaaacggtaggcctgtgggtgaccagcttccctatctgtcttcccacagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgacckctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgc

SEQ ID NO: 31344 - DNA, 601 bp, Human
aagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcggrggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttccctgtggtgtccaggataagggaaggtgaccttgagaagatcctcctctccctgacctcagtttctctaggagacctgggagggggtaagtgg

SEQ ID NO: 31345 - DNA, 601 bp, Human
cctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggasgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttccctgtggtgtccaggataagggaaggtgaccttgagaagatcctcctctccctgacctcagtttctctaggagacctgggagggggtaagtggaaag

SEQ ID NO: 31346 - DNA, 601 bp, Human
cgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgsgctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttccctgtggtgtccaggataagggaaggtgaccttgagaagatcctcctctccctgacctcagtttctctaggagacctgggagggggtaagtggaaaggctcaaggaatgagtggcaaggtgttctcgg

SEQ ID NO: 31347 - DNA, 601 bp, Human
agttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgyatttatataagtctgttatttattattaatttattggggtgaccttcttggggactcgggggctggtctgatggaactgtgtatttatttaaaactctggtgataaaaataaagctgtctgaactgttccctgtggtgtccaggataagggaaggtgaccttgagaagatcctcctctccctgacctcagtttctctaggagacctgggagggggtaagtggaaaggctcaaggaatgagtggcaaggtgttctcggagatgccaagccattggaaggtgcttacgacacctgtgggctc

SEQ ID NO: 31348 - DNA, 601 bp, Human
gccacacagctatgcctagtttccagaaactctaagcaaaagaaagaaccagaacaaaaaccagtggctctcagacatccccaaggtccccgcttcttcgtttctctccatccctttgtgcacttcccctccccacccttttagctcctcacacatcttccctcacagaagtctccctgaagagattaaaaccccacaggtaaagaagagcgaccgggacagcgctgaagggcaccaccttgggctttcgaggcccaacacctcctcagcccccaacatgctccactctctcaaaaaaaaacaacccgcgaaaacgtggtaactatgaataattcattcactcgcctcccactgggagtccacaatggcctaatgcacgtttcaagctcttggtttctatcaaacggctcgctcaaggtgggtaaccaatggaaacgcataatctatccccggcggatgtcctggaggccacggagggaaggcggcccgagctgcttcctccccgcctcgcccttccctcttggccctttacccaaaagaagtctgaattggatgcggtcttggcgtcccgtggctgaggtggcgaggtggaagatcagcc

SEQ ID NO: 31349 - DNA, 601 bp, Human
cccagctaatgttatttttagtagagacaggtctcactatattgcccaggctggtctcagacgatccgcccgcctccgcctcccaaagtgctgggattaaggtgtgagtcaccgtacgcgacacaaactatttggaaccagcagggcacctttatgaaaggtgaaacagtagctcttgtaaccttccgaacactaacagtaccccgccccgccacacagctatgcctagtttccagaaactctaagcaaaagaaagaaccagaacaaaaaccagtggctctcagacatccccaaggtcccygcttcttcgtttctctccatccctttgtgcacttcccctccccacccttttagctcctcacacatcttccctcacagaagtctccctgaagagattaaaaccccacaggtaaagaagagcgaccgggacagcgctgaagggcaccaccttgggctttcgaggcccaacacctcctcagcccccaacatgctccactctctcaaaaaaaaacaacccgcgaaaacgtggtaactatgaataattcattcactcgcctcccactgggagtccacaatggcctaatgcacgtttcaagctctt

SEQ ID NO: 31350 - DNA, 601 bp, Human
cttcctagcttgctgaatatctccttttccttcagtatctacagagtctatttcaaaaagctgttttgttagaatcctctccagtttcttgtaattcttgtcatctgacagaccactgaagccgataacttgctgttctacactttttacttccttttggatttcctgaagcctactaatagaaggatgttggtttcccatatccatacttttgttgtgttcagtttcacaagcactaaaagacgacaagaatgataacttactacagcacaaggcttctgcagaacactaatggtatatkaagtcattctaaaattctcattttaaaaaggtatacttctgagcagtcatcccacctcagcctccccagtagctgggtctacagtcgtacaccactacgcccagctaatgttatttttagtagagacaggtctcactatattgcccaggctggtctcagacgatccgcccgcctccgcctcccaaagtgctgggattaaggtgtgagtcaccgtacgcgacacaaactatttggaaccagcagggcacctttatgaaaggtgaaacagtagctcttgtaaccttccgaacactaacagta

SEQ ID NO: 31351 - DNA, 601 bp, Human
aactctttgagaagacgttctgtctcctgtgctgcccgcttcctagcttgctgaatatctccttttccttcagtatctacagagtctatttcaaaaagctgttttgttagaatcctctccagtttcttgtaattcttgtcatctgacagaccactgaagccgataacttgctgttctacactttttacttccttttggatttcctgaagcctactaatagaaggatgttggtttcccatatccatacttttgttgtgttcagtttcacaagcactaaaagacgacaagaatgataacttaytacagcacaaggcttctgcagaacactaatggtatattaagtcattctaaaattctcattttaaaaaggtatacttctgagcagtcatcccacctcagcctccccagtagctgggtctacagtcgtacaccactacgcccagctaatgttatttttagtagagacaggtctcactatattgcccaggctggtctcagacgatccgcccgcctccgcctcccaaagtgctgggattaaggtgtgagtcaccgtacgcgacacaaactatttggaaccagcagggcacctttatgaaaggtg

SEQ ID NO: 31352 - DNA, 601 bp, Human
ttttccaactaaaaatgtttacaaaagaacagactgtctgaacaaacaaaaaaaccccaccccgttaagctgggtaggaccaatcaggccttataagtgaaaaaaaagccttctatcgagcataatgaaacagaacatgtactgcttgtgtttgaaccttactcttatttaaccaaaaatttcccctttctcataattttcctagtattatgtaaggttatgcctagttctagattctgaaagacctgcattttaatgcttgcacaacccatttaaaatctacaaaagctgcctctatttygttttctgattaaaaacgcaaaaaaaaggacaaaccaaacaaaccacaccacatcatacagataatgatccgaatggaaaagttaacgtgctgtaatgatatttgtcttgcaacatcaaaagcagcagatactgaatagaatttgcttcaatcataaatactgagactgaaatatgcacgtataaatcaatgaactgaaagctctctatacatagaagcacatatgaagtgcaaaacagtatcaaaagtgagatctctggtatttcagtactcccattcatcagatttcaggtcgagata

SEQ ID NO: 31353 - DNA, 601 bp, Human
ttggtcctggagcaggtgtagttatgacatttactaagtgagtggttaacagctgactgcctagaaaacctaggaaggcctggtccctctgggttactgacagcgtctaccctcacgttgtaaaacagcaccggggaggtgtgacaaggctgtccattttacagccttggacaacagaagagaaccattatgtgctacattcagactttctgatttagttttagtataacctgacattggtaacccgtctccagtattcatcctccaactacaggtatgagtgtttcctttttttttttttaaaggcccattaacttaatttaaatgttcccatccttatgaatttactcactaaggaaaactataagctcagattttacaaacaaaagcaacttacaaggtattattgctggtcctttatcccttctctttaatgcaatctcaaaggttttttggctattagttttcataattttcttatgttgcacacaaaaacaagattcctctctaaaacgtagaggatggggaaaatgcagatgctgtttttccaactaaaaatgtttacaaaagaacagactgtctgaacaaacaaaaaaacccc

SEQ ID NO: 31354 - DNA, 601 bp, Human
ggcagcccgtggagccccgtgggaagtgaggatgtttaccttccctgtacctggagtgggctacgacagcttcctgtttgccgagacttgggtttagtgacttagaaataaaagtgtgtctcagcagatgcttattagcttctaatgactgttgggaatttaatggcatttgtatttccaggtttgagaggttatttgtccatgggatgctcgtgttaaaacaaaaatcttcattgcaaagcttaagtaaaaacaagtctcgaccgaggtaacgttagaacaccgggttctgaggttcacygtagctgccattcatttgctgtcagtctgggcaagtcatttaacttctgagactgggttctctcacctgttaaatgagccagatgcatcttcatctgtctagctcagctgtaggattccccctgtgtcattcagtctgtgtgtgtgttctcaaattgtggcaggttatttttccccatgcctcagctatttgtcagactgggtaattcaccaaatattcctgtaggaaggatgttaggatctaagtataaaagtgaagtgatttatccttcataggtcactcttaggaggtgtcctgcca

SEQ ID NO: 31355 - DNA, 601 bp, Human
tatttgcctccattatgttccatctgtttccagatccttcatgatgagagatttggggacacttctctctcctgtgtgtagttgatagtttggtggtgaagagatggctgacagtgtcaaaacctttctccaggaccttgccagagtgagtacatcttgtttataggaattcatctctcggccttttttttttttgctgaaggaaccatctaggaaatcctttagggtttttggaacttttatcatatttcttgggttctttacataaaggttgttattctagaccacactactcaagaartaggtattgttctacatcttgcagacagtcttgcaggtgcttggaagacctcttcggtggatgtctccagtattgggaccctaatcatcttggcttcagagctttttttttttttttttttaactttttattttggaatgtgtttagatttacagaaaagttataaggtagtacagagagttcctgtatgtccttcatcagcttcccttaatgttaacatataaccgtggtatatttgtcaactaagaaatgaacattggttcagtactatcacctaaactaattaattcagatttaaat

SEQ ID NO: 31356 - DNA, 601 bp, Human
acctttctccaggaccttgccagagtgagtacatcttgtttataggaattcatctctcggccttttttttttttgctgaaggaaccatctaggaaatcctttagggtttttggaacttttatcatatttcttgggttctttacataaaggttgttattctagaccacactactcaagaaataggtattgttctacatcttgcagacagtcttgcaggtgcttggaagacctcttcggtggatgtctccagtattgggaccctaatcatcttggcttcagagctttttttttttttttttttaactttttattttggaatgtgtttagatttacagaaaagttataaggtagtacagagagttcctgtatgtccttcatcagcttcccttaatgttaacatataaccgtggtatatttgtcaactaagaaatgaacattggttcagtactatcacctaaactaattaattcagatttaaattagagaacctatcttttttttttcccaatttttcatttatttaaaaatttttctgttaaaagtagagacgaagttttggcatgttgcccaggctggtctcaaactcctgggctcaagtgat

SEQ ID NO: 31357 - DNA, 601 bp, Human
ctgtgcacgtgaggaggatactctaggaaaatgccctataaagatctggttaggacccagtcatccaaattaccaatagcacaaaagtctgctacttttaatgtatgtctgaagcctaataatgtctcacttgtaaccccctcttatatttccactagcatgaaagaggccaattcttggagtggggaggttctttctttagtggaagagtttaaaaggttacctttatggccaggggaggtggctcacagctgtaatctcagcactttgggagaccaaggaggcaggattgcttgagtcygggagtatgaagcagtagtgaactatgatggtaccagtgcactatagcagggcaagaaagtaaaaaggttattacttttgagtaaaagagggaggattgaaagagtatcttagaaggtctaaaaagactttatgcatatgatctccttttttttttttttttttttttgacagagtctcactgtgtcgcccaggctggagggcagtggtgcaatctcggctcactgcaacctccacttcttgggttccagtgattctcctgcctcaacctcccaggtagctgggattacaagcacacacc

SEQ ID NO: 31358 - DNA, 601 bp, Human
tctggttaggacccagtcatccaaattaccaatagcacaaaagtctgctacttttaatgtatgtctgaagcctaataatgtctcacttgtaaccccctcttatatttccactagcatgaaagaggccaattcttggagtggggaggttctttctttagtggaagagtttaaaaggttacctttatggccaggggaggtggctcacagctgtaatctcagcactttgggagaccaaggaggcaggattgcttgagtctgggagtatgaagcagtagtgaactatgatggtaccagtgcactmtagcagggcaagaaagtaaaaaggttattacttttgagtaaaagagggaggattgaaagagtatcttagaaggtctaaaaagactttatgcatatgatctccttttttttttttttttttttttgacagagtctcactgtgtcgcccaggctggagggcagtggtgcaatctcggctcactgcaacctccacttcttgggttccagtgattctcctgcctcaacctcccaggtagctgggattacaagcacacaccaccacgcctggctaatttttatatttttagtagagacggagttt

SEQ ID NO: 31359 - DNA, 601 bp, Human
tggagtttcctgagttaaaagcaaaattaagagtaaaaattactcagacaaaaaaagatcaaaggcacactgtgccaatttatgttcctgttaacagataatacatcaacttgcccatttctctgtattccagctattatttctaaaattcgttttgtctgataacagtagacgagaatgctatccattcttaaatccagcttggccattgcttccagaataattttttctgccttctcatgaagttgaatgccccagtgctaacactctacttgggccatacatctgttgtggcacttaytaaactatgtgtgcttgcttctgcagcacatgtactaaaattggaacaatacagagattaccatggctcctgtgcatgacacacaaattcatgaaatgtttcatatttaaaaacttttttaaaaaaaaacctttaatgtaattttttggtttacttgtgtgcttttcctactaagttataagcttcttgagcatttctatatgacaatatatagcttattgaagatactcagtacgtgggtgggagatggatgcatgagtgaattcttagcctttgggaggcttaggcaggaggattgct

SEQ ID NO: 31360 - DNA, 601 bp, Human
caggagtctgtgcatctgcagagattttattcccactcaggaaagcacacttatatgtaagcaaacgtcacagccctgaatatacacttgaattttgtttctaaaatgactcattcacaagtattagaggtagcagtttctcttgacactgtctagacattttaaaatgctaacagcaactatggggactcgggaagggcagatacggctagacaagaacaaggttctccctgcttctgcttatagtgatcaacaagagttaatttgcattgaaacctatagcagaaaagattgcctaccrtttactgagaatcccagtgcaggcttaactgaaatttgggtactttgaagaatggataaatatttcctttgacttagaatttagagtaattcatcacttcttaatctaaacaattcacagatgttttcagatgttagttttaaatttaattaatatgtattcctgtgtacttagtacatgcctgtattttggcctgaatactacttgaaatgttcctgtatgcccccaaaagtttcattgttttataggcaatatcaagtttgtatctctcaattggagtgttgggaaatagaaatggat

SEQ ID NO: 31361 - DNA, 601 bp, Human
aataagccttttcttaactggcagctctagtggcggactagtggccttagctttggggatgtatatcaaggccatttaattcatgttttggtacactttctctgttacaggatatagctgacctggcatttgaggtatcagggaggaagcctcacccattccctagtgtcagcaaaataattgctgacatgctcttcaaccttttgctgcaggctcttttcctcattcaggtgagactgaccttctgggcatatgggcagctttattaaaaagaaaaactgtttcactagagagaacttcmcaaagacagagtattatatttatacagagtattatatatatgctggtgggaggtaatgatttttaaatctttttttccccacggaaatgagaattttaaaattacattataaaattataagaaacatgaatttacctgcttttttctgctactctggttattctccagtcctgccaggtggaaactttttttctttttatagttatgcctaatttttttttttttttaaagagacagacgggtcggctgggcgcagtagttcatgcctgtgatcccagcactttgggaggccgaggtggg

SEQ ID NO: 31362 - DNA, 601 bp, Human
ctcacacctgtaatcccaacactttgggaggccaaggtgggtggatcgcctgaggtcaggagttcaagaccagcttggccaatatggtgaaaccctgtctctactaaaaatacaaaaattagctgggcgaggtggcaggcgcctgtaatcccagctacttgggaggctgaggtgggagaatcgcttgaaaccaggaggtggaggttgcagtgagctgagattgcaccaccgcactcccgcctgggcatcaaagcaagactccatctcaaataataataataataataataataataataaaaaaatctgtacctaaaactcatggtttgtctaccatagttacttagtcacttgactaaaaggaaatataatatctaattgtattggctttcttgttttaggaattgaaatgcaccagcggttgtctaacatagaaaggaattggccttactactttgggtttggtttgcccttggcttttctcacagcaatgcagtcctcatatattatcaggtaatttggctacagggatttgaaggagactagtaaaaataaaaattcatgaagtcagtgccttttgtttgcttcgttctgtttcgca

SEQ ID NO: 31363 - DNA, 601 bp, Human
aacacaggaggcggaggttgcggtgagttgagatcttgccactgtactccagcctgggcgacaagaacgcgactccatctcaaaaaaaaaaatgtttgaaatattgaggtttcatcaagccataatgtttacactggaagcaaaagaacttggagcttctaatatcttcttcaaagtcatgtctgttatgaaggtgactaattatttcttttttttttttttaaacagtggctgccttttctctatcctctttcctttattcattatcagcgccaatgaagcaaagacccctggcaaagcrtagtaagtattagccagtgatgaaatttttgctgtgtaaagggttggggctgtaacaccagttatgtcagtgaggctttttaaaaaaaaaaattcttactgtaggaaaatcttaatataaggtttaatgagagagaaacacttctgggatataacccaaacttttctccatgcatatatgcacatgagtatatatatatttccaaaaccgatcccattatacatattcaagtagagggctgtatgacctggccacatgagtttattgataacagtagtaaaatatactttaaaatgagtt

SEQ ID NO: 31364 - DNA, 601 bp, Human
tgggatataacccaaacttttctccatgcatatatgcacatgagtatatatatatttccaaaaccgatcccattatacatattcaagtagagggctgtatgacctggccacatgagtttattgataacagtagtaaaatatactttaaaatgagtttttagcaataataatagcattctaaaagttttattacttcaaagaaaagctcaattcatctttgatcaattttggttaagtcagtgtggatacttgtattagagacttaggtctgctttgggtttttgtatgctcttgctatacrgcacagctcactgtttatcttaagaggaatatttgactttcttttgaaactcttcttcctgcaaccacagatagcatatgataccttcagacatagcttgaagtctgtaccccgaagtcagccatagaaaagtacttctcaaatcaaagttaatctaaaatataactatttcctgtaagagccacaatacttcaacgctggtgactgcattacattcatggcagcagcagggcccaatgcattctttttttttttgagacggagtctcgctctgtcacccaagctggagtgcagtggcgt

SEQ ID NO: 31365 - DNA, 601 bp, Human
tccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgcyatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaagcctgaagagatgagataggaggaaagacctcacagc

SEQ ID NO: 31366 - DNA, 601 bp, Human
ctaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaactgagcttgctgtttgcatgattaaaatagctctgttctcaaatctcttc

SEQ ID NO: 31367 - DNA, 601 bp, Human
cactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaackttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaactgagcttgctgtttgcatgattaaaatagctctgttctcaaatctct

SEQ ID NO: 31368 - DNA, 601 bp, Human
acactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaastttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaactgagcttgctgtttgcatgattaaaatagctctgttctcaaatctc

SEQ ID NO: 31369 - DNA, 601 bp, Human
aacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccawctttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaactgagcttgctgtttgcatgattaaaatagctctgttctcaaatct

SEQ ID NO: 31370 - DNA, 601 bp, Human
tgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacrtatttatatatttcaatttaaggaatctttttgccatgtgtatgcaaatattattttcttcatacattcattttcttttcaggggaaaattttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgat

SEQ ID NO: 31371 - DNA, 601 bp, Human
tattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacytgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaat

SEQ ID NO: 31372 - DNA, 601 bp, Human
atttgtttactaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcrttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcaga

SEQ ID NO: 31373 - DNA, 601 bp, Human
actttgaaataaattacatgatttttacaatttcaaaatcaattgcatatcatggcactattggaggtaagtctgttatttcccatgtgcactcatttggatgtttaaattctgatatgttggggaaaaaaaaaagcctataatgacttcatgaagcaaataattttaggaatttagaagagggaagttctcaggatggattggttagggtaagagttaggtagagaaatcgagatttgaagactggggaagatgtagggcgagtttatttggattgcattggaggcagagagtaactccrtttggccgatgggggaaaatggtcaagggagggaagagaataatgttggtaaattggataaaggttatagaggggcatgaatacctgtttggagatttatcctggaggcactgagaactactaaagagcaatccaagcaatgtgctggaggattaacctgctagtgataataaaggattagatagaaagggctctgcctctcttgcctctgaggaagctgttttaatatctaagtgacaagaacttgaatttggatgagggcaatgaacaattaaaggatggatttggggaattctttaa

SEQ ID NO: 31374 - DNA, 601 bp, Human
ttttttaggtatattaacccatatagtccttacacattccttgtgaatactattgttattccccatttcacagatgaagaacttaaacaatgagtaagtgatttttccaaggtcacacaaccagtaagtggttgagatctgaagccaggtattctgactctagaacagtagttctcgtctaggggcaacttcacctcacaatgaatgtttggtgttgtctggagatatttttggctgttacatttggagagtactactggtatctagtgggtagaggccagggttgctgctaaacatcctrcaaaggataggaccctccccacaacaaagaattattcagcccaaaatatcagtactactgaggatgaaccctggtctttgttattttgcatctcatgaggatgtgaagcattagtgtcaactctatagtgcttagtcctacctgttatgtgactatatttaatcatctttagaattaagtagaaattccttttctttcaggtgaatcaattccaataaggctatttttagcaggatatgacccaactccaacaatgagagatgtgaacaaaaaattttcagtaaggtactttttgaattt

SEQ ID NO: 31375 - DNA, 601 bp, Human
ctatcccaaaaaatacaaaacttagccaggcatgatagtgcacgcctgtagtcccaactactctggaggcttaggtgggaagattgcttgagttcaggagtttgagaccagcctgggcaatatattgagaacccatctctacaaaaattgaaaataaaaaaacaggcatggtggtgcacacgtgtaatctcagctacttgggaggctgaggcagaaggattgcttaagcccaggaggttgaggctgcggcaagccatgattggaccactgcactctagcttgggtgatggagcgagacacygtctctaaaaaaaaataatgtagtggaaaaataagaaggcataaggctagtaattatattctggaatatttaaattaatgttatttacattattgcactaggacccagtaccacaacagaaacagaaacaatcgccaaatatgaaataatggatggtgcaccagtaaaaggtaacacacttttcagttacttcttttgtatagtgcaaacatcagtgttcatggcagttttgtttgtatttatttagtgtgaaagtatctttgaattcttaaaccattcttacaatgatagcttttaagg

SEQ ID NO: 31376 - DNA, 601 bp, Human
aatgtggccaggtgcggtcgctcacctgtaatcccactactttgggaggctgaagcgggcagatcacttgaacccaaggaattcaagaccagcctgggcatcatggtgaaaccccatctctatcccaaaaaatacaaaacttagccaggcatgatagtgcacgcctgtagtcccaactactctggaggcttaggtgggaagattgcttgagttcaggagtttgagaccagcctgggcaatatattgagaacccatctctacaaaaattgaaaataaaaaaacaggcatggtggtgcacacrtgtaatctcagctacttgggaggctgaggcagaaggattgcttaagcccaggaggttgaggctgcggcaagccatgattggaccactgcactctagcttgggtgatggagcgagacaccgtctctaaaaaaaaataatgtagtggaaaaataagaaggcataaggctagtaattatattctggaatatttaaattaatgttatttacattattgcactaggacccagtaccacaacagaaacagaaacaatcgccaaatatgaaataatggatggtgcaccagtaaaaggtaacacactt

SEQ ID NO: 31377 - DNA, 601 bp, Human
ttttatgccatggttagaaaggtctttttcacactgaagttctaaaaataatttcctgtgcttgattctactgaagtaatacattgtggtttagggattttgtttcatttttaaaatattaattcatttgaaatgtgttgtgatgtaagaggtgaggtatgtatcacctttacttttttccagatggctgaccagttgtcctgatatcttttattgtttcatccctgctttttgattttaatatataaatatataaacttactttctcctctaatattgttgggtgtttttttttttttgsagacggcgtctccctctgtttccaggctggagtgcagtggcgtgatctcggctcactgcaacctctgcctccagggttcaagcaattctcctgcctcagcctcctgagtagctgggattataggcacacgccaacatgcctggctaatttttgtatttttagtagagacggggtttcaccgtgttgcctaggctggtctcgaactcctgagctcaggcagtctgcctgccttggcctctcaaagtgctgggattacaggcgtgagccactgtgcctggcctcatcgtcgggttttttgct

SEQ ID NO: 31378 - DNA, 601 bp, Human
ggttttatgccatggttagaaaggtctttttcacactgaagttctaaaaataatttcctgtgcttgattctactgaagtaatacattgtggtttagggattttgtttcatttttaaaatattaattcatttgaaatgtgttgtgatgtaagaggtgaggtatgtatcacctttacttttttccagatggctgaccagttgtcctgatatcttttattgtttcatccctgctttttgattttaatatataaatatataaacttactttctcctctaatattgttgggtgtttttttttttttgcagacggcgtctccctctgtttccaggctggagtgcagtggcgtgatctcggctcactgcaacctctgcctccagggttcaagcaattctcctgcctcagcctcctgagtagctgggattataggcacacgccaacatgcctggctaatttttgtatttttagtagagacggggtttcaccgtgttgcctaggctggtctcgaactcctgagctcaggcagtctgcctgccttggcctctcaaagtgctgggattacaggcgtgagccactgtgcctggcctcatcgtcgggttttttg

SEQ ID NO: 31379 - DNA, 601 bp, Human
ttgtttgtggtggttcatgccatgtagaagttattgatgtttatgtagtcagatttatcagtttttcattttatggcctctgggttttatgccatggttagaaaggtctttttcacactgaagttctaaaaataatttcctgtgcttgattctactgaagtaatacattgtggtttagggattttgtttcatttttaaaatattaattcatttgaaatgtgttgtgatgtaagaggtgaggtatgtatcacctttacttttttccagatggctgaccagttgtcctgatatcttttattgkttcatccctgctttttgattttaatatataaatatataaacttactttctcctctaatattgttgggtgtttttttttttttgcagacggcgtctccctctgtttccaggctggagtgcagtggcgtgatctcggctcactgcaacctctgcctccagggttcaagcaattctcctgcctcagcctcctgagtagctgggattataggcacacgccaacatgcctggctaatttttgtatttttagtagagacggggtttcaccgtgttgcctaggctggtctcgaactcctgagctcag

SEQ ID NO: 31380 - DNA, 601 bp, Human
agagacagggtgtcactacgttgcccaggctggtttcaaactcctggactcagcgatcctcctgcctcagcatcccaaattgctgggtttacaggtgtgagccactgtgccctgaattcctttttctaatattaagggtagcaaaaatttccctcgtttgtcttgtttgtggtggttcatgccatgtagaagttattgatgtttatgtagtcagatttatcagtttttcattttatggcctctgggttttatgccatggttagaaaggtctttttcacactgaagttctaaaaataatttyctgtgcttgattctactgaagtaatacattgtggtttagggattttgtttcatttttaaaatattaattcatttgaaatgtgttgtgatgtaagaggtgaggtatgtatcacctttacttttttccagatggctgaccagttgtcctgatatcttttattgtttcatccctgctttttgattttaatatataaatatataaacttactttctcctctaatattgttgggtgtttttttttttttgcagacggcgtctccctctgtttccaggctggagtgcagtggcgtgatctcggctc

SEQ ID NO: 31381 - DNA, 601 bp, Human
tgtttcatttctgtaaaatactcatgtatttggatatgaatagaaaagagtctgcaatgatattctgttgttaacagtggttatctgtaaaggatgaaattatgtattgactttacatatctcttatttaaatgttatatgacaagcttgttttctgtgtctattcagaaaaaagttttaaaaagttatatatcattctaaatataactacaatactcttatatctaaaaatattagtaattccttaatatcttcatacacccagacagtattcacatttccctaattggctcacagatayctttcttttttcacatactttgttcaaatcaatatttaaactagggccacacattgcatttggttgtttgagccttaaattttttaatttataggtttcccttctattttttttattaaagtttgtttgttgaagaaatggatgtgccctgtattatccctttcataccccagtcttttgttacattatttttattggttgtcactcccaggtttatatcactgaatatgtaatacatatggacttcagaatcttaaaattatattgttgatgaaattatcaaatagtttaggacctgaa

SEQ ID NO: 31382 - DNA, 601 bp, Human
ttgcttcgatataatctgtgggaagctgtatcaatatcattttatacatggactaagatgttctcagaaacattacttacatgaacaaaagattgccatttaaatgcccactggtattataacagttaaataaattatggtccagccatactgtggaatgctaaagaagggttaaaaagattgaggccgggtgcggtggctcacacctgtaatcccagcactttgggaggccaaggtgggcagagtttgatcacctgaggtcaggagtttgagaccagcatggtcaacatggagaaactcygtctccactgaaaatacaaaaattagatgggtgtggcggtgcatgcctgtaatcccagctacttgggaggctgagggaggagaattgcttgaacctgggaggtaaaggttgcagtgtgctgagatcacgccactgcagtccagcctgggtgacagagggagactccatctcaaaaaaaaaaacaaaaaaaaaagattgagacatatgtatttagttctccagaagcgtgtccatgatatattaagtgaaaaatttagccataaaaacagcatgcatagtactgtttcatttctgtaaaat

SEQ ID NO: 31383 - DNA, 601 bp, Human
tcaattcagtgtcctttcccttcactaagtctgtatgcaggaagccagggatgcctcagagtccagggcatttcaggatattaatctgaatgcatcaggtccgagatcttgctttctctgtttaacttggcattatctatctggaactgggtttgacaacccaaatttcaaatagcagttccttaaagaagtgatctggagaggtttcttcaagtaggcttgatgacagccctccaaactcatctgtaaagtatttacactattcttaaaattgaactttgtattttttttcatgttgggrgcattaaagaaaattggaactccttcgtgaagtaatgaagtaagttgatcccaaaggagttccagcaaggaggagaagcctgagttgcagttaatgtttgctgatttaaaacatgaaaatttatcacaggtgatttaactcatcgactctcttttaactttgtaggtattttcttaaagtgacaatagtgagaagactgacagatttggtaaaagagtatgatcttattgttcaccagcttgccacctatcctgatgttaacaactctattaagatggaagtgggcattgaagattgtct

SEQ ID NO: 31384 - DNA, 601 bp, Human
tgaatttgtaggtcaaattggtgagttttaaaatagtattatttctttttctttgataactgaatttgaagagggttggattttgcaccaaaataattgaattagagcttagctttgtagaaggaaggaattgattttgcataataaaagagaggatttactttataactatattaaattgtgtttctttgacttgtatgaaatgatatttgatatatcatttcatgatatatatgaaactaccagccttgaaaactaattcaagtaaattagttgacctactgaaattttcatctgcctrcatttttcaccatccttcttataattagcagcctcaccttcattcttcattttctaattacccatgccatttgtcttcctgatctagtgtgtgcctgtagccagactcacttgtgtcaacacacaattccatgtgagaaggaaaggtgtagtttcttcttgacttagatcaacttatgtacatttccatacatgattccagatgaatgcttgatttagtagggagttaaactatataaatctttctatactgaagattcagaagagaaaagaaaatatgtctttataatactgtctacat

SEQ ID NO: 31385 - DNA, 601 bp, Human
tgtggtcctgcgtggtgaagccgaggctaaggtagctcagggcttagtgccattcccagtgcctgctgggaaggcccacaaatggggcagctattgagctgggctttgtgggatgagtaggagttctccaggtctagaaaggaggcaggagtagtataagcaaaagcattgcagcctggaggcaccaggtgggccaacaggatgaacatgacattggtgtcagattactgatctgcaaaatgagaataatatacctctgtggcaagctagtcacagacatgctcacatacatggctcaccrcctgaatggcctggggaagcatttgactgataacagattctggaaattaattcaggaggcttgggtggagtcctagattctttacttttcaaaagctccccaggtgataatgataatgactcaggaaacggctgtagatgagggctttagatcacagccagtctttgagggatgaagtaaatacagtagcgtctctggtgtgggtggcggtggggaattgattccaggaccgactgtggatgctcaagtccctgatagaaaatgacctgggtagtaattacatataacctcagcgcatcc

SEQ ID NO: 31386 - DNA, 601 bp, Human
cagagggggccagaagggccccagccatcctagatggagccacaagtaccagtgccaaggctcttggtctggaattctgaaaacatttacctctgaccctggcagcccactggccattgcttgtgtgcagcccagttggcagggaaccctatccatgatttgccgcctcttttctggtcccttcagtatgaacccagcatcacagtgcacttgtggcagatggcagtgcatacccgggagctactctcctccggccagatgcccttctcccagctgcccgccgtgtggcagctctaccccrggaggaagtaccgagcagcggattccagtttctgggaaatagcagaccatggccaggcaagtgtgtggtggttctaggtgaaagcgacaggtggcccctggtgactgccgtggccctctctcttctgtgcccctggcccccttggggttcttgtctgtcctcttcctgttgctcaagtcttccttcaaggaggcctgagtgtgtgtgggtggatcggtgcatgagttcccatgtgggatgcaggcagagtgggtgagggagggagggttgccttccctgggctagggaaatccataagct

SEQ ID NO: 31387 - DNA, 601 bp, Human
aaccctatccatgatttgccgcctcttttctggtcccttcagtatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccaggcaagtgtgtggtggttctaggtgaaagcgacaggtggcccctggtgactgccgtggccctctctcttctgtgcccctggcccccttkgggttcttgtctgtcctcttcctgttgctcaagtcttccttcaaggaggcctgagtgtgtgtgggtggatcggtgcatgagttcccatgtgggatgcaggcagagtgggtgagggagggagggttgccttccctgggctagggaaatccataagctggagttcccacctgcctcacccctgcctgctgctgctgccagcctgcatgggcggccgttaaggccaactggaagagcatctcccagaggttctgatggctgctccctctcctgcagattgactctatggagcagctggtccta

SEQ ID NO: 31388 - DNA, 601 bp, Human
accccgggaggaagtaccgagcagcggattccagtttctgggaaatagcagaccatggccaggcaagtgtgtggtggttctaggtgaaagcgacaggtggcccctggtgactgccgtggccctctctcttctgtgcccctggcccccttggggttcttgtctgtcctcttcctgttgctcaagtcttccttcaaggaggcctgagtgtgtgtgggtggatcggtgcatgagttcccatgtgggatgcaggcagagtgggtgagggagggagggttgccttccctgggctagggaaatccayaagctggagttcccacctgcctcacccctgcctgctgctgctgccagcctgcatgggcggccgttaaggccaactggaagagcatctcccagaggttctgatggctgctccctctcctgcagattgactctatggagcagctggtcctaacatatcagccggagaggaaagactgacactgggagtggctggtatgttggggccctgtgcgtctcggtgtagggatcagacgaaagtgagaagacctctcctcttttcagaaagacggcgtggcctcctcctccctgctgtttgctgaga

SEQ ID NO: 31389 - DNA, 601 bp, Human
ggcctgagtgtgtgtgggtggatcggtgcatgagttcccatgtgggatgcaggcagagtgggtgagggagggagggttgccttccctgggctagggaaatccataagctggagttcccacctgcctcacccctgcctgctgctgctgccagcctgcatgggcggccgttaaggccaactggaagagcatctcccagaggttctgatggctgctccctctcctgcagattgactctatggagcagctggtcctaacatatcagccggagaggaaagactgacactgggagtggctggtatgwtggggccctgtgcgtctcggtgtagggatcagacgaaagtgagaagacctctcctcttttcagaaagacggcgtggcctcctcctccctgctgtttgctgagatttttcttacatagccacctgtcacctctgttccccagccccttggatgtgatggtacacagtgggtgggcccccataataagttcctaaagcatgggatctcatcgaataagactcatcatttaatccttgtgagaattttgtgaggtgtacgtgttaatgtcccatttcacgacgaaaagacaagactctgggga

SEQ ID NO: 31390 - DNA, 601 bp, Human
ctggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccartgctgagcaagcaatgtacaccagagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtccacttttgtgctgaattggagcctctctttgacctctttctagcatagaaatggcagcttctggtaccgaaatgttaaggtaacattttaatgatccatttcatatttttccacactgggaagg

SEQ ID NO: 31391 - DNA, 601 bp, Human
ttttgtttgacttgattcatcactttttaaggtaaatctgtttcactgaaatcagttaagctgctagagctcctttgtaaatatcatattatacttttcatttaatcttgatcttaaagaaagtacttttcgtaacagtaaggtagtaagttgattttttaaaaatataattctaggtgctgcaggcactattatgaatagatgagatgtttacacttagttaaaaatatcaagcacatggagtatttaaacaatattgaagaacagtggaagttaatgtaataggaaataagtctttgcratgaaaatgtatttgaggaaagaggggtaatggaaaaatgcctctcatcatctccattgtgttgttcgtttgatctccgcggagctgcctgcagtttttcacacagactgggctcctctcagtgcaggacactcatttctcttaacttcacctacacaactcctcccttactcagataatgcctgttcatcctttaagactcagtttaaatatttcttacttaaatgtctttcctctccctccatttggggttaaattcccttaagagtactcccacagcatgtgtgggcttctctcaca

SEQ ID NO: 31392 - DNA, 601 bp, Human
tgctatagaagtatttgttggtagtgattggtattttcatataccaatatcaaaatacttctatagaccgaggtttgtaaaggcccagtatctctgataaaatttaaaattctcttgggcattaatgataaaaggcttgactacatttgacacacgagtcaggaatgttccctttaatctgctaaatctggagcaacaaaggctagccaaagagttatgcgtacaaatagatatcaaatcatgtgacacaagaggataactagaatactgtatgtactgcctgatccgtaccataaattcyaaaagcatttgaccatcaggagataactcacgctgcctctgggacataaataataatgaagaagattatggagctgaaatatggaggtcaactaattatataagacatggcccagagataaaatgattccatttccagaataacactaacttctaattatcataacataaatatattgcatagcatctgtactgagggcatgaattcagagctacgaaagatatgatctaatatgctgaatagtcaactccatgattttgtttccttattatttattattccttacgcctagtatttact

SEQ ID NO: 31393 - DNA, 601 bp, Human
atgaaccaagttttatgaagcagtaaccattgccaactggaagtcagaaaacagtttctgaacagtgagttttgagtggggatttgagaaaagtgagtatgtatttgccaaagtgagaaggggaagagtattctatacaaagaaacagatttacaaaagcaaagagtggagtaaggcagggatgctgtgcatgattctggaagttcagcattgcctaaattatttgcatcatggtcattcaagattttaacacttattagaacaactttctggcagataacagtaaaataacttgagaaastggtgcttttttctgatttgcacaaaattaccatttgggttagcaaagaccctaatgaaagtttctggcatattctaaggatataaagaaatccagtatggtagaagcaaataatacatggtgagtaagaggcaggaaattaggttgaaacaaaaaatggggacatacagagctaaggtgtttgagttttatcctctcagttttagactggtgatgtgataagtttaattatttcaggaaagtaatcctactaattgtgaaggatgagatagagagagttgatagtggaggcaagggaga

SEQ ID NO: 31394 - DNA, 601 bp, Human
tactccagcctgggcaacagagtgagaccctgtctaaaaaaaaagaaagaaaaaataatcataaagatagaggtagctccatacgcaatatagtaccaaacctaacaaacatagattgaagtttaatgtaattaaaattgtgaactcaaaaaattgggagcacctttggagcactatacccaattgcctccagtactcatttgaattccttccaacctaactttcatttaagcctatttactgtcatgttttaagccacaaaaacagaaaactacttccttcactgacctctctttgcctmaaaatggagattgctagtcttatccaggccattgattaatactacatctcaactttcctcatagtgtctatttgtgatgaaatgtgttagtttaagaaggcaggaaatcctgagtaagaagaacaggtttattcttattttaaatatattaagatatgggccaggcatggtggctcacgcctaatcccagcactttgggaagcagaggcaggcagatcacctgaggtcaagagttcaagaccagcctggccaacatggtgaaaccccatatctactaaaatataaaaattagccaggcat

SEQ ID NO: 31395 - DNA, 601 bp, Human
agatatgggccaggcatggtggctcacgcctaatcccagcactttgggaagcagaggcaggcagatcacctgaggtcaagagttcaagaccagcctggccaacatggtgaaaccccatatctactaaaatataaaaattagccaggcatggtggtgggcgcctgtaatcccagctacttgggaggctgaggcaagagaatcactagaagctgggaagtggaggttgcagtgagccaagactgtgtcattgcactccagcatgggcaacaagagcaaaactccatctcaaaaaaaaaaaaawatatatatatatatgtataaagatatgacattctataattaataacctggctttttcattatcaggcaattccccagagtaatcagagtactttcggttctgaaatcatattactaacagatggggaagattatcaaataagcttatgctttggagaggtaaaacaaagtggcacagtcatccacaccattgctctggggccgtctgctgacgaagaactggagaccctgtcaaatatgacaggtaaacctttggcatatagtttgaataaaaaataaatttctagtctctcccattcca

SEQ ID NO: 31396 - DNA, 601 bp, Human
acacaatttcctcacctgtcaaatatacaaattagattagattacctaaaattactaaaacaagtagatataattcaaattttttatgattttctaattttatcattttgggtgtcaacttaacaactgtattgttggccaagtaattaaggagatcaaatacatgtcaacacaggaccaggtaccctgagtgatacaaagagtaaaaaacatagtctttaccctcaaaaataataagatctaatcagaatgaaaagttgaacctctactaaactatctgaaaaactccactccatgaaayagaagttcatgaaagagagtcatcagggtgaatgaaatacttggacggaacttcatgcagttgggcttggttggaccttaaagaatgagtacaatttgcatatatagggagaaggaggtacattttggagagagaaagaacaaaattatatgatcaaggtcaagaaagcaaaatttcacaatggaatattctaattaaaataagaaataggtggagagaagagagacagagagacctacgtaagtggaacacaaggtttttgtgaagagtagtagaacggattgataaggcctatttaaa

SEQ ID NO: 31397 - DNA, 601 bp, Human
actatctgaaaaactccactccatgaaacagaagttcatgaaagagagtcatcagggtgaatgaaatacttggacggaacttcatgcagttgggcttggttggaccttaaagaatgagtacaatttgcatatatagggagaaggaggtacattttggagagagaaagaacaaaattatatgatcaaggtcaagaaagcaaaatttcacaatggaatattctaattaaaataagaaataggtggagagaagagagacagagagacctacgtaagtggaacacaaggtttttgtgaagagtartagaacggattgataaggcctatttaaaaggaaactaaatgttaagcagaggatctgaattatttttaaaaatacactaaaagttattcaccacacacttgaaataccttcaatatttcatggaaaagttaaaaataaagtccttactccaaaaaaaatctggtgttttatttttcatcacatttcagaatgtgagaatatatttctacatgaatggtagatatcaaaaagcagtgtagaaagaaacatttatgttggcatcttcttttcctttcttgataaaataacagccaatatttc

SEQ ID NO: 31398 - DNA, 601 bp, Human
tggtgttttatttttcatcacatttcagaatgtgagaatatatttctacatgaatggtagatatcaaaaagcagtgtagaaagaaacatttatgttggcatcttcttttcctttcttgataaaataacagccaatatttcaaacatttattaatttaccatttattaaattgtagtgaacatgtttcatgcattatcatctatgattcttaccactagaatagtaggcactcaataaatatttgttgaatgatttgaataactgaatccctattttaacagataaaaaactagagataagraaacttaagtcggggtgcggtggctcatgcctgtaatcccagcactttgggaggccgaggtgggcgggtcacaaggtcaggagatcgagaccatcctggccaaaatggtgaaaccccttctctactgaaaaaaaaaaaaaaattaactgggcatggtggcgcatgcctgtaatcccagctactcgagaggctgaggcaggagaatcacttgaaccagggagtcagaggttgcagtgagctgagatggcaccactgcactccagcctggcgacagagcaagactctgtctcaaaaaagaaa

SEQ ID NO: 31399 - DNA, 601 bp, Human
atttctacatgaatggtagatatcaaaaagcagtgtagaaagaaacatttatgttggcatcttcttttcctttcttgataaaataacagccaatatttcaaacatttattaatttaccatttattaaattgtagtgaacatgtttcatgcattatcatctatgattcttaccactagaatagtaggcactcaataaatatttgttgaatgatttgaataactgaatccctattttaacagataaaaaactagagataaggaaacttaagtcggggtgcggtggctcatgcctgtaatcccrgcactttgggaggccgaggtgggcgggtcacaaggtcaggagatcgagaccatcctggccaaaatggtgaaaccccttctctactgaaaaaaaaaaaaaaattaactgggcatggtggcgcatgcctgtaatcccagctactcgagaggctgaggcaggagaatcacttgaaccagggagtcagaggttgcagtgagctgagatggcaccactgcactccagcctggcgacagagcaagactctgtctcaaaaaagaaaagaaaagaaaaaaaaaagaaaagatatcttaaataaatttc

SEQ ID NO: 31400 - DNA, 601 bp, Human
acatttattaatttaccatttattaaattgtagtgaacatgtttcatgcattatcatctatgattcttaccactagaatagtaggcactcaataaatatttgttgaatgatttgaataactgaatccctattttaacagataaaaaactagagataaggaaacttaagtcggggtgcggtggctcatgcctgtaatcccagcactttgggaggccgaggtgggcgggtcacaaggtcaggagatcgagaccatcctggccaaaatggtgaaaccccttctctactgaaaaaaaaaaaaaaattaactgggcatggtggcgcatgcctgtaatcccagctactcgagaggctgaggcaggagaatcacttgaaccagggagtcagaggttgcagtgagctgagatggcaccactgcactccagcctggcgacagagcaagactctgtctcaaaaaagaaaagaaaagaaaaaaaaaagaaaagatatcttaaataaatttctttttatgacacagctagcaagtagtaaaattagggtgctactcaaggtttgtctaggtccttaacacatatttacttttattttttattttcatattttt

SEQ ID NO: 31401 - DNA, 601 bp, Human
agcactttgggaggccgaggtgggcgggtcacaaggtcaggagatcgagaccatcctggccaaaatggtgaaaccccttctctactgaaaaaaaaaaaaaaattaactgggcatggtggcgcatgcctgtaatcccagctactcgagaggctgaggcaggagaatcacttgaaccagggagtcagaggttgcagtgagctgagatggcaccactgcactccagcctggcgacagagcaagactctgtctcaaaaaagaaaagaaaagaaaaaaaaaagaaaagatatcttaaataaatttmtttttatgacacagctagcaagtagtaaaattagggtgctactcaaggtttgtctaggtccttaacacatatttacttttattttttattttcatatttttaaatttttaatttttgtgggtacatagtaggtgtatatatttatagggtacatgagattttgatccaggcatgcaatgtgaaataatcacatcatggagaatggggtatccatcccctcaagcatttatcctttatgttacaaacaacccaactacactcctttagttatttttaaatgtataattaagttatttttga

SEQ ID NO: 31402 - DNA, 601 bp, Human
cttattcattctttctaactgtttttttgtgcccattaaccatccccaccttctcctacccagtcccccactacccttcccagcctctaggaaccattcttctactctgtatgtccatgagtttaattgttttgatttttagatcccacaaataagtgagaacttgcgatgtttgtctttctgcttagcacgtgtttaattagtacacattccagtctctctgcctccttttgctggttatccttatccctgtttcccactccatttatcatctctctttctcccctgtcctattacttcytattttaacttaataagaaatgacacagatatagggtactgaatatcttcgctatactacaatactattatgttccttgttctaaattaaaaagtagatccagctccttatatttctctccctaaaaaggaaaacaccagagtctgactttttagtaccatatgattttgaattaaaatttcctgggattagagaactctacattttaagaaaaactgttcacacatttgtccttacaataaagatggaataaccagacaaaaactaatgggatttccataactaaaacctagtgtgcat

SEQ ID NO: 31403 - DNA, 601 bp, Human
gtttcaaacattgcacaagcaactaactttattcctccacaggaacccagcattcctgatctgggtaccaatatttctgcaatcagtttggcaatttttggattagctgtaattttatctatattttaaactagaaattatattagaactcaaattcaatgttatacatacttggtaaacatttatttaaaatttaatttactatacttattgtctattataaagctcattataatataaaagtgaagtacaaaagttgtaagtttcctaattacttgattaattaatactatttgagttrttaaatgttaatcaaaatgagtatatcatttcctgtctttgaataatccactcattaatttttaatatgaaaagatatatatttgtacttgtaagcattttaagaaacatttttaaagtgtgctacaaattcatttggtgtactaacatcaaaatgtatccaagccatttaaaaaatatttatatatacatagtagcaaatagttttatagatttatttgtatcgcattttttattacaaatgaatatttcatgtttatataagctgtaatcaaaaaggactagtagtagtagtaaggaa

SEQ ID NO: 31404 - DNA, 601 bp, Human
atcctccgcggttaagcgtgggggtcagagctggggaggtgggtccaggctaccttggaaaacacagccccttcggggaagtgagagtttggggagtgcaagggctggagagagaagggcttccccggctccctccactcaccacgaggatgagggtccccaggcactcggccagcgcctgtcggagcagccggtagcggatgtggagcatctccccgcagcgggacaccagctccttctgtcgacccatggcggggcaggcggcggcgctgtcgggcgggcaggggtggcgggaggcggyggcgcagcgagcagcggcctccagcgctggtggctccctttataggagcgctggagacacgggccccgcccgccctgcagccccgccctgcagtcccggagcgccgaggagtgcgcgccccctcgcccccgccccacctcggctgggaggctggtgcggacgccgggtggagggagctgcgggcatggagtgtgaggagctttgagggacgggtggccttcggagggcgcttaagggaggggacgtcaagggggctgagaggcttaggcagatctgagagccaatggtgggattataggc

SEQ ID NO: 31405 - DNA, 601 bp, Human
ccgtggggaagaggactttggaagtcagcttgatcctccgcggttaagcgtgggggtcagagctggggaggtgggtccaggctaccttggaaaacacagccccttcggggaagtgagagtttggggagtgcaagggctggagagagaagggcttccccggctccctccactcaccacgaggatgagggtccccaggcactcggccagcgcctgtcggagcagccggtagcggatgtggagcatctccccgcagcgggacaccagctccttctgtcgacccatggcggggcaggcggcggckctgtcgggcgggcaggggtggcgggaggcggtggcgcagcgagcagcggcctccagcgctggtggctccctttataggagcgctggagacacgggccccgcccgccctgcagccccgccctgcagtcccggagcgccgaggagtgcgcgccccctcgcccccgccccacctcggctgggaggctggtgcggacgccgggtggagggagctgcgggcatggagtgtgaggagctttgagggacgggtggccttcggagggcgcttaagggaggggacgtcaagggggctgagaggcttagg

SEQ ID NO: 31406 - DNA, 601 bp, Human
ctcagacctggctccatcccaggacgccttggagggaggagctgtcagagccagttccaccaccttggggctaatcttcctcttcctcccccaacccctgccctgagttctcggccagcaccgccccctgccctcacaccaggtatctcagagaaaggggctttcctcaccccaaagccaaccctgattctgccactgcaggcctaggctcccaacacgcaggtaggcaggcaggcactcacccactacaaagggatccccaggcctgcccctccagttcatgcagtccttgaagttctgsttctcactgatatccaatacctcacatccatctgagtctgcaacccttcccctaaaatttaacactcttcttttgtggtctgggataagcctgatgatcctggggctcagtgggaggactaacggctcctttgtgagagagtgaactgagacttgggagggaatgaggaggcccctctaggaaaatagaagacatcatcctcccctagcctggctgctctaaaacaggtggctggactcaggactccgataggagtgagggctccgaggcaggagagtgataaaggccacctcctattgc

SEQ ID NO: 31407 - DNA, 601 bp, Human
aaaccccttctgctgtaattgcactttccagaaaaaggacacatgccttcccaccccactgtcccaactctaatatgagagggccctatggaaagggctggaagcagggtctgcgactgggatcctagaagatgactgaaccatcttcactgattttccttgaatttcagcaggcgtaggtgtaggggaacagctttcaccttagcacaagtttctccacagcccttcaggcctggaccataaaggtgggaagcctctcactcatcccccagctgccccaaagaaaagctcatgtaggccyggtgcagtggctcacactgtaatcccagcactttggtaggccgaggtgggtggatcacctgaggtcaggagtttgagaccagcctggccaacatagtgaaaccccatctctactaaaagtacaaaaattagccaggcgtggtggcaggtgcctgtaatcccagctactcgggaggctgaggcaggagaatcacttgaaaatgggaggcagatgttgcagtgagccaagattgcgccactgcacttcagcctgggcgacagagcgggactccatctcaaaaaaaaaaaaaaaaagagttga

SEQ ID NO: 31408 - DNA, 601 bp, Human
tgccaggacacctagtgggaatgctattgagggccaagggctgggggcagggttaaggccttaccagagacctggccagcgatgaggatgcccagagtgacagcaaagccaaaggccaggttgatggtgaggaaaccaccgtgggtgccccggctgagcacaacctgggccacggagccacagccaaacatctgtcaggaagaagaacaggcagggagggtgaggaccagcaactctcactccagaaggaaggggtgaagccagcaacatgcccactcgccaccactgggaggactagagscgcttcctggaacccagcccaaaccccttctgctgtaattgcactttccagaaaaaggacacatgccttcccaccccactgtcccaactctaatatgagagggccctatggaaagggctggaagcagggtctgcgactgggatcctagaagatgactgaaccatcttcactgattttccttgaatttcagcaggcgtaggtgtaggggaacagctttcaccttagcacaagtttctccacagcccttcaggcctggaccataaaggtgggaagcctctcactcatcccccagctgcccca

SEQ ID NO: 31409 - DNA, 601 bp, Human
tcggtcccctccctgcgttcccctcacacgtccccagcccatacctggtcaaagaagccattgatcatatccaagtgtccagaggggtaggtagcaaagatgccggctgtgccattggggcccgaaacaaaaagctggttgtcggcaaagtgccagattgcatctggtgacagattagacccacagtgagtcgggggagaggcctgagcccagacttccctctcaggtgtgccctccccaccctcccatgagttatgggtaagtagcaatactgctgtattgcagcaggcagagggggtgrcgtggggtggggtggagggcctgagactctgttattgcccaacttgtttctttcccttcgtgccccctaccttgaccctgtgcgtgaatgagtgagtcatgagcccggggcctgggcaggtcctagccgtctgtcatcaaaaggcctggtgccagcaggtcctgaacagagggacgggggtagtggaggaggacagggtggggaatgcttaccataatacagcccaaaaactattccagcacccaagaaggctcccagcgtctgtgccagggtgtagatgggcagcttgatccagggctc

SEQ ID NO: 31410 - DNA, 601 bp, Human
ccgcatgttttgtaagtacttgccaccatgttctgatgcgggttaccccacagattggagaaaccctgctacagtcgaggagtcctgtcccccaaccagcccatgagctaccaaggcaactcggtcccctccctgcgttcccctcacacgtccccagcccatacctggtcaaagaagccattgatcatatccaagtgtccagaggggtaggtagcaaagatgccggctgtgccattggggcccgaaacaaaaagctggttgtcggcaaagtgccagattgcatctggtgacagattagacmcacagtgagtcgggggagaggcctgagcccagacttccctctcaggtgtgccctccccaccctcccatgagttatgggtaagtagcaatactgctgtattgcagcaggcagagggggtggcgtggggtggggtggagggcctgagactctgttattgcccaacttgtttctttcccttcgtgccccctaccttgaccctgtgcgtgaatgagtgagtcatgagcccggggcctgggcaggtcctagccgtctgtcatcaaaaggcctggtgccagcaggtcctgaacagagggacggggg

SEQ ID NO: 31411 - DNA, 601 bp, Human
tagaatgtctgcgtgacaagaacccgctggagagccgcatgttttgtaagtacttgccaccatgttctgatgcgggttaccccacagattggagaaaccctgctacagtcgaggagtcctgtcccccaaccagcccatgagctaccaaggcaactcggtcccctccctgcgttcccctcacacgtccccagcccatacctggtcaaagaagccattgatcatatccaagtgtccagaggggtaggtagcaaagatgccggctgtgccattggggcccgaaacaaaaagctggttgtcggcraagtgccagattgcatctggtgacagattagacccacagtgagtcgggggagaggcctgagcccagacttccctctcaggtgtgccctccccaccctcccatgagttatgggtaagtagcaatactgctgtattgcagcaggcagagggggtggcgtggggtggggtggagggcctgagactctgttattgcccaacttgtttctttcccttcgtgccccctaccttgaccctgtgcgtgaatgagtgagtcatgagcccggggcctgggcaggtcctagccgtctgtcatcaaaaggcc

SEQ ID NO: 31412 - DNA, 601 bp, Human
ggccccgccccacgggctctgatttccgcccaatggagggcggtctgagcttcgctcacgaaaggagccgggaggcgctggcggctccaagagtctctgtgtccctggcagcggacctcatcttccctcacgccggagccccgatctctgcgccccggcccgacccagctgcgctctgtccgtctaagacgcgcggaaactacaactcccagagctcatctcgccgagatccggccccacgagtcaggtggcggaggtcaggtgacagcggacccgcctctcccaaagtctagccgggcargggaacgcggtgcattcctgaccggcacctggcgaggctcatgcgtcccgtgagggcggttcctcgagcctgggggcgctcaggtgagagcggacgcggcctcccctgtttcccaggcggaccccttgaggcacagcaggtcagcggggcagcctgccgggggtccagcgccctcagccgcggcgggctcctttccccgccaccagtgctggcctcgcgacacgggacaacccccgggtggaagggcccgagcggtggtcagccgaggcaggggcagcgggctgccggggtgggtgccgt

SEQ ID NO: 31413 - DNA, 601 bp, Human
aatttgcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagaggtaaccactttatatccttgtttctcaacctcgttattcctacctaccccctcccataaaatttaataccactagtacgctrtgtatttgtttctgtggccacaaaccattgtaatagctagatttcttcactaccaccccaagccaattttttttttttttgagatggagtctgcagcctctgtcacccaggctggagtgcagtggcgcgatctcggctcactgcaacctccgcctccggggttcaagcgattctcctacctcagccttccgagtagctgggactacaggcctgagccaccatgcccagctaatttttgtatttttagtagagatggggattcaccatgttggccaggctggtctcgaactcctgacctca

SEQ ID NO: 31414 - DNA, 601 bp, Human
accactttatatccttgtttctcaacctcgttattcctacctaccccctcccataaaatttaataccactagtacgctgtgtatttgtttctgtggccacaaaccattgtaatagctagatttcttcactaccaccccaagccaattttttttttttttgagatggagtctgcagcctctgtcacccaggctggagtgcagtggcgcgatctcggctcactgcaacctccgcctccggggttcaagcgattctcctacctcagccttccgagtagctgggactacaggcctgagccaccaygcccagctaatttttgtatttttagtagagatggggattcaccatgttggccaggctggtctcgaactcctgacctcaggtgatgcgctcacctcggcctcccaaagtgctgggatgacaggcgtgagccaccgcgcccagcctacccccagccaattttagtcccacttgacaatgcgtgctttacatctcctcatttaagtcctgtgaggtagttaccacctccttgtttggcaccacaaggtcgcataagtaataaataggtcaagcctgtctccagtgcacacagcccttgccact

SEQ ID NO: 31415 - DNA, 601 bp, Human
gagccaccatgcccagctaatttttgtatttttagtagagatggggattcaccatgttggccaggctggtctcgaactcctgacctcaggtgatgcgctcacctcggcctcccaaagtgctgggatgacaggcgtgagccaccgcgcccagcctacccccagccaattttagtcccacttgacaatgcgtgctttacatctcctcatttaagtcctgtgaggtagttaccacctccttgtttggcaccacaaggtcgcataagtaataaataggtcaagcctgtctccagtgcacacagcmcttgccactatttgtgtaccctctccaaaagcaggagacccagggagttccaggtcgtagaacagaggacaggaccaactcatacctggcagacaggagctgccacactagacccctagccccaggttgctcctgggaagggactgaatgggtgaggagccttcttgaaacatgtgacatctgaatgaggcctggacaatagttagaacttacataggaagggcacgccagacagagcccattgtcaggagatacttcatttctatcttgtagctttcacaagccactagttgtatgtaa

SEQ ID NO: 31416 - DNA, 601 bp, Human
catttctatcttgtagctttcacaagccactagttgtatgtaattatcaatctggtttttttttttttttttttttttaatttgagacggagtttcactcttatcactcaggctggagtgcaatggtgcaatctcggctcactgcaacctccacctcccgggttcaagcgattctcctgcctcagcctcctgagtagctgggactacaggcacatgccaccacgcctggctaatttttgtatttttagtagagacggggattcaccatgttggccaggctggtctcgaactcctgacttcragtgatccaactgcctcggcctcccaaagtgctggaattacacacacgagccactgcgctcagcctaatctgatgttttttaacattttaattgacttacctctcaatgtcgttttgtctctgctggcatcgttcctccaggggtctcagcctttgaggcttgggaatgtttgctgaccaagtctgtgagtttgagaagctggttaggcctgattctgcatctaatttctggagaaaaaccagactctgtcctgggcaacaaactgaatcctgaacttgaggccacagggcaggtgtgag

SEQ ID NO: 31417 - DNA, 601 bp, Human
cttacctctcaatgtcgttttgtctctgctggcatcgttcctccaggggtctcagcctttgaggcttgggaatgtttgctgaccaagtctgtgagtttgagaagctggttaggcctgattctgcatctaatttctggagaaaaaccagactctgtcctgggcaacaaactgaatcctgaacttgaggccacagggcaggtgtgaggagcggagggcagcaagagtgagagggaggcctgtggtcattccatacacgcaggagggcaattcctcccaggtcaggggacagagcacagggatycagcgccaagagcaaggcccccagaggaggccagagagtaggtacggggtcattcccggccggtgagaagggtctcagatgaggcagacctgcagcaggcaaagagagaaccctggaggagacgggccaacagaggtcagacagctggagcagccagggagacttcttgaggagtgtgtaagggagatgtccggagatgctggaggccttggggaaactgaaatcagagtgggaacagggatgtctccacacagaccttacccagagctccccacagtctgcaggaggcccgtgagactg

SEQ ID NO: 31418 - DNA, 601 bp, Human
agaggaggccagagagtaggtacggggtcattcccggccggtgagaagggtctcagatgaggcagacctgcagcaggcaaagagagaaccctggaggagacgggccaacagaggtcagacagctggagcagccagggagacttcttgaggagtgtgtaagggagatgtccggagatgctggaggccttggggaaactgaaatcagagtgggaacagggatgtctccacacagaccttacccagagctccccacagtctgcaggaggcccgtgagactgtgtactgaggcagcacggagacyaagctacagaaatccatgccggcctggctgctcttgacccactgttcacctgctgtgtcttgggtttacaggaatgcagctccccatcttccacactaaaccaaggacttgctctggggctcatccctccccgagtcctccttgtgaatgaccccagccagtcctggaatggtgacacttgtcaaataaagtcttgacaggcgcggtggctcctacctgtaaccccagcactttgggaggctgaggcgggcggatcactcgaggtcaggagtttgagaccaggctggccaacatggtgaa

SEQ ID NO: 31419 - DNA, 601 bp, Human
tgaggcagcacggagaccaagctacagaaatccatgccggcctggctgctcttgacccactgttcacctgctgtgtcttgggtttacaggaatgcagctccccatcttccacactaaaccaaggacttgctctggggctcatccctccccgagtcctccttgtgaatgaccccagccagtcctggaatggtgacacttgtcaaataaagtcttgacaggcgcggtggctcctacctgtaaccccagcactttgggaggctgaggcgggcggatcactcgaggtcaggagtttgagaccagsctggccaacatggtgaaaccccatctctactaaaaatacaaaagttagccgggcatggtggggggcacctgtaatcccagctactcaggaggctgaggcacaagaattgcttgaacccagggggtggaggtttcagtgaacagagttcgcaccactgcactccagcctgggcaacagagcaagactctgtctcaaaaaaaaaaaaatttaaatatgtatattaaaaaaaaatgtttttttaagtcttaagggtcagttggtgtcatcagcccttagactcttatcccaggacaggaaagg

SEQ ID NO: 31420 - DNA, 601 bp, Human
aaaatttaaatatgtatattaaaaaaaaatgtttttttaagtcttaagggtcagttggtgtcatcagcccttagactcttatcccaggacaggaaaggaaattaatttccttgaggtttataggttcacaatgtcaaatatctgaccacagttttaacaacttttggagaaaaagaatctcaagccagtaaaattgcattctttctttctgctaactaagtttttacaaaaagcaattgaagagggaaaaattctggtctttgttcacttcctcaggggggcactttacacaacccatttrtctgctcggagcccgtttcccctgtatatcaaagaaagataagtcctctctagggtgtccctctgaggccgtgatgcaaagccctgaggtcacagctgtcaggtggcagtcctttatgagccatccatgctccagagggcagattgtctacagggagctgagctgattcaacattcccctgaacttctctcttgctgtttttcttcctagttctgagaaatcgagaaacatgataaggaattggctgactatttttatcctttttcccctgaagctcgtagagaaatgtggtaagtttag

SEQ ID NO: 31421 - DNA, 601 bp, Human
acccaggtctgggatccaggtgttctgcaaagagccagatagttccacatataattggccttctgccctggtatctctgtacctttctgtaccaaagtgaacagctggttcttaaggtcagactatgcagctgattctcaaagtcaaacggtagagctccaacaacctgggataatatcttaaagactggctcaggctggagcagtggctcacgcctataattccagagctttgggaggccaaggcaggaagatctcttgaggccaggagtttgagaccaacctgggcaacgtagtgaaaycccatgtctactaaaaaataatttttaaaaattagccatatgcagtggctcgtgcctatagtcctagctacttgggaggctgaggcaggaagattgcctgagcccaggaagtcaaggctacagtgagttatgatcacactactgcactccggcctgggcaacagagttgagaccctgactttaaaagaaaaaaaagaagaatggcttatgcctctgccctgtggacctcacagagagagtcttgggtcctgggaaacactggggaagcagaagaggtagccaccctgttgtacccggttc

SEQ ID NO: 31422 - DNA, 601 bp, Human
ccttgacaaacaatacaaatcctgcagaggtttccccagagcctagcaccattgccgttatctggcctcttgcatctctgaggaaacatggtcacgtgatcatctcttccaggtttgttaaacaatcagtaatgtttgtagtcacactttgtggataagcaatttccgggaaaggcaggtctttcagaccctggaacctggtgtttcttaatacagacgtcagaaccctgtccccaccctgtaggatcagactttgtaagactgaggctggagcatgtgcgtgtgcctgggagtgtgcgcrcgcgtgtatttgcctgggcctgtgtgtgtgtgtgtacccgggcgtgtgtgtgtgtgtgtgtgcctgggcgtgtgtgtgtgtgcctgggtgtgtgtctgcgcgcatgtatgtgtgcccgggcgtgtgtgtgtgtgtgtgtgtgtgcccagtcgctcatacatactctttaaagccccattagtaatgctaacacgctcccctaggagaaaaacaaaaaatccagctaccaccactccagttacctggaggggaagcaggcccagagagggtagaaggcttccccaaagtcacacagctaga

SEQ ID NO: 31423 - DNA, 601 bp, Human
agacgtcagaaccctgtccccaccctgtaggatcagactttgtaagactgaggctggagcatgtgcgtgtgcctgggagtgtgcgcgcgcgtgtatttgcctgggcctgtgtgtgtgtgtgtacccgggcgtgtgtgtgtgtgtgtgtgcctgggcgtgtgtgtgtgtgcctgggtgtgtgtctgcgcgcatgtatgtgtgcccgggcgtgtgtgtgtgtgtgtgtgtgtgcccagtcgctcatacatactctttaaagccccattagtaatgctaacacgctcccctaggagaaaaacaraaaatccagctaccaccactccagttacctggaggggaagcaggcccagagagggtagaaggcttccccaaagtcacacagctagaaagtaacaaagctgggacctgcataggatccctgctgcatgagatcactttgcctcctttcctgaatgccattagaaaagaatgggccaggtgctgtagttcacgcctgtaatcccagcactttgggaggccaaggtgggtggatctcttgaggtcaggagttcgagaccagcctggccaacatggtgaaaccccgtctctactaaaaatacaa

SEQ ID NO: 31424 - DNA, 601 bp, Human
gatcagactttgtaagactgaggctggagcatgtgcgtgtgcctgggagtgtgcgcgcgcgtgtatttgcctgggcctgtgtgtgtgtgtgtacccgggcgtgtgtgtgtgtgtgtgtgcctgggcgtgtgtgtgtgtgcctgggtgtgtgtctgcgcgcatgtatgtgtgcccgggcgtgtgtgtgtgtgtgtgtgtgtgcccagtcgctcatacatactctttaaagccccattagtaatgctaacacgctcccctaggagaaaaacaaaaaatccagctaccaccactccagttaccyggaggggaagcaggcccagagagggtagaaggcttccccaaagtcacacagctagaaagtaacaaagctgggacctgcataggatccctgctgcatgagatcactttgcctcctttcctgaatgccattagaaaagaatgggccaggtgctgtagttcacgcctgtaatcccagcactttgggaggccaaggtgggtggatctcttgaggtcaggagttcgagaccagcctggccaacatggtgaaaccccgtctctactaaaaatacaaaattagctgggcatggtggcgggcgcctgt

SEQ ID NO: 31425 - DNA, 601 bp, Human
ctcaaaaacaaaaaaaaatgcctacctctcacttctgtaataattagaaaatgggagctcggtgtatagcagagtagctggtattgggtaggtgcagagtgggagagaggcctataagaattaattttaaaaacctggccaagcatggtggctcatacctgtaatcccaacactttgggaggccaaagagggaggatcacttgggcacaggaatttgacaccagcgtgagcgacatagtgagaccccatctctacaaaaaaaaatttttttttaaacggattctcactcagttgcacaggmtggagtgcaatgtggcgtgatctcagttcactgcaacctctgcctcccgggttcaagcgattctagtgcctcagcctcccaagtagctgggtttgtagacgtgcgccaccacatccggctaatttttgtattttcagtggagacagagtttcaccatgttggccaggttggtctcaaactcctgacctcaagtgatctgaccgcctcagcctcccaaagtgctgggattacaggcgtgagccaccgcacccggccaaaaatttttttttaattagctgggtgtggtggtgcatgcctgtg

SEQ ID NO: 31426 - DNA, 601 bp, Human
ttgggcacaggaatttgacaccagcgtgagcgacatagtgagaccccatctctacaaaaaaaaatttttttttaaacggattctcactcagttgcacaggctggagtgcaatgtggcgtgatctcagttcactgcaacctctgcctcccgggttcaagcgattctagtgcctcagcctcccaagtagctgggtttgtagacgtgcgccaccacatccggctaatttttgtattttcagtggagacagagtttcaccatgttggccaggttggtctcaaactcctgacctcaagtgatctgmccgcctcagcctcccaaagtgctgggattacaggcgtgagccaccgcacccggccaaaaatttttttttaattagctgggtgtggtggtgcatgcctgtgttcgtagctactgaggtgagaggcggcagtggtgggaggatggcttgagcctggcggggtcaaagctgcagtgagccatgatcactctctttaggaggaactcaggatggtgttgtgactcattttgtaaatctgatacaatgtaaagattttagacttggggggccagcttcctaactgcctcccaccttgggctaaaa

SEQ ID NO: 31427 - DNA, 601 bp, Human
tctcactcagttgcacaggctggagtgcaatgtggcgtgatctcagttcactgcaacctctgcctcccgggttcaagcgattctagtgcctcagcctcccaagtagctgggtttgtagacgtgcgccaccacatccggctaatttttgtattttcagtggagacagagtttcaccatgttggccaggttggtctcaaactcctgacctcaagtgatctgaccgcctcagcctcccaaagtgctgggattacaggcgtgagccaccgcacccggccaaaaatttttttttaattagctgggygtggtggtgcatgcctgtgttcgtagctactgaggtgagaggcggcagtggtgggaggatggcttgagcctggcggggtcaaagctgcagtgagccatgatcactctctttaggaggaactcaggatggtgttgtgactcattttgtaaatctgatacaatgtaaagattttagacttggggggccagcttcctaactgcctcccaccttgggctaaaaatatcctgcagttatcatgtgatgataataatagtaacaattatttagcatctgggctttgtggaaaacatgttacaaaca

SEQ ID NO: 31428 - DNA, 601 bp, Human
ggcctcccaaagtgttaggattacaggtgtgagccgctgtgcccggccctcaacctcctatatgcaaagattgtaggagctctgtagccatgtagatctcccactcaccttgacctccactacctctggcagagccctagggatccagagtctggctggccgcccagcatcactttcagcatcctgtcctgagcagtggctggttgtgggacttgcttatctggcatggtcctcagctctaggcagaattgaactggtggtacaggaagtcccagctatgcaagcccagaagaaatcctcrgaatgacctcagaacagtgagcctgaaaaagaagggcagactcgccacagcggcttccaggctctgaggctccacataaggaagggactgccttttgccgctctgagcaccttggcctctgcaagggccaggggacatcctgttctgaggagcccagccagccagcaggggactggagattgtggactgtggggacctacggacttgggacagagcttccatctgtattcacatgtgctgagcatggagaaggcagctctcagggtctgagaggctctgggtagcagagcctggcctggc

SEQ ID NO: 31429 - DNA, 601 bp, Human
cctcccaaagcgccaggtttctaagcgtgagccaccacgcccagccccacgatggttttctaagaccctaagacccagatctgcttcttccctcatctggggggcctgtttgtcaacttgattctgagttaacagcttaatgccaagaagaaatctcagagtgaaacaactattcacccttcctcctccagtaccccgcagatagtcagccccaggaaggggaccagtgccagggtgagctgggttgggaagggaccccaaagggctccttagaaactcattagctgggcccatgtgtctstctgagagtgcaggaaaggggctggcccagttcttcaggaccattttgacttcatgaacagaggagacccctgtgctttcatctgaagaggtggttcacggctgccttttacgctcccaggtcgcgctggaattcccctgtaatgatttttgggctccatggttctctaacaatctctggttaactcagccgcagactctcagagcctgtcatcgcagcgggaggaggacgctccggcgtttcctgctcaggcctgttttcctccatctctgtctctggcagcaggtggggaaggaagct

SEQ ID NO: 31430 - DNA, 601 bp, Human
tcaacttgattctgagttaacagcttaatgccaagaagaaatctcagagtgaaacaactattcacccttcctcctccagtaccccgcagatagtcagccccaggaaggggaccagtgccagggtgagctgggttgggaagggaccccaaagggctccttagaaactcattagctgggcccatgtgtctctctgagagtgcaggaaaggggctggcccagttcttcaggaccattttgacttcatgaacagaggagacccctgtgctttcatctgaagaggtggttcacggctgccttttaygctcccaggtcgcgctggaattcccctgtaatgatttttgggctccatggttctctaacaatctctggttaactcagccgcagactctcagagcctgtcatcgcagcgggaggaggacgctccggcgtttcctgctcaggcctgttttcctccatctctgtctctggcagcaggtggggaaggaagctaaccagggcctgtgtttgcagtcccatcacagaatagggctcgtcagagagtcagagctcaggagttcagatgtcaggggtttcggcccagttttctgtcacaggcctgaac

SEQ ID NO: 31431 - DNA, 601 bp, Human
gagtcctcactttccctggcaggagaaggaaggggtgcttctcccagagacgtgcgtcttttccccgcatgggaagagtcctgtgtgaccggtgttgaggccagatttcaaagcgattctttctaagactaagtatttgaagagagccctgaaggtcaaggggcagggggctgagctgctggttggcacttctgaggttgctttcagaagcaggagtggccacgtcgggtgaatgccgctcatgctgggccttgtctgggagtctcacttgctgccacctgctggcttaggcacaaacgtygcgacctagtccagtccgtgccagggaggctgcctctgccttctctgctcttagctgctttgtccttcccttgcctcccagccgtgaggattccctgatgaagaagacctagaaccctctccttctctctttatgcctttcccccttcctcgcctctcctgcgagatctggcctgaaagcaaagctttggttccgaggcccctagcaggcctgccattccgctcccagctccttctgtctctgcacaccctccccctgcaaatcttacaagtcatctcttaccacaactgtccaggcccc

SEQ ID NO: 31432 - DNA, 601 bp, Human
aatccagagggttggttgagatctcactgtccagcttctcagcagtaattagactcttgtcctccacaggccaccattaaatgcaaccctggtgatcacttttgaaatcacatttcgttccaaaaatattactatccttgagctccccgatgaagtaagtaaccaatcttaacggatgggtagggaaatgctaggtaacagaacacatttgaattaagagctggtggaaacaggtctcctaggcggcccctgttccatcaacctagaaatctgtgattttggctttgttggtgtcttttgsggatgagtatcacatgccattagatggaattaagaaggtgatagtgaggaacctgaggcaaaaatggttctgggaatgtaaacgttcttaccgggagtggtggctcacgcctgtaatcccagcactctgggaggccaaggtgagcgggtcacctgaggtaggaagttcgagaccagcctgatcaacatggtgaaaccccatctctactaaagtaaatacaaaaattagccagtcgtggtggcatgcacctgtaatccaagccacttgggaggctgaggcaggaggatcacttgaacccag

SEQ ID NO: 31433 - DNA, 601 bp, Human
gaggcaaaaatggttctgggaatgtaaacgttcttaccgggagtggtggctcacgcctgtaatcccagcactctgggaggccaaggtgagcgggtcacctgaggtaggaagttcgagaccagcctgatcaacatggtgaaaccccatctctactaaagtaaatacaaaaattagccagtcgtggtggcatgcacctgtaatccaagccacttgggaggctgaggcaggaggatcacttgaacccaggaggcggaggttggggtgagcctagatggccccactacactccagcctgggtgayagagtgagactccttctcaaaaaaaaaaaaaaaaaaagttcttacaattttcaaggcctggctgctcaaagggcattcaaggaccagagaattgggcttccttaggaacacagcatctcaggccccatcccaaacctactgattcaaagtcagcacactagcaagatccccaaatggtttgagtccacattaaggtttgtgaagcctcattctgagacaccactggttgggtgtcgtttccaaaaaccagtgccagaggccgtgtgatctaatagcgatcattacccatagctttatgca

SEQ ID NO: 31434 - DNA, 601 bp, Human
cgggagtggtggctcacgcctgtaatcccagcactctgggaggccaaggtgagcgggtcacctgaggtaggaagttcgagaccagcctgatcaacatggtgaaaccccatctctactaaagtaaatacaaaaattagccagtcgtggtggcatgcacctgtaatccaagccacttgggaggctgaggcaggaggatcacttgaacccaggaggcggaggttggggtgagcctagatggccccactacactccagcctgggtgacagagtgagactccttctcaaaaaaaaaaaaaaaaaaagttcttacaattttcaaggcctggctgctcaaagggcattcaaggaccagagaattgggcttccttaggaacacagcatctcaggccccatcccaaacctactgattcaaagtcagcacactagcaagatccccaaatggtttgagtccacattaaggtttgtgaagcctcattctgagacaccactggttgggtgtcgtttccaaaaaccagtgccagaggccgtgtgatctaatagcgatcattacccatagctttatgcatgtatctatttgtgtgtaccctgctcccaccttactg

SEQ ID NO: 31435 - DNA, 601 bp, Human
aaaaagttcttacaattttcaaggcctggctgctcaaagggcattcaaggaccagagaattgggcttccttaggaacacagcatctcaggccccatcccaaacctactgattcaaagtcagcacactagcaagatccccaaatggtttgagtccacattaaggtttgtgaagcctcattctgagacaccactggttgggtgtcgtttccaaaaaccagtgccagaggccgtgtgatctaatagcgatcattacccatagctttatgcatgtatctatttgtgtgtaccctgctcccaccttactgagcatttgagccagttgctattcaattagataaaaagcatccacagaggaggtggcaaataagggtttaaataacaagatgaacgcaagtcactcagggcgcataacttctggagagctattgtacaacctggcgatatagttaacaatcatgtattactgcatgcctaaaaactgctaagagatagatcctaaatgttcccaccacagctgggtgcagtggcttgcacctatagtcctagctactcacgttcgtaacaacaacaaaaaaaagataagtatctgagatgatggata

SEQ ID NO: 31436 - DNA, 601 bp, Human
gagcaagactctgtctctaaaaaattaaaaataaaaataaaatgtttaaaaataacagcattgctgagaggggatctcggagtgtccagctaagaggaccccgcatgagagggagctctccccgctggtgagcaccttgttagtgccatttcccacacctcccctcttgcccagggtgtgaggccagcatgcagagccggtgggttcccacagcacagccctctgatccacagattaaattctgactctgggaggaacagatgctgattgcttcgtttagggccaaacatcgaagtcaaartgtcatctttttatttttatgtattcatttattttttattttatttatttgtttagagacagagcttcactctgtcgcccaggttggagtaaagtggcgcaatctcagctccctgcaacctctgcctcctgggttcaagcgattctcctgcctcagcctcccaagtagctgggattataggcgcccaccaccaggcccagctaatttttgtatttttagtagagatggggtttcaccatgttgactaggctggtcttgaactcctgacctgaggtgatccacccgccacggcctcctaaa

SEQ ID NO: 31437 - DNA, 601 bp, Human
ctgggcacggtgggattacatctgtaatcccagcactttgggaggccgaggtgggcggatcacctgaggtcaggagttcaagaccagcctggccaacatggtgaaaccccgtctctactaaaaatacaaaaattagccaggtggtagtggtgtgcgcctataatcccagctactcaggaggctgaggcaggagaatcacttgaacccgggaggcagaggtggcagtgagctgagatcacgccactgcactccagcctgggtgacagaatgagaccctgtctcaaaaaaaaaaaaaaaaaargaaaagaaaagtctttaacaatgagagtcaaaccattggtgtgagatggcattgatgggcaccaacctaccttttcaggctcctgcctcactggcccttccccacccaactctcaccactcccctctactacccgtgatgctggaagcctctggttagaacatgggagttgagtggtctaggagccaggcctgtgagccttgggtaaggcacttcaccccaatatagcaccgtctccttattcgtagctgtacagtgaataatgtttacttgacagccttgtgaagattaaaagcacaaa

SEQ ID NO: 31438 - DNA, 601 bp, Human
gtagtggtgtgcgcctataatcccagctactcaggaggctgaggcaggagaatcacttgaacccgggaggcagaggtggcagtgagctgagatcacgccactgcactccagcctgggtgacagaatgagaccctgtctcaaaaaaaaaaaaaaaaaaagaaaagaaaagtctttaacaatgagagtcaaaccattggtgtgagatggcattgatgggcaccaacctaccttttcaggctcctgcctcactggcccttccccacccaactctcaccactcccctctactacccgtgatgctrgaagcctctggttagaacatgggagttgagtggtctaggagccaggcctgtgagccttgggtaaggcacttcaccccaatatagcaccgtctccttattcgtagctgtacagtgaataatgtttacttgacagccttgtgaagattaaaagcacaaacaagtataaaatgtctaggattgactgggcacggtggctcatgcctgtaatcccagcacttcgggaggccgaggcaggcagatcacctgaggttgggagctcaagaccagcctggccaacatgatgaaacccagtctctacta

SEQ ID NO: 31439 - DNA, 601 bp, Human
ccttattcgtagctgtacagtgaataatgtttacttgacagccttgtgaagattaaaagcacaaacaagtataaaatgtctaggattgactgggcacggtggctcatgcctgtaatcccagcacttcgggaggccgaggcaggcagatcacctgaggttgggagctcaagaccagcctggccaacatgatgaaacccagtctctactaaaaatacaaaaattagccaagcgtggtggcaagtacctgtaatcccagctacttaggaggctgaggcaggaaaatcacttgaacccgggaggyagaggttgcagcgagccgaaatcatgccattgcactccagcctgggtgacatgagcaaaactccatctaaaaaaataaaaaatgtctaggattgtccctggcacatagaaagcactcagtgaaaggtagcgattatcacttcattctgtcttgtatcggtcaatcgaccgattttctccctgcctagttccagaagggatttagtggccacttaacaaatatgcaagcaacgttgcaaggaatatctgttaaaaataagaaaaagtgagtggcaggaaaataaaagagccaggagtggca

SEQ ID NO: 31440 - DNA, 601 bp, Human
ggtatggtggctcatgcctgtaatcccagcactttgggaggccgaggtgggcggatcacctgaggtcaggagttcgagaccagcctggccaacatagtgaaagtccatctctactaaaaattcaaaaattagctgggcatggtggcgcacacctgtaatcccaggtactcgggactcaggagcctaaggcaggagaaccgcttgaactcgggaggcagaggttgcagtgagccgagatcactccactacactccagcctgggtgacagagcgagactccgtctcaaaaaaaaaaaaaaaaaggaaagtctcactcaggccaggcgcggtggctcacatctataatcccagcactttgggaggctgaggcgggtagattgcttgagctcaggagttcgagaccagcctgggcagcatggcgaacaggaggttcaagttggctggtgggcgcagcgtctctccttttgcttagtaagctcttggaaggtgaggctgcgggtggtgcgtccctccgttccctagcgtgttgcatagagctagatgccagcggggtcctcggtaactgtacgtggcatcggattgaacctcagtcttcctaacag

SEQ ID NO: 31441 - DNA, 601 bp, Human
ggtaggctggcctcagggtgtgggggcctcacgtgacaagaagggggccgtgctgggcacgtgggagtctccttcagaagcccagcctcagctcatcccggtccccaaactcctttccagcccgaggatacgctttcttgtgatccgcagcagcgccattagcatcataaaccaggtgattggctggatctactttgtggcctggtccatctccttctaccctcaggtgatcatgaattggaggcggaaaaggtaaccccctgggccgtatgtgcaggctctctcggggcccctaggagcrggacgttccagcaaggctgccgatagcgcagcctccaacgtcccctctacccttctgtctgcctaccctttccagaaagttgtcccagtgcgaaggctcggagagcctgggtcggattcccgtgctgggcgtttcatcccttgcccagctcagcccctccctgggaaagcaggaaaacagggaaaaggggctccttagtttagtggagaatgggcgggggagggagggcagtccatcgtgaatctcctctgcgctgggtccatccgaccctggaggattgcggcgtcaagtcctgtagtc

SEQ ID NO: 31442 - DNA, 601 bp, Human
aggctggcctcagggtgtgggggcctcacgtgacaagaagggggccgtgctgggcacgtgggagtctccttcagaagcccagcctcagctcatcccggtccccaaactcctttccagcccgaggatacgctttcttgtgatccgcagcagcgccattagcatcataaaccaggtgattggctggatctactttgtggcctggtccatctccttctaccctcaggtgatcatgaattggaggcggaaaaggtaaccccctgggccgtatgtgcaggctctctcggggcccctaggagcaggrcgttccagcaaggctgccgatagcgcagcctccaacgtcccctctacccttctgtctgcctaccctttccagaaagttgtcccagtgcgaaggctcggagagcctgggtcggattcccgtgctgggcgtttcatcccttgcccagctcagcccctccctgggaaagcaggaaaacagggaaaaggggctccttagtttagtggagaatgggcgggggagggagggcagtccatcgtgaatctcctctgcgctgggtccatccgaccctggaggattgcggcgtcaagtcctgtagtctcg

SEQ ID NO: 31443 - DNA, 601 bp, Human
gctggcctcagggtgtgggggcctcacgtgacaagaagggggccgtgctgggcacgtgggagtctccttcagaagcccagcctcagctcatcccggtccccaaactcctttccagcccgaggatacgctttcttgtgatccgcagcagcgccattagcatcataaaccaggtgattggctggatctactttgtggcctggtccatctccttctaccctcaggtgatcatgaattggaggcggaaaaggtaaccccctgggccgtatgtgcaggctctctcggggcccctaggagcaggacrttccagcaaggctgccgatagcgcagcctccaacgtcccctctacccttctgtctgcctaccctttccagaaagttgtcccagtgcgaaggctcggagagcctgggtcggattcccgtgctgggcgtttcatcccttgcccagctcagcccctccctgggaaagcaggaaaacagggaaaaggggctccttagtttagtggagaatgggcgggggagggagggcagtccatcgtgaatctcctctgcgctgggtccatccgaccctggaggattgcggcgtcaagtcctgtagtctcggt

SEQ ID NO: 31444 - DNA, 601 bp, Human
atcatcgtgcagtgctgcctgtatgaggtgagaccagccctggccccccacaggccaccccagccaacacccgccaccccacctcacctttgacagaagacacggcagagcctgggaaaggaagggtgtgtgttcattcatccaggtcctgtgctgggcatagaagacacccatgagtccaggccctcagagccccccaagtctggggtgagggactcagggagaggcagtgcctggactcaggctgagagccgtgcacagaggagcacagacagctcatggaggagtgcaaggccctgarccctgccagggaggagggaggagggcacagaagggaggagggaggagggcacagaagggaggagggcagaggaagacgcttggttgggctccaaggatgagtgaagttcctatggaggaggggaggggccagggtgggctcctggaggggtcaggtcacagaggccaaggggcatttgagagggaccctgagcaggcgggtgcagctgggcttcagggtgccaggagggggcccgcgtgcaggcggagacacctgtattcagctttgttgctggaagccatgggtgtcggcagggcaggg

SEQ ID NO: 31445 - DNA, 601 bp, Human
ttctcttctgcttctcctacatcaagctcgcagtcacgctggtcaagtattttccacaggtacctccagggccctgttcacatggccggtggcaggagaggtgagagctacatggcccaggccctgctccggtggggcagctcctgccggcgtgaggaaacaggacggaaagccacagggagcccgggagcccagcgggagcggggcggtggggaggccagcctgccgctcttcccccggggctggaatcacaggagatcgctagcggaggccccttggaccccacgctcccctaagcatsaggtgtgcgggtggttccccttctccacaccccagcctttcctgatgcctttggctctgccctcaccactgcctccatttccacagcaggacactctggagaggtgaggtgggaggagggagccccttcctgcgcagagctcagcccgtcctatgagcatagccggtcctcttcagatccggggactcagggtccagcacatcttgccccacagcctgggacagggtcagggctgaagttgctgtacccggggacctagggcctcatttaactcaccccattcccaaagggagaagcctt

SEQ ID NO: 31446 - DNA, 601 bp, Human
tctcttctgcttctcctacatcaagctcgcagtcacgctggtcaagtattttccacaggtacctccagggccctgttcacatggccggtggcaggagaggtgagagctacatggcccaggccctgctccggtggggcagctcctgccggcgtgaggaaacaggacggaaagccacagggagcccgggagcccagcgggagcggggcggtggggaggccagcctgccgctcttcccccggggctggaatcacaggagatcgctagcggaggccccttggaccccacgctcccctaagcatcrggtgtgcgggtggttccccttctccacaccccagcctttcctgatgcctttggctctgccctcaccactgcctccatttccacagcaggacactctggagaggtgaggtgggaggagggagccccttcctgcgcagagctcagcccgtcctatgagcatagccggtcctcttcagatccggggactcagggtccagcacatcttgccccacagcctgggacagggtcagggctgaagttgctgtacccggggacctagggcctcatttaactcaccccattcccaaagggagaagccttg

SEQ ID NO: 31447 - DNA, 601 bp, Human
gtggggcagctcctgccggcgtgaggaaacaggacggaaagccacagggagcccgggagcccagcgggagcggggcggtggggaggccagcctgccgctcttcccccggggctggaatcacaggagatcgctagcggaggccccttggaccccacgctcccctaagcatcaggtgtgcgggtggttccccttctccacaccccagcctttcctgatgcctttggctctgccctcaccactgcctccatttccacagcaggacactctggagaggtgaggtgggaggagggagccccttccygcgcagagctcagcccgtcctatgagcatagccggtcctcttcagatccggggactcagggtccagcacatcttgccccacagcctgggacagggtcagggctgaagttgctgtacccggggacctagggcctcatttaactcaccccattcccaaagggagaagccttgttccagtgcccccagccctgggagcctcgtgttctgtgagctcaggagggccagcgttctgactgggaggcaggactggactcttaggctgagcaggactaagttctgtggccaaggagcccgggcgttc

SEQ ID NO: 31448 - DNA, 601 bp, Human
actcagggtccagcacatcttgccccacagcctgggacagggtcagggctgaagttgctgtacccggggacctagggcctcatttaactcaccccattcccaaagggagaagccttgttccagtgcccccagccctgggagcctcgtgttctgtgagctcaggagggccagcgttctgactgggaggcaggactggactcttaggctgagcaggactaagttctgtggccaaggagcccgggcgttccgggccaggccagcctgcacagaggctggggcgggacacagggcggcagtgagrggatgtggctggttgaacagtgttgagcatgttgaagctgggaagctggggtcaggtcccgggagctggggggggcttccgaggaggggaaggtttggggaagtgggccccagtccctgagggtgggagggattggggccaagaaaccggggatggaggagcccaggttggagacgtttggaactgctggaggggcagcagcaagtacggaagagggtgagccgggacacagacagggactgactagaggctcactgggaggccaccagagaggccaggacctgcctcacgggggggaag

SEQ ID NO: 31449 - DNA, 601 bp, Human
agggtccagcacatcttgccccacagcctgggacagggtcagggctgaagttgctgtacccggggacctagggcctcatttaactcaccccattcccaaagggagaagccttgttccagtgcccccagccctgggagcctcgtgttctgtgagctcaggagggccagcgttctgactgggaggcaggactggactcttaggctgagcaggactaagttctgtggccaaggagcccgggcgttccgggccaggccagcctgcacagaggctggggcgggacacagggcggcagtgaggggaygtggctggttgaacagtgttgagcatgttgaagctgggaagctggggtcaggtcccgggagctggggggggcttccgaggaggggaaggtttggggaagtgggccccagtccctgagggtgggagggattggggccaagaaaccggggatggaggagcccaggttggagacgtttggaactgctggaggggcagcagcaagtacggaagagggtgagccgggacacagacagggactgactagaggctcactgggaggccaccagagaggccaggacctgcctcacgggggggaaggaaa

SEQ ID NO: 31450 - DNA, 601 bp, Human
ggtccagcacatcttgccccacagcctgggacagggtcagggctgaagttgctgtacccggggacctagggcctcatttaactcaccccattcccaaagggagaagccttgttccagtgcccccagccctgggagcctcgtgttctgtgagctcaggagggccagcgttctgactgggaggcaggactggactcttaggctgagcaggactaagttctgtggccaaggagcccgggcgttccgggccaggccagcctgcacagaggctggggcgggacacagggcggcagtgaggggatgyggctggttgaacagtgttgagcatgttgaagctgggaagctggggtcaggtcccgggagctggggggggcttccgaggaggggaaggtttggggaagtgggccccagtccctgagggtgggagggattggggccaagaaaccggggatggaggagcccaggttggagacgtttggaactgctggaggggcagcagcaagtacggaagagggtgagccgggacacagacagggactgactagaggctcactgggaggccaccagagaggccaggacctgcctcacgggggggaaggaaagg

SEQ ID NO: 31451 - DNA, 601 bp, Human
ggcctcatttaactcaccccattcccaaagggagaagccttgttccagtgcccccagccctgggagcctcgtgttctgtgagctcaggagggccagcgttctgactgggaggcaggactggactcttaggctgagcaggactaagttctgtggccaaggagcccgggcgttccgggccaggccagcctgcacagaggctggggcgggacacagggcggcagtgaggggatgtggctggttgaacagtgttgagcatgttgaagctgggaagctggggtcaggtcccgggagctggggggggcttccgaggaggggaaggtttggggaagtgggccccagtccctgagggtgggagggattggggccaagaaaccggggatggaggagcccaggttggagacgtttggaactgctggaggggcagcagcaagtacggaagagggtgagccgggacacagacagggactgactagaggctcactgggaggccaccagagaggccaggacctgcctcacgggggggaaggaaaggtcacagcagtcagaggacccacagggctctgcagcatgggaggacgtggggcacaggcagtcagactgg

SEQ ID NO: 31452 - DNA, 601 bp, Human
gaggggatgtggctggttgaacagtgttgagcatgttgaagctgggaagctggggtcaggtcccgggagctggggggggcttccgaggaggggaaggtttggggaagtgggccccagtccctgagggtgggagggattggggccaagaaaccggggatggaggagcccaggttggagacgtttggaactgctggaggggcagcagcaagtacggaagagggtgagccgggacacagacagggactgactagaggctcactgggaggccaccagagaggccaggacctgcctcacgggggggaaggaaaggtcacagcagtcagaggacccacagggctctgcagcatgggaggacgtggggcacaggcagtcagactggggcgcatccccgcagacccgcccccccaaccagacccaggaagccccggccaggcctgtggggggcgttaaccccgctctacagacggggaaaccaaggctaggagaactgtcacttgcccaagacagcaggctccggtgatggagccaggattccaaaccagaagtcccactcccaccagtccctaagcacatgaagtccaggctgagtttggggacagcc

SEQ ID NO: 31453 - DNA, 601 bp, Human
ggtcaccgtgtccttggagccaaggccccagtgggaggaatgagaaccgcttttgtttggaggggcagtcacgaggcgcatgaggcagccgcccagccctcaccgccctccgtctgtctgtccgtctgtctggcccaggcctacatgaacttttactacaaaagcactgagggctggagcattggcaacgtgctcctggacttcaccgggggcagcttcagcctcctgcagatgttcctccagtcctacaacaacggtgagtcagccagcgggctgctggccaccctgcggctggggcatygggcggggccagccttcccgggaccttccagccagggctccacccccacctgggatccaagccaatccagcccccaaggagagacccacctaggggccttcgtagctggaggctttgtggttttctgggacccccaccgcccaccaccccacaagctccagctgcctcaggagctgccaacctaacaccagcttctgtcccccggctgctaacagaccagtggacgctgatcttcggagacccaaccaagtttggactcggggtcttctccatcgtcttcgacgtcgtcttcttcatcca

SEQ ID NO: 31454 - DNA, 601 bp, Human
acatccagctgctccttacccagcatctggagtacaggacatagctctctcctgctaccagtctgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggkgggggtcccaggacgtgcctcatacatgacttgagcttgtcagtccactgagtttccttctacgagatcaacgcgaggggcctgtatcttgaattaaaacctactcgcttcctttctgcactctgtgtgctcgatacagaaggcaggtgtgctggccttcagagccaggtgccctgctcccctcgtgtaaggaagcgcataaggttgtgaaggtcactgacccgagagcgctgcgtgctgaccccacacttcactggggagccctcttgggtagcgcgagacgcctacccgcccagggcc

SEQ ID NO: 31455 - DNA, 601 bp, Human
tgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctaygagatcaacgcgaggggcctgtatcttgaattaaaacctactcgcttcctttctgcactctgtgtgctcgatacagaaggcaggtgtgctggccttcagagccaggtgccctgctcccctcgtgtaaggaagcgcataaggttgtgaaggtcactgacccgagagcgctgcgtgctgaccccacacttcactggggagccctcttgggtagcgcgagacgcctacccgcccagggccaggtcagtctcccaggctccgtgtcttcacggttaccagggcacgccactcaatctggatgtg

SEQ ID NO: 31456 - DNA, 601 bp, Human
ggaggtacagagagttgaagtggttattgttccaagccagcttctacattccccctaagggccaactttaagttccttgagtctcttaaagtctgcagacaggagagagggtgtgaggggtgtctgggatcctcctcccaggaaaggggctcaccttcacaatgacatccatggcattcttgtcttcctgcttgctttccccaaaggacctgacgttgaaggagcagatcctcatggccagggcgctgtggatggagaggaggagaagcagcagtggggccagctcccgtgacatcctggygctgctctggcttcaagactctgtgagaagacagcagtgcttggagtgctggattctggccacttccgcaggctccactgacttataaagcctgcagataacaggaattactggatttctccttgcaactttcagttctctgaggaactgaagatcatgggttttaatccccaaggaaatacagatacattgggctagcctttaaggagcccttatgttcgtcaccctggtgcagaaattggcatgcctcatttaggcgccatcctccacaaagtcactcatatcccaaccgggagccag

SEQ ID NO: 31457 - DNA, 601 bp, Human
aaggaaagagagagaaaggagctgggctttgctggtgaaaaggagtagctgtataaggttacttcatctttctttgttcatcacctctacatggggagtaatagtccctcttcataaagattatgaagtgaaaccatgtgcttatagtgcctgatacaggcattcaataaatagcaataaaaatcataatggctaacccttatctggaacgtataatgagccagatactacattaagagctttccatttgccaactcctgtagtccccccagcaaccctggagggaaccattgttatcacycctgttttaagatgacggcaggaggtacagagagttgaagtggttattgttccaagccagcttctacattccccctaagggccaactttaagttccttgagtctcttaaagtctgcagacaggagagagggtgtgaggggtgtctgggatcctcctcccaggaaaggggctcaccttcacaatgacatccatggcattcttgtcttcctgcttgctttccccaaaggacctgacgttgaaggagcagatcctcatggccagggcgctgtggatggagaggaggagaagcagcagtggggc

SEQ ID NO: 31458 - DNA, 601 bp, Human
actccagagaaagcaagcagtgtccccagacattgggtatatcacccaaggaaagcgtaagcgaaagtggaaggagtggggaagtagaggagagggagagaggaaggaaggaggagaagaagaaagaaagacaaagagagggagggatgatgaggatgggagagagaaggaaggaaggaaaaaagtaaggaagggaaaggaagaaagaaacaaagaaaaagagaaaggaagaagaaagaaaagacagaaagaagaaagaaaaaggaagaaagaaaaagaaagaaagaaagaaagagagaaagaaagaaaagaaagaaagaagaaaaggaaagagagagaaaggagctgggctttgctggtgaaaaggagtagctgtataaggttacttcatctttctttgttcatcacctctacatggggagtaatagtccctcttcataaagattatgaagtgaaaccatgtgcttatagtgcctgatacaggcattcaataaatagcaataaaaatcataatggctaacccttatctggaacgtataatgagccagatactacattaagagctttccatttgccaactcctgtagtccccccagcaacc

SEQ ID NO: 31459 - DNA, 601 bp, Human
ttgactccagagaaagcaagcagtgtccccagacattgggtatatcacccaaggaaagcgtaagcgaaagtggaaggagtggggaagtagaggagagggagagaggaaggaaggaggagaagaagaaagaaagacaaagagagggagggatgatgaggatgggagagagaaggaaggaaggaaaaaagtaaggaagggaaaggaagaaagaaacaaagaaaaagagaaaggaagaagaaagaaaagacagaaagaagaaagaaaaaggaagaaagaaaaagaaagaaagaaagaaagagagaaagaaagaaaagaaagaaagaagaaaaggaaagagagagaaaggagctgggctttgctggtgaaaaggagtagctgtataaggttacttcatctttctttgttcatcacctctacatggggagtaatagtccctcttcataaagattatgaagtgaaaccatgtgcttatagtgcctgatacaggcattcaataaatagcaataaaaatcataatggctaacccttatctggaacgtataatgagccagatactacattaagagctttccatttgccaactcctgtagtccccccagca

SEQ ID NO: 31460 - DNA, 601 bp, Human
gggtttcccattgaacaatcttgtcatggctcccacaggcttggcattgctatcctggctaaacaacaccatctagaaggccttggttacctcccaaagggcagggccacctgggtctgagaggctcgtccaaggaagaacagagcctgccagtcctcactccaatcctccttcccagtgacagcaacagcagcggctctggctcatggatacccaccttgctgcaggctctgctgggtgcctcaggcaccctgagttctcttcaccagccagtgctacaggtggtatttggatgtggtcrccattttactaggggagctggtggttcagggaggggcagggcctcccaagctcacaagtctggtaggtggaatctggacccagggctcctggcccccctaccacaccatggtgtctcaggtttcctaaggtaataagtacctttccagagtcccgggaaagggttaagttgccagcatcaaaaattaattaacctgtaggataaagggagtcaattgactccagagaaagcaagcagtgtccccagacattgggtatatcacccaaggaaagcgtaagcgaaagtggaaggagtggggaa

SEQ ID NO: 31461 - DNA, 601 bp, Human
tttcatcagtgaggaaggagatgggaactcagtggctacccaggctccacgggccatgtgtgaagtggggaaaatcattgccttgcatgtcagggtttcccattgaacaatcttgtcatggctcccacaggcttggcattgctatcctggctaaacaacaccatctagaaggccttggttacctcccaaagggcagggccacctgggtctgagaggctcgtccaaggaagaacagagcctgccagtcctcactccaatcctccttcccagtgacagcaacagcagcggctctggctcatgratacccaccttgctgcaggctctgctgggtgcctcaggcaccctgagttctcttcaccagccagtgctacaggtggtatttggatgtggtcgccattttactaggggagctggtggttcagggaggggcagggcctcccaagctcacaagtctggtaggtggaatctggacccagggctcctggcccccctaccacaccatggtgtctcaggtttcctaaggtaataagtacctttccagagtcccgggaaagggttaagttgccagcatcaaaaattaattaacctgtaggataaaggg

SEQ ID NO: 31462 - DNA, 601 bp, Human
gggatggcctcttggtaggatggggagggtgaggcagccttgacaaggacttcggacatgctctgcaggacacagctgctcaggggagatgcagagttcaagcccccatgatggactcaccaaggaacaaaaagacagccgggtttcatcagtgaggaaggagatgggaactcagtggctacccaggctccacgggccatgtgtgaagtggggaaaatcattgccttgcatgtcagggtttcccattgaacaatcttgtcatggctcccacaggcttggcattgctatcctggctaaacamcaccatctagaaggccttggttacctcccaaagggcagggccacctgggtctgagaggctcgtccaaggaagaacagagcctgccagtcctcactccaatcctccttcccagtgacagcaacagcagcggctctggctcatggatacccaccttgctgcaggctctgctgggtgcctcaggcaccctgagttctcttcaccagccagtgctacaggtggtatttggatgtggtcgccattttactaggggagctggtggttcagggaggggcagggcctcccaagctcacaagtctggta

SEQ ID NO: 31463 - DNA, 601 bp, Human
ggcagatcacctgaggtcaggagttcgagaccagcctggccaacatggtgaaacccgcctctactaaaaatacaaaaattagcacctataggaggtgcttggtcaatgggcgctagggataatcctattctgaatgcctggcattctcgggtgactgtgagtgccctgtagggtagctcttgcagtgttttggggatggcctcttggtaggatggggagggtgaggcagccttgacaaggacttcggacatgctctgcaggacacagctgctcaggggagatgcagagttcaagcccccaygatggactcaccaaggaacaaaaagacagccgggtttcatcagtgaggaaggagatgggaactcagtggctacccaggctccacgggccatgtgtgaagtggggaaaatcattgccttgcatgtcagggtttcccattgaacaatcttgtcatggctcccacaggcttggcattgctatcctggctaaacaacaccatctagaaggccttggttacctcccaaagggcagggccacctgggtctgagaggctcgtccaaggaagaacagagcctgccagtcctcactccaatcctccttc

SEQ ID NO: 31464 - DNA, 601 bp, Human
gcaaagataacagactggattagaaataaagaggtataattataatgataataattataaaagctgacatttactgcaaacctactccgagccttacaacaaccctgtggggtaactatgcttattagcccattaaacataggcagaaaccaagctcagagtggttgagtgactagcttaaagtcatacagccaggataggtggtagagtcaggatttgaacttaggtctgcgtgactacaaagcccaccatgttgaactgttaaaatacagtcccagccgggcacggtggcttacgcctrtaataccagcactttgggaggccaagatgggcagatcacctgaggtcaggagttcgagaccagcctggccaacatggtgaaacccgcctctactaaaaatacaaaaattagcacctataggaggtgcttggtcaatgggcgctagggataatcctattctgaatgcctggcattctcgggtgactgtgagtgccctgtagggtagctcttgcagtgttttggggatggcctcttggtaggatggggagggtgaggcagccttgacaaggacttcggacatgctctgcaggacacagctgc

SEQ ID NO: 31465 - DNA, 601 bp, Human
atttattaagcccttagtaagcaaagataacagactggattagaaataaagaggtataattataatgataataattataaaagctgacatttactgcaaacctactccgagccttacaacaaccctgtggggtaactatgcttattagcccattaaacataggcagaaaccaagctcagagtggttgagtgactagcttaaagtcatacagccaggataggtggtagagtcaggatttgaacttaggtctgcgtgactacaaagcccaccatgttgaactgttaaaatacagtcccagccrggcacggtggcttacgcctgtaataccagcactttgggaggccaagatgggcagatcacctgaggtcaggagttcgagaccagcctggccaacatggtgaaacccgcctctactaaaaatacaaaaattagcacctataggaggtgcttggtcaatgggcgctagggataatcctattctgaatgcctggcattctcgggtgactgtgagtgccctgtagggtagctcttgcagtgttttggggatggcctcttggtaggatggggagggtgaggcagccttgacaaggacttcggacat

SEQ ID NO: 31466 - DNA, 601 bp, Human
agagggcccacccttccccatgttacctgttcagcttctccatcagtatggggcagatcctgttgttgctgtccttgatttccatcacgagtatgatgtcacagcgtttgatgacctgcaagaaagagaattcccaggggtttgaggtcatttaccacagataaataaaaccttttattggacacttactgtttttaagtattgcactgagtgcttattaaaataatttcttctctgaactaaatgaaggactccctgaggtaggtaggtgcttttgttatgtacattttaaagaggagcrtgagactcagagaaagttgagtaaattacactcccaatcaccctactagaaaatggcggaggcagaatttgaacctatgtaattcaagcccagagccccttgctcatgacctccccacaatatcctgcctcttggctttgcttgaataattacaataataataataaatatttattaagcccttagtaagcaaagataacagactggattagaaataaagaggtataattataatgataataattataaaagctgacatttactgcaaacctactccgagccttacaacaaccctgtggg

SEQ ID NO: 31467 - DNA, 601 bp, Human
tggcttgtgggggataaagagacaaacaggcttggctctgcttggagtccgcgacagtctagataggttggggtgtgccaagaccactggtggtgaaaagactcgccccagactgactgtggaggagatgactggagcctacctgtcccctcagtcccccacaaacctgtcccctcagtctcccataaacctgactggggacactccaaggaaggctgagatgacaaagaatagagcactggctatgagatcagatgtgacgcaagttcaaaggtaggcttggccacttcctggctgggtractcaggcaggtcccccactcagttcccttactataagggaagcccttaggcagactgacatggattcttgcctgtccctacaattgtcctacacatgccttccctatgatggataagcccagagcctgggggatgatggcaccaggatctaccatctcatcttgctcctgcccaagacccagacatggcttttgttcaaaagtccctattaagtgtttcttgctgagatggccaggtgcagcggctcacacctgtaatcccagcactttgggaggctgagaggggcagatcacttgagg

SEQ ID NO: 31468 - DNA, 601 bp, Human
agcagaaggggtatttaggggccaacttagaccttacagaaattcctgggacttcagatgcagtatgctaaggcagacttagcccctggggccccaggagtgtgaacagtaggttctgccgggcttccactttggggagactggccctattttgaacatagcctgccaagtcctgagttagcaaactgcttgtggtgactcagttgcaaagtgactaaggcccatcctggcttgtgggggataaagagacaaacaggcttggctctgcttggagtccgcgacagtctagataggttggggwgtgccaagaccactggtggtgaaaagactcgccccagactgactgtggaggagatgactggagcctacctgtcccctcagtcccccacaaacctgtcccctcagtctcccataaacctgactggggacactccaaggaaggctgagatgacaaagaatagagcactggctatgagatcagatgtgacgcaagttcaaaggtaggcttggccacttcctggctgggtgactcaggcaggtcccccactcagttcccttactataagggaagcccttaggcagactgacatggattcttgcc

SEQ ID NO: 31469 - DNA, 601 bp, Human
atgcattttgattcaattcacgatttattggtggccatgttccagggagcataggtgatacttacttgtagagaaaggcatattgttctttatatgtgtttcttccaagccgagagctaatcacatagttgtacgttatgcctctccttgaatttctagaaaacaaagatttaacactgcatcttgaagagtaaacattcccctactgtacatgttcctttctttccaatctgcctccatacgcccaatggcatcatgtggaagggccactgttcatcataacctttgagtccaatgagargagccaccattgattggctggaatgtggcatctgccacgatctttacagccattatttcttgccttatgaggagagtgttatcattaccccctttctatggtttgcaagcccaaagctgggatttgaacctagatccaactcaccccaaaacccgcatgctttggcctgtacctgtgggaggccactgagaccctagaagacaatcttggccagaatcagcccctgaccccgctcatgcccatggctgcagctgcagctcatgctttctggtggaataaatgtcatcaggccacctgtcc

SEQ ID NO: 31470 - DNA, 601 bp, Human
ctggcctgccaaccatggagccaaccaacaaattaggtgtttggagaccccttgtgttttcagcttgaagagtcaatactttgcataggcccctagttttgacagcaattattttgatgaacactgagaattggttagaaatcaaaatttggttttgaagaaaagacatgcattttgattcaattcacgatttattggtggccatgttccagggagcataggtgatacttacttgtagagaaaggcatattgttctttatatgtgtttcttccaagccgagagctaatcacatagttgtaygttatgcctctccttgaatttctagaaaacaaagatttaacactgcatcttgaagagtaaacattcccctactgtacatgttcctttctttccaatctgcctccatacgcccaatggcatcatgtggaagggccactgttcatcataacctttgagtccaatgagaggagccaccattgattggctggaatgtggcatctgccacgatctttacagccattatttcttgccttatgaggagagtgttatcattaccccctttctatggtttgcaagcccaaagctgggatttgaacctag

SEQ ID NO: 31471 - DNA, 601 bp, Human
tgagcctatagggatggcaaatatgtgcccccttctgtgaaaacagcaccccaagttcctttgggagaccacccatccctcctccacctcaaactgagtttggggtggagctggggtggacacagatttagtcaatcagagtagctcaacaccctgatcacaatgattggttcagggatggacacctgacccagtcagagccaatgagactcagtcccacactatttgttgccttgtgggaaagaaaatttattttggtctggaggctgctggtggctgtcctgccatcccagggatggarccaacctgagaatggagccacacagaggaaagggcaaccaggagatagaaaggaagagacaaatcaagctctgattaccttgtctgagccctggatccagctatgcctgaagtactcctggacatttcagttacacaaaccaatcaattgctcctttttttcatgagccatgttaagattctgtcccttgcaactgaaacaatcctgactgctctatgccttacacttctcaattgcaaagtgggaatgagaaaggtactgtagctacctcaagggattattgggaggattaaataaact

SEQ ID NO: 31472 - DNA, 601 bp, Human
agaactcaagaggaggaagggggatcacaggagtcacattccgaaacgagaaaagagaaatacagaagaagaacccttgggtgcacttccatatttaccaagagctttcacagcccctcacagccacaagtggtctcttccaaaagtggaaagaactgagcctatagggatggcaaatatgtgcccccttctgtgaaaacagcaccccaagttcctttgggagaccacccatccctcctccacctcaaactgagtttggggtggagctggggtggacacagatttagtcaatcagagtagstcaacaccctgatcacaatgattggttcagggatggacacctgacccagtcagagccaatgagactcagtcccacactatttgttgccttgtgggaaagaaaatttattttggtctggaggctgctggtggctgtcctgccatcccagggatggagccaacctgagaatggagccacacagaggaaagggcaaccaggagatagaaaggaagagacaaatcaagctctgattaccttgtctgagccctggatccagctatgcctgaagtactcctggacatttcagttacacaaaccaat

SEQ ID NO: 31473 - DNA, 601 bp, Human
cagaactcaagaggaggaagggggatcacaggagtcacattccgaaacgagaaaagagaaatacagaagaagaacccttgggtgcacttccatatttaccaagagctttcacagcccctcacagccacaagtggtctcttccaaaagtggaaagaactgagcctatagggatggcaaatatgtgcccccttctgtgaaaacagcaccccaagttcctttgggagaccacccatccctcctccacctcaaactgagtttggggtggagctggggtggacacagatttagtcaatcagagtakctcaacaccctgatcacaatgattggttcagggatggacacctgacccagtcagagccaatgagactcagtcccacactatttgttgccttgtgggaaagaaaatttattttggtctggaggctgctggtggctgtcctgccatcccagggatggagccaacctgagaatggagccacacagaggaaagggcaaccaggagatagaaaggaagagacaaatcaagctctgattaccttgtctgagccctggatccagctatgcctgaagtactcctggacatttcagttacacaaaccaa

SEQ ID NO: 31474 - DNA, 601 bp, Human
tcccagctacttgggaggctgaggcaggaaaatcgcttgaacccgggaggcggaggttgcagtgagccaagatcctgccactgcactccagcctgggcgacagagcaggactctgtctcaaaaaaaagaaaaaaaagaggcacaagagttatacatgttgttatgagaaacaaaattcagagcatcaaaataagaaatgaatctttaaaatgtcacatgtaatcccaccatcctttgggatacatgtgtataaaatcaggatccttttagtaaacatctttttctaacctgttctaccccwgacctgatctactgtggccatgttgccttctgattcttctgtatcattttcaatcacttcccactcatttgccaggggagaagaatggcgctggagaagggacttgacctacccacgggcacacaactgccatgtgtaactgagtgagtggccatcgtccaggctttgctggaagtccttcaaaatagggggtctgggcacttagacccctgtaactccccgccttgggttcccactttgcagagtgataacttctgcaaaggaaacaccagcctcaaaagctccaagaggaacaggccg

SEQ ID NO: 31475 - DNA, 601 bp, Human
aggcattgagggtcaaggtctagtgcccaatgttgtgtcttcagtggtgacctcaaagggtggcatcaacccatctttttttttttttttttttgagacaggatctcactctgttgcccagcctggagtgcagtggtgcgatcttggctcactgcaacctccgcttcctggactcaagtgatcctcccacctcagcctcccaagtagctgggaccataggcatgcatcaccatgcccagctaatttttttgaatttttcatagagatggagtctcatcatgttgcccaagctaactcatcyttccaggacaatggcatagaaagacaagatggcaaccttacctcctcttcagtcagcttgtaagctttctggaagtcaaaaacactgtttgacttgggaacaacagaactgacgatttcttgtcctctaagcacaatcctggaacaaggggagggaaaacagttgtgttaatccaacctgtgattgctgagatcaaaccaaggtctgtgtttgctgtctggaattaaccgagcagtctggccctttcatgtggcgctcaaagtccagagctggttttagcctgtgaccctaaaggacagt

SEQ ID NO: 31476 - DNA, 601 bp, Human
ggagatgcctgggagatgctttcattttagcgatgagcaaatttaggaccagggaggggagaggaaatgcccgaagtcaccccacagaacacttactggtaagcgtcattccaagaccagctcgatcagaaattttggaggggcctcaaatcacagaatcataggcattgagggtcaaggtctagtgcccaatgttgtgtcttcagtggtgacctcaaagggtggcatcaacccatctttttttttttttttttttgagacaggatctcactctgttgcccagcctggagtgcagtggtgygatcttggctcactgcaacctccgcttcctggactcaagtgatcctcccacctcagcctcccaagtagctgggaccataggcatgcatcaccatgcccagctaatttttttgaatttttcatagagatggagtctcatcatgttgcccaagctaactcatctttccaggacaatggcatagaaagacaagatggcaaccttacctcctcttcagtcagcttgtaagctttctggaagtcaaaaacactgtttgacttgggaacaacagaactgacgatttcttgtcctctaagcacaatc

SEQ ID NO: 31477 - DNA, 601 bp, Human
catccagggcctataaggagaaaggggaggtagacatggaaattaggagatgcctgggagatgctttcattttagcgatgagcaaatttaggaccagggaggggagaggaaatgcccgaagtcaccccacagaacacttactggtaagcgtcattccaagaccagctcgatcagaaattttggaggggcctcaaatcacagaatcataggcattgagggtcaaggtctagtgcccaatgttgtgtcttcagtggtgacctcaaagggtggcatcaacccatctttttttttttttttttttgagacaggatctcactctgttgcccagcctggagtgcagtggtgcgatcttggctcactgcaacctccgcttcctggactcaagtgatcctcccacctcagcctcccaagtagctgggaccataggcatgcatcaccatgcccagctaatttttttgaatttttcatagagatggagtctcatcatgttgcccaagctaactcatctttccaggacaatggcatagaaagacaagatggcaaccttacctcctcttcagtcagcttgtaagctttctggaagtcaaaaacactgtttgac

SEQ ID NO: 31478 - DNA, 601 bp, Human
acagtgctatgggtgagcctgtgtacttccactcatgggtatcatgtgcccattcacaaacagttgatattcacacacacatagccccttgatctgtatcttcccacttgtgctaggtatgtagtacccagacctctgtctcagcttgaagaaagagcatgccaagaagttgtttggagtggtgggggattgcagccatttcccccttttaccaagggcagccaccacttggctcaaggcagccagatctgctggtgcctcaagagaggccagaaccagtcttctgtaaaatatcctgggkttttttttttttttttttgagacagagtcttgctctgttgcccagtctggggttcagtggtgtgatctctgctcgctgcaacctccgcctcccaggttcaagcaattattgtgcctcagccgcccaagtagctgggattacaggcatgcaccactacacccagctaattttttttttttttttttgagatggagtctcgctctgtcgcccagactggagtacagtggtgtgatctcagctcactgcagtctccgcctcccaggttcaagctattctcctgcctcagcctcccaagtagct

SEQ ID NO: 31479 - DNA, 601 bp, Human
tgagatggagtttcactcttattgcccaggctggagtgcaatggtgcaatcttggcttaccgcaacctccacctcccgggttcaagtgattctcctgcctcagccccctgagtagctgggattacaggcatgcgccacctcacccggctaattttgtatttttagtagagacggggtttgtccgtgttggtcaggctggtctcgaactcccgacctcaggtgatcgcctgccttggcctcccaaagtgctggcattacaggtgtgagccactgcgttggcctatgctttttttttttttttgtatgcctctcagaatgtttctttattatatatttatttttttttttttttgagacagggtttaacactgttggccaagctggagtacagtggtgagatcttggctcacttcttctcctgggctcaggcgatcctcccgccttagtctcctgagtagttaggacaacagatgcacaccatcatgccaggctaattttttatatttttggtagaggtagggtttcgccatcttgcccaggctggtttcgaactcctgagctcaagtgatctacccatcatggcctcccaaagtgctgggat

SEQ ID NO: 31480 - DNA, 601 bp, Human
tgctaccacgcccagctaatttttgtatacttagtacagatggggttttgccatgttggctaggctggtctagaactcctggcctcaagtgatccacccacctcggcctcccaaagtgctgggattgcagatgtgagccaccgcacccagcctcatctgtttgtctgtaatggttctttggtattggctgaatggatgggctgaaatttattcagtcatttaggtctattccagtctgaactgtcctgatttagaactgtgccattgaaatggagtaggtagaaggtatctgtaggatggkatcctagaaggggagttactggatcaaaggtgtggttcaggcagagtgtcaggcgacatcctcaagtctgagccccgcgcaggaactttggtagtcagctgggtggctgcgggcctgtttgtgcctcccctctcctggctctgaatgcctttccttctggtttccctcccagtgttgaacttgaccctcatcgacctcccgggtatcaccaaggtgcctgtgggcgaccagcctccagacatcgagtaccagatcaaggacatgatcctgcagttcatcagccgggagagcagcctcatt

SEQ ID NO: 31481 - DNA, 601 bp, Human
acagtggcacaatctcagctcactgcaacctccgcctcccaggttcaactgattctcctgccccagcttcctgagtagctgggattacaagtgggcaccaccacgcccagctagtttttgtatttttactagagacggggtttcactgtgttggccaagctggtctcaaactcctgacttcaggtgatccacttgccttggcctcccaaagtgctgggattacagccatgagccaccgcacccggcctattatgagcattttcaaacattcccaaaagtgtggaaaaaagttcaaagaatyctcgtggatggcttccccagcttcggtggttattattattattttcttcctggaatattttattttttcattttatttatttatttatttatttatttatttatttatttatgagacggagtctctgttgcccaggctggagtgcaatggtgcagtctgggctcactgcaacctccacctcccaggttcatgccattctcctgcctcagcctcccgagtagctgggattacaggtgccagccaccacgcgtggctaatttttgtatttttaattgagacagggtttcaccatgttggcca

SEQ ID NO: 31482 - DNA, 601 bp, Human
gaggtttggggaggatttgctggtgctagagaggaaagcagaccctacccaaccccacgccctactacagccaccccgacccggctgcccttggacactgttaggcctccatcttggatcctaagggcctttggggtctgtgggcactagccaggctgaggatttggtgatatgggcctcttccccttcctcctgactcactgatgtccacagctgcccttctctgccttccttcctgtttctaagaacgaaggcgcttccactctcagctcacttgtaggcctgctcccgttttgtgacmtcaggcttcagaagccctcccactggaccctttttcctggcgtactaatgactcacaactcctcctcctttacgggaacccaggctaggcgtggtgtctcatgcctataaccccaggattttggaaagcacagttgggaggatggcttgaggcccagagtttgagaccagcctgagcaacacagcaagaccccatctctctcttaaaaaattatccaggctgggcacagtggctcacgcctgtaatcccagcactttgggagaccaaggcgggtggatcaaaccccagctctactaaaaa

SEQ ID NO: 31483 - DNA, 601 bp, Human
tttggactttcttttcagttccattgatctctctggacatgaataccctgatgtacccaactgtttaaaatatactcgtttgatagtggattttagctcttccctattgctcttgtttttaagatgttatttcttttttttcttgtgagacaaggcctcgctctgttgcccgggctggagtgcagtggggtgattacagcttgctgcaacctcgaactcccaggctcaggtgatcctcccatctcagcctcccaggtagctgggactatacacgtgtgctaccacgcctcgctaatttttrtatatttttgtagagatggggttttgccatgttacccaggctggtctggaactcttgggctcaagcgttccacccgcctcggcctcccaaagtgttggaattacaggcgtgagccaccgcacctggccttgagattttttttctttttctttttctttttctttttctttttctctttttttttattcagagtcttgatctgtcacccaggctgaagtgtagttgcatgatcttggctcactgcaacctccgcctgccgggttcaagcggttctcctgcctcagcctcccgagtacctgg

SEQ ID NO: 31484 - DNA, 601 bp, Human
gcaacctcgaactcccaggctcaggtgatcctcccatctcagcctcccaggtagctgggactatacacgtgtgctaccacgcctcgctaatttttgtatatttttgtagagatggggttttgccatgttacccaggctggtctggaactcttgggctcaagcgttccacccgcctcggcctcccaaagtgttggaattacaggcgtgagccaccgcacctggccttgagattttttttctttttctttttctttttctttttctttttctctttttttttattcagagtcttgatctgtcrcccaggctgaagtgtagttgcatgatcttggctcactgcaacctccgcctgccgggttcaagcggttctcctgcctcagcctcccgagtacctgggactatagtcacgcgccaccatgcacggctaattttttgtatttttagtagaggcggggtttcaccatgctggccagggtggcctcgagctccttaccttgtgatctacccacctcagcctcccaaagtgatgggattacaggcgtgagccaccgctcccggccgagatttttttctcacctatctttgaatctcagcttgtaga

SEQ ID NO: 31485 - DNA, 601 bp, Human
ggcttcagtgagccatgttcatgccactgcactccagcctgggcaatagagtgagaccctgtttcaaaaacttaaataactaaataaaagaaatgtacttgattcagggtctggtgaagagcagatgttcagtgacttggtgctgctactattacaaccatcgctgttattattaccaaaattttaattatcattgtaattattcagtcatttacccagaagactgtatgcattgcctggggttggtgacagggggttaataactcttttttatttattattattattattattattattwtttttttttatttttggagacacagtctcactctgtcacctaggctagagtgcagtggcatgatcttggctcactgcaacctccacgtcccaggttcgagtgattctcctgcctcagcttcctgagtagctgggattacaggagtgtgccaccacacctggctaatttttgtatttttagtagagatggagtttcaccatgttggccaggctggtctcaaattctgagctcgagtgatccgcctgtgtcagcctcctgaagtgctgagattacaagcatgagccaccatgcctggcctat

SEQ ID NO: 31486 - DNA, 601 bp, Human
gagccatgttcatgccactgcactccagcctgggcaatagagtgagaccctgtttcaaaaacttaaataactaaataaaagaaatgtacttgattcagggtctggtgaagagcagatgttcagtgacttggtgctgctactattacaaccatcgctgttattattaccaaaattttaattatcattgtaattattcagtcatttacccagaagactgtatgcattgcctggggttggtgacagggggttaataactcttttttatttattattattattattattattattatttttttttatttttggagacacagtctcactctgtcacctaggctagagtgcagtggcatgatcttggctcactgcaacctccacgtcccaggttcgagtgattctcctgcctcagcttcctgagtagctgggattacaggagtgtgccaccacacctggctaatttttgtatttttagtagagatggagtttcaccatgttggccaggctggtctcaaattctgagctcgagtgatccgcctgtgtcagcctcctgaagtgctgagattacaagcatgagccaccatgcctggcctatcgttctctt

SEQ ID NO: 31487 - DNA, 601 bp, Human
gtgcagtggcatgatcttggctcactgcaacctccacgtcccaggttcgagtgattctcctgcctcagcttcctgagtagctgggattacaggagtgtgccaccacacctggctaatttttgtatttttagtagagatggagtttcaccatgttggccaggctggtctcaaattctgagctcgagtgatccgcctgtgtcagcctcctgaagtgctgagattacaagcatgagccaccatgcctggcctatcgttctcttcttgtaagtaattgattcacatggtgcataaacagaaatgrtattaaaagctatacagtgggccagtgtgtggtagcaggggcaagacgctcctcctcgctgttttctagcaccttccagggtggcagcagggcctcagcagcactccagcagtcatcttttcatgcacatatcagggggacacagtgtccacacgagagtaggttcctgtccttgtagaaggcataattctaatgggggagactgacacccaacaaaccgccagataaatgcacgatcaagaatccagtaggggcgcgggggccgggaaaagagccacccagagaaggcagctcaggaga

SEQ ID NO: 31488 - DNA, 601 bp, Human
ttctcttcttgtaagtaattgattcacatggtgcataaacagaaatgatattaaaagctatacagtgggccagtgtgtggtagcaggggcaagacgctcctcctcgctgttttctagcaccttccagggtggcagcagggcctcagcagcactccagcagtcatcttttcatgcacatatcagggggacacagtgtccacacgagagtaggttcctgtccttgtagaaggcataattctaatgggggagactgacacccaacaaaccgccagataaatgcacgatcaagaatccagtaggrgcgcgggggccgggaaaagagccacccagagaaggcagctcaggagagcaaagagggaagtcagtgtctagagggaggggccctccaggagaggaagctggggtgcttacaaacgggagtagggagaggaagggaagtaaaactccgcagctggctggggcctcctgagagccagcagtgaaaagtccagctggcctccagggagcctggagggggctcagcctccttccacgtggggtgcttcccagagcagcagcgccccttcctctccatttgctcatgacttaagtgccctagtat

SEQ ID NO: 31489 - DNA, 601 bp, Human
gggggctcagcctccttccacgtggggtgcttcccagagcagcagcgccccttcctctccatttgctcatgacttaagtgccctagtatcctgtcacagaccaagggaaggccagcgtagctccctgcctttctaggcagcccacatagacgggggtcgatggccagggctgcagggcagggacccctggtcacggaggtctttgggttaccccacttgctccatgccatagatgtgaggttccttcatgcctcttttctagctcgccagacactttgtatttattttttatttttttgawgattttttttttttttttttttttttgagacagagcctcactctgttgcccgggctggagtgcagtggcatgatctcagctcactccagcctccacctcccaggttcaagtgattctcatgcctcagcctcccaagtagctgggattacaggcgtgcgccaccacactcaactaacttctgtatttttagcagagacagggtttcaccatgttggccaggcttgtctcctaatctcaggtgatctgcccgccttagcctcccaaagtgctgggattacaggcgtgagccactgtacccat

SEQ ID NO: 31490 - DNA, 601 bp, Human
ctccagcctgggcatcagagtgagactctgtttaaaaaaaagaaaaaaggccaggcacggtggctcacgcctgtaatcctagcactttgggaggctgaggtgggtggatcaccaggtcaggagattgagaccacggtgaaaccctgtctctactcaacgtacaaaaaaattagccgggcgcggtggtgggcacctgtagtcccagctacacaggaggctgaggcaggagaatgacatgaacccaggaggcggagcttgcagtgagctgagatcacgccactgcactccagcctgggtgatygagcaagactgtctcaaaaaaaaaaaaaaaaaaaattgcaaaattatccaggcatggtggcacatgcctgtaatcccagctacttgggagactgaggcaagagaattgcttgaacccaggaggtggaggttgcggtgagccgagatcgtgccattgcactccagcctgggtgatagggcaagactccgtctccaaaaaaaaaagatgagtgttggccaggggtggtggcttacgcctgtaatcccaacattttgggaggccgaggcgggaggatcacttgaggtccggagttcaagacca

SEQ ID NO: 31491 - DNA, 601 bp, Human
aaaaaagaaaaaaggccaggcacggtggctcacgcctgtaatcctagcactttgggaggctgaggtgggtggatcaccaggtcaggagattgagaccacggtgaaaccctgtctctactcaacgtacaaaaaaattagccgggcgcggtggtgggcacctgtagtcccagctacacaggaggctgaggcaggagaatgacatgaacccaggaggcggagcttgcagtgagctgagatcacgccactgcactccagcctgggtgattgagcaagactgtctcaaaaaaaaaaaaaaaaaaaattgcaaaattatccaggcatggtggcacatgcctgtaatcccagctacttgggagactgaggcaagagaattgcttgaacccaggaggtggaggttgcggtgagccgagatcgtgccattgcactccagcctgggtgatagggcaagactccgtctccaaaaaaaaaagatgagtgttggccaggggtggtggcttacgcctgtaatcccaacattttgggaggccgaggcgggaggatcacttgaggtccggagttcaagaccagcctggccaacatggtgaaacccctgtctctactg

SEQ ID NO: 31492 - DNA, 601 bp, Human
ggcaagagaatcgcttgaagccaagaggcagaggttgcagtgagctgagaacgtgtcactgcatatcagcctgggcaacagagtaagactccgtctcaaaaaaaaaaaaaaaaaaagaagttgagtgtcaggcgaagacctgaagcaggtgagggcagggcaggagccgtgtgggattaagcccggccagtgcaaaggccctggggcaggactgggccgggcatgtcagaggaagaccctgtggctggatggagtgagtgaggggagtgggaggaggtgatagagcaggttgtgcagggcsttgtggggcctcagggaggacattggcttttgctgtgagtgaggtgggagccatggacagttctgagcgcaggagagtcaggactgactcaggtgctcacaggctccctagccgtggtgggagaagagacatgggagagcgggtgggagccagaccttggctaggttaggtccctctccagcttggcctcttaagatccaccccatgacttggttggtgcagctgcttagctgtgagattgggaagcaggtgtgcccccacaatcccaaattctcactcggggactcttctgcctctgac

SEQ ID NO: 31493 - DNA, 601 bp, Human
accctgtctctatgaaaaaatacaaaaattagccaggtgtggtggtgggcacctgtagtcccagctacttggaaggctaaagcaggacaatcacttgaacctgggagtcagaggttgcagtgagccaggatcacaccactgcactccagcctgggcagacagagcgagactgtatctcaaaaataaataagtaaataaataaataaataaatttaaatactacttgttaagcctatggcaggactgggccaggggatgcccatcacaaacagtccctgtcccccggggcttagcacgttaygtcatttgtaaccagttgccttgcagggccctccctgcccaggcactctcaccatggagaagcgccactgttatctgtgtctcctgtcaagagctgggccttcttgctttagcattttatctgagggtccaaggtcctcatgcagacatgggcggtctttctcggttcacgccttacaagagaacgggaattacggtaatagacttcccccagcctgaattctgcacttggcttttctcttcttgttaaagcaaagcctggagccttctgtctccgcctggtgcagcccacagactgttc

SEQ ID NO: 31494 - DNA, 601 bp, Human
ccaccacagcctcccgagtagctgggaataatacaggtatgcgccaccatgcctagctaatttttgtatttttgtagagacaaggtctcactatgttacctaggctgatcttaaactcctgacctcaagcaaaccgcctgcctgaactttccaactatgagatcgcagacgtgaaccaccacgcctggccttgtttttttaatttttatttattttattttattcttttgagacaaggtctcttgttctgttgcccaggctggagtgcactggtgcaatcatggctcactgaagcctggayctcctgggctcaagcaattcttctgcctcagccacctgagtagcctgatcctcaggcgtgcaccacagcacctggctaatttttaaagtatttctagagactggatctcactatgttgcccaggctgtctcaaactccttagctcaagcgatcctcctacctcagcttcccgaagtgatgggattacaggagtgcaccaccatgcccagcccaactccccctttttataaggacaccagttatattggctatgagcacaccctgtgatattctcttgactgattacatctgcagtgaccc

SEQ ID NO: 31495 - DNA, 601 bp, Human
gcatcctaaagtgctaatattgcaggcatgagccaccgcacccggccaataaaacattttaacttgtgtgaaaccaggtgtctttgcagaattaccattagtggcagcattttttctttttttgtgggcacacaaaataacagtgcattttaggatcagtgacttcttggaggtaatgagatctaaaaacatcttcagtctccacgaaggaggtagatgttgttaccctcaacccattttgtagatgaggaatcggaggctcagaggggcaaagtcctgtccaaggcctcacatcccatcratgggtcaggaccaaccccagcaggctgggaggtggcgggaacctatggaagccacctgaattgtggggaagtggctacctttccttcccagcatcctgtaaatcaagttgagcttcagggcagaggtgctgagctttgacccctgaacttcactcctgtcttctgcaaagtgggaggaataagtgggccttctcagatcgaatgggtgaataatcggaacaggcttagcttgagcctgactcgtagccagcatttgccattgggagctcttgaatttggtttatttgtcttaatataga

SEQ ID NO: 31496 - DNA, 601 bp, Human
ctcataggatggtccagcagtttggggtggattttgagaagaggatcgagggctcaggagatcaggtggacactctggagctctccgggggcgcccgaatcaatcgcatcttccacgagcggttcccatttgagctggtgaaggtagtgccccccggggctgggccctcccgtctctggtcaggcaccctcctgctggcctcaagccaggcctcctcccaggcaataaggtctcaagctcctacctctaggcctgaacttgtggtgggcagggtgtggcctggatgaggtgtccccatggscttccttttctgacactcagctttgaggttttgggcagaacaatatgaaaacccctgtgtttttcctctgacaaaagccaatatacattctttgcaaaatacatagaaaatacagataaatttacatgagaagatgtccctagcatgtcattgaagaaggaaaaaataggcattggagccagcatgtgcaacatagcactgagctgatatatacaacatccttatgtatgaaactgaacatggatgtctgtctacaagtgtttctttgtatttgcaaggatgtttgcaaaaatgtcagcc

SEQ ID NO: 31497 - DNA, 601 bp, Human
gtccagcagtttggggtggattttgagaagaggatcgagggctcaggagatcaggtggacactctggagctctccgggggcgcccgaatcaatcgcatcttccacgagcggttcccatttgagctggtgaaggtagtgccccccggggctgggccctcccgtctctggtcaggcaccctcctgctggcctcaagccaggcctcctcccaggcaataaggtctcaagctcctacctctaggcctgaacttgtggtgggcagggtgtggcctggatgaggtgtccccatgggcttccttttcygacactcagctttgaggttttgggcagaacaatatgaaaacccctgtgtttttcctctgacaaaagccaatatacattctttgcaaaatacatagaaaatacagataaatttacatgagaagatgtccctagcatgtcattgaagaaggaaaaaataggcattggagccagcatgtgcaacatagcactgagctgatatatacaacatccttatgtatgaaactgaacatggatgtctgtctacaagtgtttctttgtatttgcaaggatgtttgcaaaaatgtcagccctgggtgctag

SEQ ID NO: 31498 - DNA, 601 bp, Human
tatcgctttgtgtccgtgaacttggcctctccccagaggctggggcaggagcatgtaggcctgggcccaggcacacaggggagtgccaggcctcctggactggccagacagatgcacagttgtccctgggaccctgataccaagcctagcatgtgtctgatgaaattggggtttcactgggctgttgctttgctgcctcctgggaagcagagagggaccccccgcgtcaactgctggaggctgagctccttgaagctccctggctgtcaccccttcttgaccaatgcccggcattctcagrcttccctggagccaccgacttctctgtccctcagctccgggaatggcctgaatgccagcgacatcatgagagccagctggggtcctaagtgcccctgcccaccccctgcaccccacgctgtcccccaggggcagcccatttttggatccacttagtcacagtgcctctatgcgctctcgacgagccactgcctccactcagcaggacgcgccgggctcccccaacccgcgccaacgccgcgggcctggttcccagggcagcacgctttggccaagcagctgaaatgcctcccagtgggca

SEQ ID NO: 31499 - DNA, 601 bp, Human
ccaagcctagcatgtgtctgatgaaattggggtttcactgggctgttgctttgctgcctcctgggaagcagagagggaccccccgcgtcaactgctggaggctgagctccttgaagctccctggctgtcaccccttcttgaccaatgcccggcattctcagacttccctggagccaccgacttctctgtccctcagctccgggaatggcctgaatgccagcgacatcatgagagccagctggggtcctaagtgcccctgcccaccccctgcaccccacgctgtcccccaggggcagcccawttttggatccacttagtcacagtgcctctatgcgctctcgacgagccactgcctccactcagcaggacgcgccgggctcccccaacccgcgccaacgccgcgggcctggttcccagggcagcacgctttggccaagcagctgaaatgcctcccagtgggcagtctgtgcttgcgcgaccacagtgtccccagcgctccgggttgccagggaatttctgcttgagcccctctgttcttagtctggaaaagcccacatttgctgcttaagcttcttcgattagaaaagggagggggaaaaca

SEQ ID NO: 31500 - DNA, 601 bp, Human
gcacttagggaggctcaggcaggaggattgcttgagcccaggagttcgagaccaacgtgggcaacatagcaagaccttgtctctacgaaaacataaaaaaattagccaggcgtggtggcgcatgcctgtggtcccagttacttgggagggtgaggtgggaggatcccttgagcccacaagatcaaggcttcagtaagttatggtcgtgccatcgccctccagcctgggagacagagcgagaccccgtctcttaaaaaagaagcagcaaaggaaatccccaggccctggccaccaccagccygctccctatcctacagtccttcaagtggactcccacaacgtaaggcccattgactcttgactcccttcctgccacccttcttccctccctccctcccctcggcgtctgcatttgggagccaagcgtgttgtttgttgtatctgtagtttgctgccttgattactaagcaatcttccagggaatggatggagcacagcaaggacctccacttgcctgctggagggtgtttggggtgctttttgtgttgtggttttttgtttttttttttttttttgagacagagttttgctctgtcgccca

SEQ ID NO: 31501 - DNA, 601 bp, Human
agaagcagcaaaggaaatccccaggccctggccaccaccagcccgctccctatcctacagtccttcaagtggactcccacaacgtaaggcccattgactcttgactcccttcctgccacccttcttccctccctccctcccctcggcgtctgcatttgggagccaagcgtgttgtttgttgtatctgtagtttgctgccttgattactaagcaatcttccagggaatggatggagcacagcaaggacctccacttgcctgctggagggtgtttggggtgctttttgtgttgtggttttttgtttttttttttttttttgagacagagttttgctctgtcgcccaggctggggtgcagtggcacgatcttgactcactgccacctccacttcccaggttcaagtgattctcatgcctcagcctccgaagtagccaggactacaggcacatgccactttacccacctaatttttgtatttttagtagagagagattttcactatgttggccaggctggtcttgaactcctgacctcaggtgatctgcccgccttggcctcccaaagtgctgggattataggggtgagctaccacgcccagcct

SEQ ID NO: 31502 - DNA, 601 bp, Human
aaagacaagaaggatgagggagggagagtttcagcaagtgcagtggactcataagccctgctcctcacatgagacctttctagcttgatagcttgagcgtgtgtgtgtgtgcgcgcgtgcacgtgcacgtgtgtgttttattttagtgttcataattggacaaattagcttcgcagttttaatgcaacactttgaacacgccaggcgctaaagactttacaggctggacacggtggctcacgcctgtagtcctagcactttgggaggccaaggcaggtggattgcctgagctcaggagttmgagaccagcttgggcaacacggtgaaaacccgtctctactaaaatacaaaaaattagccaggtggtgtggcgtgcgcctgtggtctcagctactcggaagactgaggcaggagaattgcttgaacccaggaggcagaggttgcagtgagccgagattacgccattgcacgccagcctgggtaacacagtgagactctgtctcccaaaaaaaagaaaaagaaaaaaatacaaggcagtggcttgcagtggttcacacctgtaatcccagcactttgggaggccaaggtaggaggatcactt

SEQ ID NO: 31503 - DNA, 601 bp, Human
tcgcagttttaatgcaacactttgaacacgccaggcgctaaagactttacaggctggacacggtggctcacgcctgtagtcctagcactttgggaggccaaggcaggtggattgcctgagctcaggagttcgagaccagcttgggcaacacggtgaaaacccgtctctactaaaatacaaaaaattagccaggtggtgtggcgtgcgcctgtggtctcagctactcggaagactgaggcaggagaattgcttgaacccaggaggcagaggttgcagtgagccgagattacgccattgcacrccagcctgggtaacacagtgagactctgtctcccaaaaaaaagaaaaagaaaaaaatacaaggcagtggcttgcagtggttcacacctgtaatcccagcactttgggaggccaaggtaggaggatcacttgagcctaggagttcaggaccagtctgggcaacatagtgagaccccacctctacaaaaaaagaaaaatcagccaggtgtggtggcacatgcctgcgaccccagcatcttgggacgctgaggcagggggttgcttgagcccaggagtttgaggctatgattgttctactgca

SEQ ID NO: 31504 - DNA, 601 bp, Human
aaaaatacaaggcagtggcttgcagtggttcacacctgtaatcccagcactttgggaggccaaggtaggaggatcacttgagcctaggagttcaggaccagtctgggcaacatagtgagaccccacctctacaaaaaaagaaaaatcagccaggtgtggtggcacatgcctgcgaccccagcatcttgggacgctgaggcagggggttgcttgagcccaggagtttgaggctatgattgttctactgcactccagcctgggagacagtaagttcttttctcaaaaaaaaaaaaaaaaaaaagccaggcgcagtggctcatgcttgtaatcccagcactttgagaggccgaggcgggcggatcatgaggtcaggatttcgagaccagcctgaccaactcagtgaaaccctgtatctactaaaaatacaaaaattagctgggcgtggtggcaggcacctgtaatcccagctatttgggaggctgaggcaggagaatcgcttgaacccaggaggcagaggttgcagtgagccaagattgtcccactgcactccagcctgggcgacagagcaagactccgtctcgaagaaaaaaaaaaaaaaaac

SEQ ID NO: 31505 - DNA, 601 bp, Human
ctgcctggggtctccctagcttcaaggcatacactgtagatttaaaccagaaccttccgtggcacccagatgagggcccacatcggggagccctgatttcagcaggatgtcgattcagtgtgcgtggtctcaggcatcacccgctgattccttcagccccttggcatgcttaggcctcactcagattgttggagaggctcacgcaggccttcctgcctgaggcaggccgggtggtgccgctggtatgccctctcgctgggccctgtgatagagcagtgggcaaacccacacccagctcccyaccctcagaggaagaccacatgcagggaaccgatggggacccagggcgttaaggtgtagtgtgcttagtgctgggcggggccgtgcagggcttgtgggtgtccagagggcggccactgggccttgccttgaggggtcaggcaggcttcctaggggagggcctctagagccaaatctcaggctatggagtcaccagatacaacatttatcggtgcacctgacaaagctgattgaggatctgttccgtgctgggcaccaggtaggtgaggagaagggaggaaggaaaacgaaggaatgaggg

SEQ ID NO: 31506 - DNA, 601 bp, Human
gcaggtagaggtaagagagccagcggccaggccccatcgccaggagggccctgcaggtccaggggaggattttggattttcccccaagacaccaggatgcttctgattagatccaggcccaggagaggggccaccttgtgggctgctatttgagggagccctggcaaggatgggagccaggaggcccttaggaaatagcacctctggaacctcactgtcacccagccatcactgtggaggttggctcagctcagtgccacctccttcagatgctgttgatgaaaatccttcttgtgcttgratgttctgggcttcccattgccctccaaatgtatattataaacagggcccaagcctggcgcagtggctcatgcctgtaatcccaatactttgcaggaggccaaggtgggtcgattgctggagcccaggagtttgagaccagcctgggaaacatggtgaaaccctgtctctacaaaaaatacaaaaattaactgggcatggtggtggtgcgtaatctcagctacttaggaggctgaggtgggagaatgacctgagcccaggaagtcaaggctgtgctgagccatgatcacaccagggctct

SEQ ID NO: 31507 - DNA, 601 bp, Human
tgttgatgaaaatccttcttgtgcttgaatgttctgggcttcccattgccctccaaatgtatattataaacagggcccaagcctggcgcagtggctcatgcctgtaatcccaatactttgcaggaggccaaggtgggtcgattgctggagcccaggagtttgagaccagcctgggaaacatggtgaaaccctgtctctacaaaaaatacaaaaattaactgggcatggtggtggtgcgtaatctcagctacttaggaggctgaggtgggagaatgacctgagcccaggaagtcaaggctgygctgagccatgatcacaccagggctctccagcctgggtgacagagtgagactctgtctcaaaaataaataagtaaataaatagcccagataagaagccctataataaacttactgaatgttgggaatatcactggataaaattctgcctttgttcttagttttccagcctttcctgatctagaaacagaagcctactttctcccttatcctacagccaacttggactttaaaacaaaacccccgaggtagtcagcaaaggaaggtgaccaagctgacttgcttttccatattgttctgaa

SEQ ID NO: 31508 - DNA, 601 bp, Human
gaaaagacaagaaaatatgatggataagtaacaggagatatatgttgtttgcaagtggtgatatgattgtcagagtagaaaatatattagaaccgtaaggtggtggagtaggtgtccacatataaaatatagtgggatttgtctatgccggcatgaactagccaggaagtaggatggataaagaagaaaagagatctgggattgtggatgaataaggaaccttatagaaacacaccctgtcgaccttggatgtcctctaaatttgggtcaggagtcatgcaagatatgtgtcatttcatgrccagcagctgtcccacagtctgatgtctaagactggatggctctgtggttagagccacttacaggctggtgttgggatcaaatgatgagaagagtaggaagaagggccaggtgcagtggctcatgcctgtaatgccagcactttgggaggtggagccaggcagatcccttgagtctaggaatttaagaccagcctgggcaacacagtgaaacctcgtctctacaaaaaatcaaaaattagctgagcatggtggtatgcacctgtggttccagctactcgggagactgaggcaggggaact

SEQ ID NO: 31509 - DNA, 601 bp, Human
gaccatccggggcaatacaatgagacctcatcttaaaaattaataataggctgggcacgatagctcacacctgtaattctagcatgttaggaggctgaggcgggcggattgcctgagctcaggagtttgagaccagcctggctaacatggcaaaaaccccatctctactaaaaatacaaaaaattaaccaggcgtggtggcacgcgcctgtaatcccagctactcaggaggctgaggcaggaggattgcttgaaccttggaggcggaggttgcagtgagccaagattgcgccaccgcactscagtgtgggtgacagggccagactctgtctccaaaaataataataataaagatataaataagaatttttcccttgagcgggggtctgtgacctctttgagctttccaacacagccccagggattgggagcccctaggtgagagccgctggaaactacattgtcactagcagctcaggggagcttgggatagttgaagccccacacctggagaagccctgagccacaaagggttgtaccttgacatcttaacccagctagaggccttgtgaaatatgaacggctgtatcaatgcctgcctt

SEQ ID NO: 31510 - DNA, 601 bp, Human
tccggggcaatacaatgagacctcatcttaaaaattaataataggctgggcacgatagctcacacctgtaattctagcatgttaggaggctgaggcgggcggattgcctgagctcaggagtttgagaccagcctggctaacatggcaaaaaccccatctctactaaaaatacaaaaaattaaccaggcgtggtggcacgcgcctgtaatcccagctactcaggaggctgaggcaggaggattgcttgaaccttggaggcggaggttgcagtgagccaagattgcgccaccgcactccagtstgggtgacagggccagactctgtctccaaaaataataataataaagatataaataagaatttttcccttgagcgggggtctgtgacctctttgagctttccaacacagccccagggattgggagcccctaggtgagagccgctggaaactacattgtcactagcagctcaggggagcttgggatagttgaagccccacacctggagaagccctgagccacaaagggttgtaccttgacatcttaacccagctagaggccttgtgaaatatgaacggctgtatcaatgcctgccttcagta

SEQ ID NO: 31511 - DNA, 601 bp, Human
aacctgggaagcagaggttgcggtgagccaaaattgcgccattgcactccagcctgggcaacaagagtgaaagtgtgtctcaaagaaaaaaaaacaccagacaattgttgttaactatagtcttaactgcagtcaccctactcttctgttgaacaatagaagttaatgccttttctctaactgtatgtttgtacccattaaccccacctctctttaccccctacttgtccccacctttcccagcctctagtatttatccttctactctccacctctgtgagatccgctcttctaccttttwtttttttagctcccacgtatgagtgacaacatgcaagatctgtctttttgtgcctggcttatttcacttaacataatgacctccagttccattcatgttgctgcaaatgacaggatctcattcttttctatggccctgatcaacccgtttcttgcttaattctcttgacgtaaccatggcttagtggcctggaagggaagccacttctgtgtgatagcttgttgctactctgatgcggtccaggttggctttcaagagtccctggcaaagagagctgtgtttttctcattgtcctggttg

SEQ ID NO: 31512 - DNA, 601 bp, Human
ggtaactaccagcatcaagtcctcccagctcctctctgtaggagggaacctacccacctacccccagtgcacagaggaggagctggaggctgtgtcaggtgcagggccagctggccagtccccatggtccctgggatggcacagccaccaactcagtccaggcaacctcagtggagaggctggggttgcctgaggcccctggagccgccctgcctggctctcttccccttgggtttgggggaatgctctgtaggagtgccccccactggggacttgctggcacccaacccagccccaggayaggcaggactgggcttggaagtcccagacttagagagaaggcaggctggggggccccggctggccccagggagaagcaaagagaggcgggcctcttggctatggacccctgctctgtgctgggctcattggctaagagagcccactgaggccacacctgaggagaaccctactccccgtgaggaaaccctcacgcttgctattcgggtggctctgtggtcacccccatctaaggctctgagcggtgacttgccccacatcatggagcgggggagggtccccctggggtggaggcttcccc

SEQ ID NO: 31513 - DNA, 601 bp, Human
cccctggggtggaggcttccccagtgcacgtctgcgggcccatgctccctgacctgagggacaccccagcccgacatccgaacacctccgctgcagcccaggcctgatgtccccttgactgaggacattgggggtgaaaggatcatcccgctccacatgaggccagacgctcatctctggaatgttcctgaaacctcaggagccctgaggcttctgcgggactctggggcgctgtttctaaacccagggtggtggagtctgctgagccaccatacaagcatttctggggtccctgtggaascttccagaacctcagatccagcgaacctcatggggttgggatgtgggaggagtgtggagccaggcgtggtctgcagccttctccccgcctcaggcacctctaggaactcacgtgtccagatcggatggctcctcaaaatggctggggtggggtagggtgccctttctctttttctcccctctttccgccttgcagtgagaaaccagcctgcgctgtggtgtgtgggctgtcaggccggctgagagctggtgccctgcctttcagttcagggctgtggggaccttccagggtcccctgggt

SEQ ID NO: 31514 - DNA, 601 bp, Human
ggctggggtggggtagggtgccctttctctttttctcccctctttccgccttgcagtgagaaaccagcctgcgctgtggtgtgtgggctgtcaggccggctgagagctggtgccctgcctttcagttcagggctgtggggaccttccagggtcccctgggtgggaatgccaggcctggggcagcgagccttggaggagcctctgggcctgaacctcagcctggcagctctctgcctggcagcattgcaagtctagttttcagatctcctcttccttcacgtgaggggcccttcgtgttttyctcatctgagagttgaaagccagagcccccgaccctcccgtggagccccacactggagtctggagcagcagtgggagaagggccgggcgccggccgtaatgagaaacagccgacctgtgaaaggggccctgtgtgagccccagacacaaagcaggctccattcaggagggggcagccatggaacctgacccccgccaccacccaagttaggatcccagcagggacccttggagtcacacacgtggcagccacccctgaggaggaggccaccctcttagatgcctcagtgagacacaagac

SEQ ID NO: 31515 - DNA, 601 bp, Human
gggctttgggtcacagagacctggcctctgaagtcctgctgtggcttgcgctgcctgccgtgtggccttcggcagccagcttccctctctgagctaggagggatccgtgaactgagaccaagcagtgcatggcatgggtccccaagagctgctgctgtggcgggtgggcacacacatcactgggtgagtgtgggactccagggtgccacccccagctccgtgactcgccagccccttgcccctggccgaggggcccacctctgagctgcctccctagcagtctggacagccgtggctggcrcttggtgcttcctgaacagggccaaccttagaaagcaagtgatagggcaggtgcggtggtgcacacctgtaatcccagcactctgggaggctcgcttgaacccaggagtttaagaccagcctgggcaacatagcgagaccccatctctattaaaataatgataatgataataataaagaaagggagtaaggcttctgcagcacctggcccaggacctatccagccccaagatgtcctaaagcggccaaggttgaaatcccagccctgctcctctctgcctcagtcttcccctctgtaaaa

SEQ ID NO: 31516 - DNA, 601 bp, Human
ctcatgccaaagaccatcatgcacctcatgatcaacaatgtgagtggagaactaaaaatgagaaggaggtagctgggtgcggtggctcacgcctgtaatcccagcactttgggaggccaaggcgggcggatcacttgaggtcaggagttcaagaccagcctggccaaaacggtgaaaccccatctctactaaaaatacaaaaattaggctgggcgcggtggctcacacctgtaatcccagcactttgcgaggccaaggcgggcggatcacgagctaaggagttcgagactagactgaccarcatggtgaaaccccatctctactaaatatacaaaaattagccgggcacggtagctcacgcctgtaatcccagctactcaggaggctgaggcaggggaatcgcttgaacccaagaggcagaggttgtggtaagcctagagtgcaccactgcactccagcctgggcgacagagtgagactccgtctcaagaaaagagagagagagagagagaaaaatacaaaaagtagccgggcatggtggcgggtgcctgtaatccagctacccgggaagctgaggcaggacaattacttgaacctgggag

SEQ ID NO: 31517 - DNA, 601 bp, Human
tgtaacaggattagccgggcgcagtggctcactcacgcctgtaatcccagcactttgggaggccaaggcgggtggatcacctgaggtcaggagttaaagaccagcctggccaatatggtgaaaccccatctctgctaaaaatacaaaaattagccgggggttggggggcacgcctgtagtcccagctacttgggaggttgaggcacaagaattgcttggacccaggagacgcaggttgcagtgagccaagattgcactgcagcctgggtgacagagtgagactctgtcacaaaaaaataatgatataacaggattggctgggcgcggtggctcacgcctgtaatcccagcactttgggaggctgaggcaggcggatcataaggtcaggagatcgagaccatcctggctaacagggtgaaaccctgtctctactaaaaatacaaaaaataagctgggcgtggtggcaggcgcctgtagtcccagctacttgggagactgaggcaggagaatggcataaacccgggaggcggaggttgcagtgagctgagattgcaccactgcactccaacctgggcgacagtgagactgtctcaaaaaaaaa

SEQ ID NO: 31518 - DNA, 601 bp, Human
gttaaagaccagcctggccaatatggtgaaaccccatctctgctaaaaatacaaaaattagccgggggttggggggcacgcctgtagtcccagctacttgggaggttgaggcacaagaattgcttggacccaggagacgcaggttgcagtgagccaagattgcactgcagcctgggtgacagagtgagactctgtcacaaaaaaataaagatataacaggattggctgggcgcggtggctcacgcctgtaatcccagcactttgggaggctgaggcaggcggatcataaggtcaggagatygagaccatcctggctaacagggtgaaaccctgtctctactaaaaatacaaaaaataagctgggcgtggtggcaggcgcctgtagtcccagctacttgggagactgaggcaggagaatggcataaacccgggaggcggaggttgcagtgagctgagattgcaccactgcactccaacctgggcgacagtgagactgtctcaaaaaaaaaaaagcaaaaacaaaaaagatataacaggattattctgccaaggttaaggaaataaataaataagctaaaacaggagaaaagacatcaatgga

SEQ ID NO: 31519 - DNA, 601 bp, Human
ttgggaggctgaggcaggataattacttgaacccgggaggcggaggttgcagtgagctgaaattgagccactgtactccagcctgggtgacagagcaagactctttttcaaaaaagtctgggggtggccccgccctgtgagagatgtttttccagcagtcactgtgggttctgggttggggtgatacacaagcctgaccctccccaacccctgcccgcagacgaaggccttcatccaccacgagctgctggcctacctatactcctcggcagaccagagcagcctcatggaggagtcggcygaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacaggtccggaagcctggttcccctaccctcaagcattcggcctgcaggttcctgccctccctgtgtgtcctgcagggtcctggcaggaaacaggacacagcccaagggtggcacccagggctgggcactgtgggagctgctgccctgctga

SEQ ID NO: 31520 - DNA, 601 bp, Human
atccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccwgaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccag

SEQ ID NO: 31521 - DNA, 601 bp, Human
taacatgcttgaattccctaatcctttggttgttactcaccaggagagagaaaaggagctgcttacagaagatgctccctggggcagcagaggccagagccatcagaagcagtcccaatggccagggacggtggccagataacagggcagcctgggatgcacagagcggctaagaagacgctggcacttgcacagggtattctgctgccaccttgatgcagctgagcttggtttggaagacagtccggaggcaagtgataaacagtaggaggagcaacgggagaatttctttccccctataccctggccagtctccttccttccagttcaattacgtctaaatgcaaagaggctttcctacaagtgaggagggtggggtacaaaacaccccaaaacccagtcagtagctcctcctcacagcagctttcaaaatttctcttgccacttaacacataggcagaaggaggagggaacacccttcatcctcagccctcctccctttcccccaggttgatgctgtgaagtcctccccagttattacccactcccacagcctcccctccttcttggccttattaacctgtcttgccctcgggtacaa

SEQ ID NO: 31522 - DNA, 601 bp, Human
aatagcaccttacacagttacaaagctattaaaaacccaagtggaagccaagttgaggatattttcaatgacagtcacatttttgttatttttcttaaactattctttgcttaaactgcttcgtgggtaaaattcaaaatgtcctggataatttgcatgttcacccagaatcctttctctttttttgcagcttagtagaactcagcatgttaaataacatgagtttatgtaatcactggtagcagaagtaaacctcagaaacttctgggccaaatgcctaaagaatgaattcacttctctrctcttagaaaaacaccacagcaggatggaagagggattcccttgaaaaattttaacactctggcagtgggtgcttgagaagtaagctgaacactttccatcctgaatcccaagcctctcaactcttccctgaatcttcctcagatctgcttttgttttccccaatctctcttctctgcctcccatcctcactcctagtctctttcaagcccaaactgcagagaggaagcaggtagtaacatgcttgaattccctaatcctttggttgttactcaccaggagagagaaaaggagctgctta

SEQ ID NO: 31523 - DNA, 601 bp, Human
aagataaaaaatggttcacctatacagacgagctccattataatctatgggaccactcatatatgtagtccatcattgactgaggcattgttttgcagagcatgactgtatatgtgcgtgtgtgtatatatatataaatgtacatatatatatataaatatatgagacattcttatagttatatccacacttccactcccacccccatcttctttccttcttgtcctaggattccatgttgatggtcctccctctgcaggcagagccactgaaggtttccattcattaaatactattcccrtcttcaggttaaatcactgactaagtggcttagtgacacccttttagtcagtttcagagtcagaaataaataaacaggagatgaattgtccaagagatattagacagtacagggatcagaagcaaaagaaatgtgggtagaatcctttgaaacatttttaccacattttaccaaacttgtactaacttaagatggtatctgagttatcgtctccctaagcagttacaggatgagaaggtgaccatcaaccctgcattgtatattatttacatggagaaaatgtttgtcctcatacctgcc

SEQ ID NO: 31524 - DNA, 601 bp, Human
gggtttcaccttgttagccaggatggtctcgatctcctgacctcatgatccacccgcctcggcctcccaaagtgctgggattacaggcgtgagccaccgcgcccggcctactatgtggtttttatcccaaactttacaagagcagcctgcagctaaatgtgacaagttacagctatgaaactgttaatagtgtttctcacctttgcctacaagtgtttcagcctgaagatgagaaggaactcgaagataaactttctgacaagcatcgcaaagtaatgttaaaacctcaaaaaaaaaaaaagaaaaaatatcaggaattaaatttgatcacaaattttcacattgtagctttttcttattgataaaaatattgtcaattttggaaacaaattaatcatttaattctttacatttttaatactcactttaaaaggaaccagcaaagagaatagctttaggaatagcactgtcatttatttgtcaatgaaaaaaattaagtgaatagtagttcttagaacctaaatcatattgtgtcaatgcaagaaaatatttcacaaaccattgactttatatagaagttatacgtctctaagaccattca

SEQ ID NO: 31525 - DNA, 601 bp, Human
tagtaaacccgatgcgctgtggttattatcaaattacctcctttacagattcatatttaacacatttagtgtatttactatgtgtctttagagtgtggactgtttattaatttcaaaccttaaagcactgggcaaaacaacatctggcttggaaaggataccatttctgtattgtttgtaattttttacatgtgaatgcaaagccagtgaaaaaccttgatgaaaaaaattttacgtttgggctcagaacaaccaacttatacttcagagatggctatggtactaagacccaccaaaactktatttgattttcacaagctgttctgtgaaatatgtcacatttattcttggtggatacttgttcattgtaatcaacctcaagtacaaattttattgggggcatttagattttgagacatccatttcatgtctaatcaattgaagaatcttggctttgaaattttggcagcagattagtttatacaaattagaatatgctcctggttttggtgccttgctttgtttgacgtaatccaagataattgagccttctgatgtttgctaatttttttggcaagagaagtatacaactaactttggt

SEQ ID NO: 31526 - DNA, 601 bp, Human
gcgtgcacctgtaattccagcgactcaggaggcttagtcaggagaattgcttgaacctgggaggtgaaggttgcagtgagcagagatagcaccactgcacttcagcctgggcaacagagcaagactttgtctctaaataaataaataagaagaaaaccagtctattcttaagtaatatttcccagtaatattgcaaataatctttctgtaatatctttcaaggtttagtaaacccgatgcgctgtggttattatcaaattacctcctttacagattcatatttaacacatttagtgtattyactatgtgtctttagagtgtggactgtttattaatttcaaaccttaaagcactgggcaaaacaacatctggcttggaaaggataccatttctgtattgtttgtaattttttacatgtgaatgcaaagccagtgaaaaaccttgatgaaaaaaattttacgtttgggctcagaacaaccaacttatacttcagagatggctatggtactaagacccaccaaaactgtatttgattttcacaagctgttctgtgaaatatgtcacatttattcttggtggatacttgttcattgtaatcaac

SEQ ID NO: 31527 - DNA, 601 bp, Human
tcagcctggccaatatggtgaaactccatctctactaaaaatacaaaaattagccaagcatggtggcgtgcacctgtaattccagcgactcaggaggcttagtcaggagaattgcttgaacctgggaggtgaaggttgcagtgagcagagatagcaccactgcacttcagcctgggcaacagagcaagactttgtctctaaataaataaataagaagaaaaccagtctattcttaagtaatatttcccagtaatattgcaaataatctttctgtaatatctttcaaggtttagtaaacccratgcgctgtggttattatcaaattacctcctttacagattcatatttaacacatttagtgtatttactatgtgtctttagagtgtggactgtttattaatttcaaaccttaaagcactgggcaaaacaacatctggcttggaaaggataccatttctgtattgtttgtaattttttacatgtgaatgcaaagccagtgaaaaaccttgatgaaaaaaattttacgtttgggctcagaacaaccaacttatacttcagagatggctatggtactaagacccaccaaaactgtatttgattt

SEQ ID NO: 31528 - DNA, 601 bp, Human
tgatgtcagtaggttttgaactttttgcagtagtttgatacttaaaactatcttgccaaaaataagaaaactaagtggctcacacctgtaatcccagcagtttgggaggccgaggtgggaggatcacaaggtcgggagttctagatcagcctggccaatatggtgaaactccatctctactaaaaatacaaaaattagccaagcatggtggcgtgcacctgtaattccagcgactcaggaggcttagtcaggagaattgcttgaacctgggaggtgaaggttgcagtgagcagagatagcrccactgcacttcagcctgggcaacagagcaagactttgtctctaaataaataaataagaagaaaaccagtctattcttaagtaatatttcccagtaatattgcaaataatctttctgtaatatctttcaaggtttagtaaacccgatgcgctgtggttattatcaaattacctcctttacagattcatatttaacacatttagtgtatttactatgtgtctttagagtgtggactgtttattaatttcaaaccttaaagcactgggcaaaacaacatctggcttggaaaggataccattt

SEQ ID NO: 31529 - DNA, 601 bp, Human
ttgtgtgtgtataaatttatatatgtgtatacaaacttgattttttatgtcataagtggtataaccgtatgatgtcagtaggttttgaactttttgcagtagtttgatacttaaaactatcttgccaaaaataagaaaactaagtggctcacacctgtaatcccagcagtttgggaggccgaggtgggaggatcacaaggtcgggagttctagatcagcctggccaatatggtgaaactccatctctactaaaaatacaaaaattagccaagcatggtggcgtgcacctgtaattccagckactcaggaggcttagtcaggagaattgcttgaacctgggaggtgaaggttgcagtgagcagagatagcaccactgcacttcagcctgggcaacagagcaagactttgtctctaaataaataaataagaagaaaaccagtctattcttaagtaatatttcccagtaatattgcaaataatctttctgtaatatctttcaaggtttagtaaacccgatgcgctgtggttattatcaaattacctcctttacagattcatatttaacacatttagtgtatttactatgtgtctttagagtgtg

SEQ ID NO: 31530 - DNA, 601 bp, Human
tgaactcttaattattgtgtgtgtataaatttatatatgtgtatacaaacttgattttttatgtcataagtggtataaccgtatgatgtcagtaggttttgaactttttgcagtagtttgatacttaaaactatcttgccaaaaataagaaaactaagtggctcacacctgtaatcccagcagtttgggaggccgaggtgggaggatcacaaggtcgggagttctagatcagcctggccaatatggtgaaactccatctctactaaaaatacaaaaattagccaagcatggtggcgtgcayctgtaattccagcgactcaggaggcttagtcaggagaattgcttgaacctgggaggtgaaggttgcagtgagcagagatagcaccactgcacttcagcctgggcaacagagcaagactttgtctctaaataaataaataagaagaaaaccagtctattcttaagtaatatttcccagtaatattgcaaataatctttctgtaatatctttcaaggtttagtaaacccgatgcgctgtggttattatcaaattacctcctttacagattcatatttaacacatttagtgtatttactatgt

SEQ ID NO: 31531 - DNA, 601 bp, Human
aaataaaatattttcctagtgtcactgattttattctcttttctttgaactcttaattattgtgtgtgtataaatttatatatgtgtatacaaacttgattttttatgtcataagtggtataaccgtatgatgtcagtaggttttgaactttttgcagtagtttgatacttaaaactatcttgccaaaaataagaaaactaagtggctcacacctgtaatcccagcagtttgggaggccgaggtgggaggatcacaaggtcgggagttctagatcagcctggccaatatggtgaaactccrtctctactaaaaatacaaaaattagccaagcatggtggcgtgcacctgtaattccagcgactcaggaggcttagtcaggagaattgcttgaacctgggaggtgaaggttgcagtgagcagagatagcaccactgcacttcagcctgggcaacagagcaagactttgtctctaaataaataaataagaagaaaaccagtctattcttaagtaatatttcccagtaatattgcaaataatctttctgtaatatctttcaaggtttagtaaacccgatgcgctgtggttattatcaaattacc

SEQ ID NO: 31532 - DNA, 601 bp, Human
taatgcatgagaagcagaaaaagggaggttacatttggaatgtgctcagcacctgctattctaaaacgtgggggccatgaaaattaaataattatattaatggagtcacattttccactaccttcgtcatacattaatttgagaaataaaatattttcctagtgtcactgattttattctcttttctttgaactcttaattattgtgtgtgtataaatttatatatgtgtatacaaacttgattttttatgtcataagtggtataaccgtatgatgtcagtaggttttgaactttttgcartagtttgatacttaaaactatcttgccaaaaataagaaaactaagtggctcacacctgtaatcccagcagtttgggaggccgaggtgggaggatcacaaggtcgggagttctagatcagcctggccaatatggtgaaactccatctctactaaaaatacaaaaattagccaagcatggtggcgtgcacctgtaattccagcgactcaggaggcttagtcaggagaattgcttgaacctgggaggtgaaggttgcagtgagcagagatagcaccactgcacttcagcctgggcaacagagc

SEQ ID NO: 31533 - DNA, 601 bp, Human
gaatcacatttcgctgagttttagacccgcccctgtcttgtccttgctcctcaggttggtttgttcttattcccaaacttgaaatcactattagaaaactctgatattcttactttgctcctggtctacagagtcattcatctttataaaagtttgtaaatggctctgccactccttaaaagtctagtctttatttacactaattgtaagtggaaaagacaaatttgtcattcaatagcatagattttaacatgaaacacgttaaaacacatgaaacacgaaggactcccgtaagcatatkactgtgctaggctgcttaagcccttgccttataccttgttttctcttgctgacagtacaacttttatctcttgttgttcccgtctctgaccatctgaaaggaaaatggaaaaacttttcctttcagaagacaaaatgaggtcatgtgttgtgtaaattgagccatcttctagaattctgaaggcagggtcactggaccggattaggctggccgacttgagacactcctccagattcactgcagggaagaaatatcacagcagtttgtcagatgaaacaggagtggaacaagttttacagg

SEQ ID NO: 31534 - DNA, 601 bp, Human
ggagtaagctttaaacagtctcttctcctctttaaagagagactcaaacccgcaatcagtgggaagagagccgcacagggtggagcccacatctccagcctgaatcacatttcgctgagttttagacccgcccctgtcttgtccttgctcctcaggttggtttgttcttattcccaaacttgaaatcactattagaaaactctgatattcttactttgctcctggtctacagagtcattcatctttataaaagtttgtaaatggctctgccactccttaaaagtctagtctttatttacaytaattgtaagtggaaaagacaaatttgtcattcaatagcatagattttaacatgaaacacgttaaaacacatgaaacacgaaggactcccgtaagcatatgactgtgctaggctgcttaagcccttgccttataccttgttttctcttgctgacagtacaacttttatctcttgttgttcccgtctctgaccatctgaaaggaaaatggaaaaacttttcctttcagaagacaaaatgaggtcatgtgttgtgtaaattgagccatcttctagaattctgaaggcagggtcactggaccg

SEQ ID NO: 31535 - DNA, 601 bp, Human
gggagtaagctttaaacagtctcttctcctctttaaagagagactcaaacccgcaatcagtgggaagagagccgcacagggtggagcccacatctccagcctgaatcacatttcgctgagttttagacccgcccctgtcttgtccttgctcctcaggttggtttgttcttattcccaaacttgaaatcactattagaaaactctgatattcttactttgctcctggtctacagagtcattcatctttataaaagtttgtaaatggctctgccactccttaaaagtctagtctttatttacrctaattgtaagtggaaaagacaaatttgtcattcaatagcatagattttaacatgaaacacgttaaaacacatgaaacacgaaggactcccgtaagcatatgactgtgctaggctgcttaagcccttgccttataccttgttttctcttgctgacagtacaacttttatctcttgttgttcccgtctctgaccatctgaaaggaaaatggaaaaacttttcctttcagaagacaaaatgaggtcatgtgttgtgtaaattgagccatcttctagaattctgaaggcagggtcactggacc

SEQ ID NO: 31536 - DNA, 601 bp, Human
aagagagggcctgccctatagaatattctagtaagatgggagtaagctttaaacagtctcttctcctctttaaagagagactcaaacccgcaatcagtgggaagagagccgcacagggtggagcccacatctccagcctgaatcacatttcgctgagttttagacccgcccctgtcttgtccttgctcctcaggttggtttgttcttattcccaaacttgaaatcactattagaaaactctgatattcttactttgctcctggtctacagagtcattcatctttataaaagtttgtaaatrgctctgccactccttaaaagtctagtctttatttacactaattgtaagtggaaaagacaaatttgtcattcaatagcatagattttaacatgaaacacgttaaaacacatgaaacacgaaggactcccgtaagcatatgactgtgctaggctgcttaagcccttgccttataccttgttttctcttgctgacagtacaacttttatctcttgttgttcccgtctctgaccatctgaaaggaaaatggaaaaacttttcctttcagaagacaaaatgaggtcatgtgttgtgtaaattgag

SEQ ID NO: 31537 - DNA, 601 bp, Human
ttacaatgtggatataaaataacatttttaaagtcttaagcatattaagaggagttcatacaatcaaaaagaatttagttgggaaatcctctcctaaatagaatcatttattaagaaatggttttataagacgaaattcattgtggtgaatttgctgaaaatgagatgtgaattccagcaactttttcctccctgctttctgaactgatctctaccgctcagtgcaagaaaatgagcctagagttaaacattcaaatcaattctgtggattggccacacctccactctctgaagagagggsctgccctatagaatattctagtaagatgggagtaagctttaaacagtctcttctcctctttaaagagagactcaaacccgcaatcagtgggaagagagccgcacagggtggagcccacatctccagcctgaatcacatttcgctgagttttagacccgcccctgtcttgtccttgctcctcaggttggtttgttcttattcccaaacttgaaatcactattagaaaactctgatattcttactttgctcctggtctacagagtcattcatctttataaaagtttgtaaatggctctgcca

SEQ ID NO: 31538 - DNA, 601 bp, Human
attgcttatcattttttggaactgtgattattttacacatacatcaacaagcagatgtaagggttacacattacaatatcatggctagtcagcaaagcatttctattgataaaacacacacacacacctcagactacattatgttcccccgttctacctatttctctatttactcagttaaccaccaggaaatgtatagggcatttggaaagatgccactttgagaaagtataaactccccctaaaatagataattcattaataaatatttaaggatcaactttattccactaggactggyacaaccaaaatctgttaaaaccctcactccacaatacaatcatttatacatctatgtagacacaggtcagcatttgctcaagtatacttgattttatataatgtggggattttacaatgtggatataaaataacatttttaaagtcttaagcatattaagaggagttcatacaatcaaaaagaatttagttgggaaatcctctcctaaatagaatcatttattaagaaatggttttataagacgaaattcattgtggtgaatttgctgaaaatgagatgtgaattccagcaactttttcc

SEQ ID NO: 31539 - DNA, 601 bp, Human
agtaataatttaggaatagaacaaatacgtcatgatgaatattttcaacctaacctcttgtgatggtttatttttttaccactacccctctttcctactctcctattctttctttcttctgcttaggtgcccattatctgccatgttttccgaatttttatttgcattttgcattgtgcaaagccacaaattctgtcacttatttgatctcaacttttttgccatttgtatatctataaaacatgtagagtaatacacttttcaagttttatctatttattcttatcttcatataaataayagtaacagtttccgtgattttgaattctttggaattgaaaattatgtgataataaaactagaagtaaagcaacttttcttccacaattaattcctcaagaattagaaaattttggccgggcgcagtggctcacacctgtaatcccagcactttgggaggcctaggcaggtgaatcacctgagatcaggagttcaagaccaaactggtcaacatggcgaaaccttgtctctactaaaaatacaaaaattagctgggcgtggtggtgggtgtccgtaatcccagcaactcgggaggttgagg

SEQ ID NO: 31540 - DNA, 601 bp, Human
gaagggttctttgtccacgcctggcccacttatggaataaaagatggtgtaattctgtgcagcatcagattggatctgcagtaataatttaggaatagaacaaatacgtcatgatgaatattttcaacctaacctcttgtgatggtttatttttttaccactacccctctttcctactctcctattctttctttcttctgcttaggtgcccattatctgccatgttttccgaatttttatttgcattttgcattgtgcaaagccacaaattctgtcacttatttgatctcaacttttttgycatttgtatatctataaaacatgtagagtaatacacttttcaagttttatctatttattcttatcttcatataaataacagtaacagtttccgtgattttgaattctttggaattgaaaattatgtgataataaaactagaagtaaagcaacttttcttccacaattaattcctcaagaattagaaaattttggccgggcgcagtggctcacacctgtaatcccagcactttgggaggcctaggcaggtgaatcacctgagatcaggagttcaagaccaaactggtcaacatggcgaaac

SEQ ID NO: 31541 - DNA, 601 bp, Human
ctttaaattcagtaaaactctttgttatttctccaggattacagaccaaaatatatcctttaaaattccatcgttatattttctttacctcccccgccacttcccttattatatccactgtttttccccatcaatggtgaatagaaatttaaagtttatattgcatattaatatcttgaatattaaatcaaataattgattcttataatatgtaaacaagcatagttgaaaatattagtaagccagtaataaagatataattatgaataaatatttcaataatcctaccgcaaactgttcrtatttctcacggtcaatgctccttgtacaaaagatatccccagtgtctttctctatgtaaaacaaattgaagggttctttgtccacgcctggcccacttatggaataaaagatggtgtaattctgtgcagcatcagattggatctgcagtaataatttaggaatagaacaaatacgtcatgatgaatattttcaacctaacctcttgtgatggtttatttttttaccactacccctctttcctactctcctattctttctttcttctgcttaggtgcccattatctgccatgttttccga

SEQ ID NO: 31542 - DNA, 601 bp, Human
atactcttatatcattcaagacaataaatgcttaatcagttttattcaccaccattccaaaaacctactatgaatatctcatttcatcagatgagacatcagtccaccaaagagttatataaaattaacagaaacaaaaggatttaattatcagaagagttagaattgtcttgtctttgggtaggataagatagaatcaaatgaattgataaacttgttctgggttactaaggaagtaaaatggtactaagggatctcattgctgaagaatagtgagagaaagggatgcaaaaaaaaaaaagctatgtaaggggctaaggcagtggatccaacacttacacatttagaatcacgttggatgactggatctcatcccagaacaattaaatcagaatacttgggcatgggtccaagcatcagtattttttttcaagttctcacatgacttataatgtacagccatggttgagaataactgagtcattttattatggataactttaaattcagtaaaactctttgttatttctccaggattacagaccaaaatatatcctttaaaattccatcgttatattttctttacctcccccgccacttc

SEQ ID NO: 31543 - DNA, 601 bp, Human
agattgaagctaacttttccaaaggtacagattatccccaacactcagagagaaaggaagtttgcagctgctttcacagcatcacttggaattgttgaagaaagttcccttcttatataactattctttgaatatgtattgaattagacctatggctactactcccaaagctacgaaatcaaattatttcaaataaaaataatctattattaatacttaacatgaatatggcttatataaaatcaaagaattaggaaattccatgaaaattcccaggtttaaggacaaaattctagaacaygtgtattgttaaatctaccattagaatatcttcaacaacttttacagtttacatagtggtatcactggtattacggcatttaatgatcagaacactactgaggttgggaacacagctactagcagcccataaacaaagaagaaagcgaactctaggaggttgtgatttgtttgaggctacaaggaaaggaacagatacttaggatctaccaattcccagaaacatacattattcaatattttaaactattattaaagtatattacgttaaaaacatattatcttattttaacctctgcat

SEQ ID NO: 31544 - DNA, 601 bp, Human
gagatcggattactgcactccagcctgggagacagagtgacaccctatatcaaaaaaacaacaaaaaaaaacaagataataaaagatagtaaggttctggttgaataggaataggtaagaaaggagcagattgaagctaacttttccaaaggtacagattatccccaacactcagagagaaaggaagtttgcagctgctttcacagcatcacttggaattgttgaagaaagttcccttcttatataactattctttgaatatgtattgaattagacctatggctactactcccaaagctaygaaatcaaattatttcaaataaaaataatctattattaatacttaacatgaatatggcttatataaaatcaaagaattaggaaattccatgaaaattcccaggtttaaggacaaaattctagaacacgtgtattgttaaatctaccattagaatatcttcaacaacttttacagtttacatagtggtatcactggtattacggcatttaatgatcagaacactactgaggttgggaacacagctactagcagcccataaacaaagaagaaagcgaactctaggaggttgtgatttgtttg

SEQ ID NO: 31545 - DNA, 601 bp, Human
caggagaattgcttgaactcagaaggcagaggttgcagtgagccgagatcggattactgcactccagcctgggagacagagtgacaccctatatcaaaaaaacaacaaaaaaaaacaagataataaaagatagtaaggttctggttgaataggaataggtaagaaaggagcagattgaagctaacttttccaaaggtacagattatccccaacactcagagagaaaggaagtttgcagctgctttcacagcatcacttggaattgttgaagaaagttcccttcttatataactattctttkaatatgtattgaattagacctatggctactactcccaaagctacgaaatcaaattatttcaaataaaaataatctattattaatacttaacatgaatatggcttatataaaatcaaagaattaggaaattccatgaaaattcccaggtttaaggacaaaattctagaacacgtgtattgttaaatctaccattagaatatcttcaacaacttttacagtttacatagtggtatcactggtattacggcatttaatgatcagaacactactgaggttgggaacacagctactagcagccca

SEQ ID NO: 31546 - DNA, 601 bp, Human
tgggcgtggtggtgggcgcctgtaatcccagctactcgggaggttgaggcaggagaattgcttgaactcagaaggcagaggttgcagtgagccgagatcggattactgcactccagcctgggagacagagtgacaccctatatcaaaaaaacaacaaaaaaaaacaagataataaaagatagtaaggttctggttgaataggaataggtaagaaaggagcagattgaagctaacttttccaaaggtacagattatccccaacactcagagagaaaggaagtttgcagctgctttcacagcrtcacttggaattgttgaagaaagttcccttcttatataactattctttgaatatgtattgaattagacctatggctactactcccaaagctacgaaatcaaattatttcaaataaaaataatctattattaatacttaacatgaatatggcttatataaaatcaaagaattaggaaattccatgaaaattcccaggtttaaggacaaaattctagaacacgtgtattgttaaatctaccattagaatatcttcaacaacttttacagtttacatagtggtatcactggtattacggcatt

SEQ ID NO: 31547 - DNA, 601 bp, Human
cacacctgtaatcccagtactttgggaggccgaggtgggtgaatcacctgaggccaagagtttgagaccagcctggcgaacatggtggaaccctgtctctacgaaaaatacaaagattagctgggcgtggtggtgggcgcctgtaatcccagctactcgggaggttgaggcaggagaattgcttgaactcagaaggcagaggttgcagtgagccgagatcggattactgcactccagcctgggagacagagtgacaccctatatcaaaaaaacaacaaaaaaaaacaagataataaaagayagtaaggttctggttgaataggaataggtaagaaaggagcagattgaagctaacttttccaaaggtacagattatccccaacactcagagagaaaggaagtttgcagctgctttcacagcatcacttggaattgttgaagaaagttcccttcttatataactattctttgaatatgtattgaattagacctatggctactactcccaaagctacgaaatcaaattatttcaaataaaaataatctattattaatacttaacatgaatatggcttatataaaatcaaagaattaggaaatt

SEQ ID NO: 31548 - DNA, 601 bp, Human
gccgggcacagtggctcacacctgtaatcccagtactttgggaggccgaggtgggtgaatcacctgaggccaagagtttgagaccagcctggcgaacatggtggaaccctgtctctacgaaaaatacaaagattagctgggcgtggtggtgggcgcctgtaatcccagctactcgggaggttgaggcaggagaattgcttgaactcagaaggcagaggttgcagtgagccgagatcggattactgcactccagcctgggagacagagtgacaccctatatcaaaaaaacaacaaaaaaaaacaagataataaaagatagtaaggttctggttgaataggaataggtaagaaaggagcagattgaagctaacttttccaaaggtacagattatccccaacactcagagagaaaggaagtttgcagctgctttcacagcatcacttggaattgttgaagaaagttcccttcttatataactattctttgaatatgtattgaattagacctatggctactactcccaaagctacgaaatcaaattatttcaaataaaaataatctattattaatacttaacatgaatatggcttatataaaatc

SEQ ID NO: 31549 - DNA, 601 bp, Human
ttacaagaggccgggcacagtggctcacacctgtaatcccagtactttgggaggccgaggtgggtgaatcacctgaggccaagagtttgagaccagcctggcgaacatggtggaaccctgtctctacgaaaaatacaaagattagctgggcgtggtggtgggcgcctgtaatcccagctactcgggaggttgaggcaggagaattgcttgaactcagaaggcagaggttgcagtgagccgagatcggattactgcactccagcctgggagacagagtgacaccctatatcaaaaaaacaamaaaaaaaaacaagataataaaagatagtaaggttctggttgaataggaataggtaagaaaggagcagattgaagctaacttttccaaaggtacagattatccccaacactcagagagaaaggaagtttgcagctgctttcacagcatcacttggaattgttgaagaaagttcccttcttatataactattctttgaatatgtattgaattagacctatggctactactcccaaagctacgaaatcaaattatttcaaataaaaataatctattattaatacttaacatgaatatggctta

SEQ ID NO: 31550 - DNA, 601 bp, Human
ctgttttacttgttagaatgcatgtagattttccccaactatgtcattaacacgtgtttttaaagtttataaaaatacaattctatttatgtacagatgtatatatacatacaaataaatggacatcacaactatttcaggaactcaattatatgttttttacctatattttctcatttttctatggtaagcatgtatttctttgcaataaaaatgttaataaaagcatatacataccagaaattccatttcaaaatgaatgccttgtccccaacagccagtatgtatttaatgtcctttscctttaaactccaaattattcctacaccttccttatgtggtttgtgcatagtaagtgttcagcaaatagttgttgaatggattttcatccctcatgggaacaactaaacctacccaaagtgaattctgcattaactcagctttttaccacaactagctcttctaattttccctactgtaaccacttctaagtgaactaggattaaaattccaggcatcaaactcctccctctctctcataagccttagtagtcagttgccaagttctagagattttggcatttttgtgtgtgtcatgcat

SEQ ID NO: 31551 - DNA, 601 bp, Human
atacttacgaaatgtcaaatagtcttcttgtcatgctacaataaaatgtgaacttaccggatcggcaattttcaggcacagtaaagatagtcactctgtgttcaaaatatggggcgttatcattatcatcttcaattttgatgatcaaagggagtggatattctggtgcatagccatctgcagttgttgcatagccatataactgaaagaagggaaaataccatcaatgtattctcaaaccacaaattatgcacaaaagtaagcctagcagtgggggaaaatgtaacattaaaaaaaaaaatcattcccaaagacccgtaactaagaaatgatgcaatagagagataacccacagatgcagtctctgcctgccatgtgatttcaatcccctctcagcgttattgctcattattctcccactctaagcaccatgcactccagttgttctctgaattaactgtatgctgttttacttgttagaatgcatgtagattttccccaactatgtcattaacacgtgtttttaaagtttataaaaatacaattctatttatgtacagatgtatatatacatacaaataaatggacatcacaactattt

SEQ ID NO: 31552 - DNA, 601 bp, Human
agcaatatttccttcactccagactttctaagcatgcattggtaaaccaaacaccaacttcagcaacaaccccaccctggagagaatttagtcaaataaatgctgccagaattataaaatcatgatataaaagggaaaaatgtataatattttatcatatgaatatgcttaaatttaagaaagtgtgctcagagtcaattaccacccttaatagcaatgtcatataacatcaattcctaatgggaaaaaaagtgtatgtaatcagaaataccagaaaatgcataaaatgcaatgataaaaygtaaacatctttaattataatacttacgaaatgtcaaatagtcttcttgtcatgctacaataaaatgtgaacttaccggatcggcaattttcaggcacagtaaagatagtcactctgtgttcaaaatatggggcgttatcattatcatcttcaattttgatgatcaaagggagtggatattctggtgcatagccatctgcagttgttgcatagccatataactgaaagaagggaaaataccatcaatgtattctcaaaccacaaattatgcacaaaagtaagcctagcagtgggggaaaa

SEQ ID NO: 31553 - DNA, 601 bp, Human
aatgatccctggcccacgtgtaaatcccctgtaatattctctatggatttctgggtatagtcccttttatactgaacaacaacttttcctaatggcaaaattgagcaatatttccttcactccagactttctaagcatgcattggtaaaccaaacaccaacttcagcaacaaccccaccctggagagaatttagtcaaataaatgctgccagaattataaaatcatgatataaaagggaaaaatgtataatattttatcatatgaatatgcttaaatttaagaaagtgtgctcagagtcawttaccacccttaatagcaatgtcatataacatcaattcctaatgggaaaaaaagtgtatgtaatcagaaataccagaaaatgcataaaatgcaatgataaaacgtaaacatctttaattataatacttacgaaatgtcaaatagtcttcttgtcatgctacaataaaatgtgaacttaccggatcggcaattttcaggcacagtaaagatagtcactctgtgttcaaaatatggggcgttatcattatcatcttcaattttgatgatcaaagggagtggatattctggtgcatagccatc

SEQ ID NO: 31554 - DNA, 601 bp, Human
tgttggaagaaaaaatgatccctggcccacgtgtaaatcccctgtaatattctctatggatttctgggtatagtcccttttatactgaacaacaacttttcctaatggcaaaattgagcaatatttccttcactccagactttctaagcatgcattggtaaaccaaacaccaacttcagcaacaaccccaccctggagagaatttagtcaaataaatgctgccagaattataaaatcatgatataaaagggaaaaatgtataatattttatcatatgaatatgcttaaatttaagaaagtktgctcagagtcaattaccacccttaatagcaatgtcatataacatcaattcctaatgggaaaaaaagtgtatgtaatcagaaataccagaaaatgcataaaatgcaatgataaaacgtaaacatctttaattataatacttacgaaatgtcaaatagtcttcttgtcatgctacaataaaatgtgaacttaccggatcggcaattttcaggcacagtaaagatagtcactctgtgttcaaaatatggggcgttatcattatcatcttcaattttgatgatcaaagggagtggatattctg

SEQ ID NO: 31555 - DNA, 601 bp, Human
tccttaaatgacactttttaaaaaaccactgaatgaatgaatgaatgaatgaaaaaataacctcttactttgttggaagaaaaaatgatccctggcccacgtgtaaatcccctgtaatattctctatggatttctgggtatagtcccttttatactgaacaacaacttttcctaatggcaaaattgagcaatatttccttcactccagactttctaagcatgcattggtaaaccaaacaccaacttcagcaacaaccccaccctggagagaatttagtcaaataaatgctgccagaattayaaaatcatgatataaaagggaaaaatgtataatattttatcatatgaatatgcttaaatttaagaaagtgtgctcagagtcaattaccacccttaatagcaatgtcatataacatcaattcctaatgggaaaaaaagtgtatgtaatcagaaataccagaaaatgcataaaatgcaatgataaaacgtaaacatctttaattataatacttacgaaatgtcaaatagtcttcttgtcatgctacaataaaatgtgaacttaccggatcggcaattttcaggcacagtaaagatagtcact

SEQ ID NO: 31556 - DNA, 601 bp, Human
ccttccctcccaccttttggaatccccattgtttgttgttcccatttttgtgtctatgtgtacccaatgttcagctctcacttataagtgataacatgtggtatttagctttctgtttgtgtgttaatttgcttaggataatgacctccagttgcatctatgttgctgcaaaagacatgattttattcttttttatggctgcatagtattctatggcatttgtgtactacattttctttatccaatccaccattgaagggcacgtggattcatttcatgtctttgctattgtgaatggtgyggcaacaaacatacaagtgcaagtgtcttttggtagaatgatttgttttcccttgggtatatacctagtaatggcattgctggctcaaatagtagctctgtttttagttctttgagtaatctccaaactgctttccacaggggctgaactaatttacattctcaccaatggcatataagtgttcatggaccatttttgaatgggaccttctctgcataccttgcctcttttataacccaacttgataaagttaatcagaggaataccacatcttttcatgtaataacaaatattttatgc

SEQ ID NO: 31557 - DNA, 601 bp, Human
tttctctctaagttcacgggctatttttaaatttaacttaatttaattttagatttgggggtacacatgcgggtttgttacaggggtatattgtgcgataccgaggtttgggcttctaatgatcccaccacccccgtagtgaatgtggtaccgaatacgtagttttcagccccttccctcctccttccctcccaccttttggaatccccattgtttgttgttcccatttttgtgtctatgtgtacccaatgttcagctctcacttataagtgataacatgtggtatttagctttctgtttstgtgttaatttgcttaggataatgacctccagttgcatctatgttgctgcaaaagacatgattttattcttttttatggctgcatagtattctatggcatttgtgtactacattttctttatccaatccaccattgaagggcacgtggattcatttcatgtctttgctattgtgaatggtgtggcaacaaacatacaagtgcaagtgtcttttggtagaatgatttgttttcccttgggtatatacctagtaatggcattgctggctcaaatagtagctctgtttttagttctttgagta

SEQ ID NO: 31558 - DNA, 601 bp, Human
aaataatcctcaataggaggatttttagggcagtgaaaccactctggatgatactataatgatgaatgtgtgtctttacacattcgttcaaactcatagaatatatagcaccaagagtgaaccacaatgtgagaactatggactttaggtaataatgatgtgtaataatgatgtgtcaacataaatgtatcagttgtatcaaatataacaccgtggggcaggatgttgatagcagggaaggctatgtgtgttgggagggatagggagtatatgggaaccgtctgtattttctttttctttytttttttttttttttttgagacggagtctcgctctgtcacccaggctggggtgcagtggcgcgatctcggctcactgcaagctccgcctcccgggttcacgccattctcctgcctcagcctcctgagtagctgggactacaggcgcccgccaccaagcccggctaatttctttggatttttttggtagagacggcgtttcatggtgttagccaggatggtctccatctcctaacctcatgatccgcccgcctcaggctcccaaagtgctgggattacaggcgtgagccaccgcgcctggc

SEQ ID NO: 31559 - DNA, 601 bp, Human
aaatattattcagtgctaaaaagaaaagagctatcaagacttaaaaagacatgaaagaaatttaaaagcatattactaaatgaaagaagccaatcttaaaagcctacatactatatgatttcaactatatgacattctaaaaaagggcaaaatatagagacagtaaaaatatcagtggttgccaggaattaagagagaagaaggcatcaataggagaagcactacagaagcaaaataatcctcaataggaggatttttagggcagtgaaaccactctggatgatactataatgatgaatgygtgtctttacacattcgttcaaactcatagaatatatagcaccaagagtgaaccacaatgtgagaactatggactttaggtaataatgatgtgtaataatgatgtgtcaacataaatgtatcagttgtatcaaatataacaccgtggggcaggatgttgatagcagggaaggctatgtgtgttgggagggatagggagtatatgggaaccgtctgtattttctttttctttctttttttttttttttttgagacggagtctcgctctgtcacccaggctggggtgcagtggcgcgatctc

SEQ ID NO: 31560 - DNA, 601 bp, Human
acaatgaaatattattcagtgctaaaaagaaaagagctatcaagacttaaaaagacatgaaagaaatttaaaagcatattactaaatgaaagaagccaatcttaaaagcctacatactatatgatttcaactatatgacattctaaaaaagggcaaaatatagagacagtaaaaatatcagtggttgccaggaattaagagagaagaaggcatcaataggagaagcactacagaagcaaaataatcctcaataggaggatttttagggcagtgaaaccactctggatgatactataatgakgaatgtgtgtctttacacattcgttcaaactcatagaatatatagcaccaagagtgaaccacaatgtgagaactatggactttaggtaataatgatgtgtaataatgatgtgtcaacataaatgtatcagttgtatcaaatataacaccgtggggcaggatgttgatagcagggaaggctatgtgtgttgggagggatagggagtatatgggaaccgtctgtattttctttttctttctttttttttttttttttgagacggagtctcgctctgtcacccaggctggggtgcagtggcgc

SEQ ID NO: 31561 - DNA, 601 bp, Human
gtgatctcacagagctaccaaattctagacatgttttttgaaaaagtagataaatctagatgaatgaatagagaggtatactcacagaagtttctgtgaaagatggtggattgtcattttcatcctcaagtgaaatagtaattgttcctgtattaaataaaccgaaaggctgaccacccatgtctcgcacttccattattaactggtaagtatcacatttctgaaaaaaaggaaaaaactacattaatgaacacttttatttcctataacttgcaattctcacaaccacttgtttaggcaygattattgtacaaatattcttttttactttttcttttatatatttatttatttatttgagatggggtctcactgtcacccaggctggagtgcagtggcatgatcttggctcacagcaacctctgcctcccaggttcaagcaattctcctacctcagcttccagagtagctgggagtgcaggcgcccaccaccacacccagctaatctttgtatttttagtagagacagggttttactgtgttgcccaggctggtcacgaactcctgagcttaggcaatctgcctgcctcggcctcccaaa

SEQ ID NO: 31562 - DNA, 601 bp, Human
tttgtgatctcacagagctaccaaattctagacatgttttttgaaaaagtagataaatctagatgaatgaatagagaggtatactcacagaagtttctgtgaaagatggtggattgtcattttcatcctcaagtgaaatagtaattgttcctgtattaaataaaccgaaaggctgaccacccatgtctcgcacttccattattaactggtaagtatcacatttctgaaaaaaaggaaaaaactacattaatgaacacttttatttcctataacttgcaattctcacaaccacttgtttagrcacgattattgtacaaatattcttttttactttttcttttatatatttatttatttatttgagatggggtctcactgtcacccaggctggagtgcagtggcatgatcttggctcacagcaacctctgcctcccaggttcaagcaattctcctacctcagcttccagagtagctgggagtgcaggcgcccaccaccacacccagctaatctttgtatttttagtagagacagggttttactgtgttgcccaggctggtcacgaactcctgagcttaggcaatctgcctgcctcggcctccc

SEQ ID NO: 31563 - DNA, 601 bp, Human
aagatttaatgccaaggaatctggtagcagagcttaacaccaaaaaaataaaataaaataaaataaaagtttaacacatgagctacgtctagggctaagaagctcttcggtagccaagagcatggttatttccctagcatccagaaataactagtacttcaattatttgtacagaaatcatatttttctccctatgttatttgtaagtagtagttatttaaatcaaactgtcaaactttgtgatctcacagagctaccaaattctagacatgttttttgaaaaagtagataaatctagatsaatgaatagagaggtatactcacagaagtttctgtgaaagatggtggattgtcattttcatcctcaagtgaaatagtaattgttcctgtattaaataaaccgaaaggctgaccacccatgtctcgcacttccattattaactggtaagtatcacatttctgaaaaaaaggaaaaaactacattaatgaacacttttatttcctataacttgcaattctcacaaccacttgtttaggcacgattattgtacaaatattcttttttactttttcttttatatatttatttatttatttgaga

SEQ ID NO: 31564 - DNA, 601 bp, Human
ggtaagagaataagaaacaacaaagtttatataaaccaatataaatcatttggccttgcactgcagtagtctagtcatatacatataagaattatctcttaaaatcagtgcgtgagttaggatattttaaagcatagcctgattattttatttgtttaccttgacaacacacagcactccttcatttgtatttggatctgtgctaattatgaagtttccattttcatttccttgtaggattttgtatacagcctttgagtgaggagtgtttggcaaatcctgatcctgtaccttcattcgyaaaatctccacgtcaattctgttttcttctacttctgtaacatactgaaagaattgccccttattattatcaatttacaactttgacaatgtagctttatattctaaaacacgtatttaaagaaaaaaataaataaagtgatgtgaaaagctgccctcactatatggggaaacattttacaaatttaatgcgtagcttagttctttcctcctgaattgccttttcatatcttttccattcttcaaaggctaccccaagtcttatcttctgaacttctctgagataattttcctaatcatt

SEQ ID NO: 31565 - DNA, 601 bp, Human
ttcttcatatagagaacaatgagttttgtacctgacatgactttcttctaagagagaaaattagggtaagagaataagaaacaacaaagtttatataaaccaatataaatcatttggccttgcactgcagtagtctagtcatatacatataagaattatctcttaaaatcagtgcgtgagttaggatattttaaagcatagcctgattattttatttgtttaccttgacaacacacagcactccttcatttgtatttggatctgtgctaattatgaagtttccattttcatttccttgtargattttgtatacagcctttgagtgaggagtgtttggcaaatcctgatcctgtaccttcattcgtaaaatctccacgtcaattctgttttcttctacttctgtaacatactgaaagaattgccccttattattatcaatttacaactttgacaatgtagctttatattctaaaacacgtatttaaagaaaaaaataaataaagtgatgtgaaaagctgccctcactatatggggaaacattttacaaatttaatgcgtagcttagttctttcctcctgaattgccttttcatatcttttcc

SEQ ID NO: 31566 - DNA, 601 bp, Human
attcttccattttcttcttttgtgttcttataaaaaagaaatgtggacaagtaagtgtctaagaccccttctaaagcaaatatctggttcagtattcaatatttctctgtcttggttttcttcatatagagaacaatgagttttgtacctgacatgactttcttctaagagagaaaattagggtaagagaataagaaacaacaaagtttatataaaccaatataaatcatttggccttgcactgcagtagtctagtcatatacatataagaattatctcttaaaatcagtgcgtgagttargatattttaaagcatagcctgattattttatttgtttaccttgacaacacacagcactccttcatttgtatttggatctgtgctaattatgaagtttccattttcatttccttgtaggattttgtatacagcctttgagtgaggagtgtttggcaaatcctgatcctgtaccttcattcgtaaaatctccacgtcaattctgttttcttctacttctgtaacatactgaaagaattgccccttattattatcaatttacaactttgacaatgtagctttatattctaaaacacgtattta

SEQ ID NO: 31567 - DNA, 601 bp, Human
caaatagtgattcttccattttcttcttttgtgttcttataaaaaagaaatgtggacaagtaagtgtctaagaccccttctaaagcaaatatctggttcagtattcaatatttctctgtcttggttttcttcatatagagaacaatgagttttgtacctgacatgactttcttctaagagagaaaattagggtaagagaataagaaacaacaaagtttatataaaccaatataaatcatttggccttgcactgcagtagtctagtcatatacatataagaattatctcttaaaatcagtgygtgagttaggatattttaaagcatagcctgattattttatttgtttaccttgacaacacacagcactccttcatttgtatttggatctgtgctaattatgaagtttccattttcatttccttgtaggattttgtatacagcctttgagtgaggagtgtttggcaaatcctgatcctgtaccttcattcgtaaaatctccacgtcaattctgttttcttctacttctgtaacatactgaaagaattgccccttattattatcaatttacaactttgacaatgtagctttatattctaaaac

SEQ ID NO: 31568 - DNA, 601 bp, Human
tgaaaggagttgaaaagttgaggcttgatttcaaatagtgattcttccattttcttcttttgtgttcttataaaaaagaaatgtggacaagtaagtgtctaagaccccttctaaagcaaatatctggttcagtattcaatatttctctgtcttggttttcttcatatagagaacaatgagttttgtacctgacatgactttcttctaagagagaaaattagggtaagagaataagaaacaacaaagtttatataaaccaatataaatcatttggccttgcactgcagtagtctagtcatayacatataagaattatctcttaaaatcagtgcgtgagttaggatattttaaagcatagcctgattattttatttgtttaccttgacaacacacagcactccttcatttgtatttggatctgtgctaattatgaagtttccattttcatttccttgtaggattttgtatacagcctttgagtgaggagtgtttggcaaatcctgatcctgtaccttcattcgtaaaatctccacgtcaattctgttttcttctacttctgtaacatactgaaagaattgccccttattattatcaatttaca

SEQ ID NO: 31569 - DNA, 601 bp, Human
agtcaatgagagctatggatagatggactaaaaaagaattaggtccagttaaagtaatcatcctagaaaccagtaattgcaattaaatttaaaaaatccaaagcaatggctacctggaatatagggggattaatgggaaaagttgctgaatatttagttcaatagtctcttttacagaatacatcatagagaggtaaaaataaaatgtactatgaacatgaaaggagttgaaaagttgaggcttgatttcaaatagtgattcttccattttcttcttttgtgttcttataaaaaagaaatktggacaagtaagtgtctaagaccccttctaaagcaaatatctggttcagtattcaatatttctctgtcttggttttcttcatatagagaacaatgagttttgtacctgacatgactttcttctaagagagaaaattagggtaagagaataagaaacaacaaagtttatataaaccaatataaatcatttggccttgcactgcagtagtctagtcatatacatataagaattatctcttaaaatcagtgcgtgagttaggatattttaaagcatagcctgattattttatttgtttacctt

SEQ ID NO: 31570 - DNA, 601 bp, Human
tgaatgaagctatgcaagaagtcaatgagagctatggatagatggactaaaaaagaattaggtccagttaaagtaatcatcctagaaaccagtaattgcaattaaatttaaaaaatccaaagcaatggctacctggaatatagggggattaatgggaaaagttgctgaatatttagttcaatagtctcttttacagaatacatcatagagaggtaaaaataaaatgtactatgaacatgaaaggagttgaaaagttgaggcttgatttcaaatagtgattcttccattttcttcttttgtgttcttataaaaaagaaatgtggacaagtaagtgtctaagaccccttctaaagcaaatatctggttcagtattcaatatttctctgtcttggttttcttcatatagagaacaatgagttttgtacctgacatgactttcttctaagagagaaaattagggtaagagaataagaaacaacaaagtttatataaaccaatataaatcatttggccttgcactgcagtagtctagtcatatacatataagaattatctcttaaaatcagtgcgtgagttaggatattttaaagcatagcctgat

SEQ ID NO: 31571 - DNA, 601 bp, Human
gctattctcgtgatagtgaataagtctcgcaggagctgatagctttatcaggggtttctgcttttgcttctgcctcattcttctcttgctgccaccatgtgagaagtgccttttgcctccctccatgattctgaggcctccctagccatgtgaaactgtaagtccaattaaacctctttttgttcccagtttcggatatgtctttatcagccatgtgaaaacaaactaatacagtcctaaaatgaatagttagaaagaatcctaaaacaacatttaaatggtgaaaaaaatatcaaggggraaaaaacctaagaacaagaaaagaaaaagaaataaagaaagaaaaagtagacagtacaataattaaagaatattttctaaaaatcttatcaggagaacacaatgtctgcctgaaccttctgaggacttaaactgtctctaagaaattaatgaatgaagctatgcaagaagtcaatgagagctatggatagatggactaaaaaagaattaggtccagttaaagtaatcatcctagaaaccagtaattgcaattaaatttaaaaaatccaaagcaatggctacctggaatatagggggatta

SEQ ID NO: 31572 - DNA, 601 bp, Human
gaaagcgcttggtccttgatatggttggctatgtcccacccacatctcaacttgatttgtatctcccagaattcccacctgttgtgggagggacccagggcaaggtaattgaatcttgggggccagtctttcctgtgctattctcgtgatagtgaataagtctcgcaggagctgatagctttatcaggggtttctgcttttgcttctgcctcattcttctcttgctgccaccatgtgagaagtgccttttgcctccctccatgattctgaggcctccctagccatgtgaaactgtaagtcyaattaaacctctttttgttcccagtttcggatatgtctttatcagccatgtgaaaacaaactaatacagtcctaaaatgaatagttagaaagaatcctaaaacaacatttaaatggtgaaaaaaatatcaagggggaaaaaacctaagaacaagaaaagaaaaagaaataaagaaagaaaaagtagacagtacaataattaaagaatattttctaaaaatcttatcaggagaacacaatgtctgcctgaaccttctgaggacttaaactgtctctaagaaattaatgaatgaagctatgc

SEQ ID NO: 31573 - DNA, 601 bp, Human
gaggacattctttacagaattgattctaaaattgaccttggtaaaagattgcaaatcaccataaaagacttaagtcattgtttgaccattgctttataaaataggataaatgatttgttctccattaagagaagctcagaacaaacttactttgaacccaactgttttaggtgtgttgaaccctttcagcaagctcaaatcataatgtatctaaacctgtacttctgaaaaaaaacggtgatccttgagtatgccaccatttcctcagcagaaattaataatatatagatcatctttgaawccttagaccttaattttaattgtgatgtaattacatttaaatttattgtgatataattaagccttaagctttggccattcactacctcatagctttgcattatagatgcactgaagcctaaactgggtgatatccaataacatgaacaataaaaatgcaaacattgcttgaattatgttttgtctagaaataaacagatttcaccacaaggtttccttaaaaacatgtcgtatatttatattttatctgtagaaaatggcactcacctgcatccactgcaacaactgaaatattgtattg

SEQ ID NO: 31574 - DNA, 601 bp, Human
cattcttaatttccatgtcagcttgtctaatacttagaacttaatagacaaaccaccagttggggaataaatgagtaaacataaagtcttctttgccatcatagaaaaaagtaggggtataatatctgagaacacattgtttgcattttgttattaaaaaaaaaacaaagggacaaataaataagcatgaacattttcactactaccaacttatattaattaccatggaatttcatatgtatttattaatacagtcaaccattccttctaaagaaatgcaatagacacaggaaaaaaaaaacccatagcattgtatcagctagtttgttttgaacatccagcatatgcatgtaaaaagagtggaaaccttcttggattaggcaggtagtcaaacgaataggctatgttataaaagcccaagttcatttatctttattatttatggcaatttgccaaaatttatggtaaatttgtcatcaatatgataaaatggaagagtgtagcttctacttatatttttatcatcctcttttaatatgttttgtatatttttatgatgtatacattagtataatagtacatgtatataaaaatacatatg

SEQ ID NO: 31575 - DNA, 601 bp, Human
gcattttatttttaaaaaattaggcctctgcatttctgtaatctcttctctttcatccttaatctgagcaggtcttaactgatcgccacttctgataatattcatacattctttttgaggaaagttctcacatcatagaatctcttgtgaaactataataattctatagttgatatcgtgtaagaatttggccttatcttaacattcttaatttccatgtcagcttgtctaatacttagaacttaatagacaaaccaccagttggggaataaatgagtaaacataaagtcttctttgccawcatagaaaaaagtaggggtataatatctgagaacacattgtttgcattttgttattaaaaaaaaaacaaagggacaaataaataagcatgaacattttcactactaccaacttatattaattaccatggaatttcatatgtatttattaatacagtcaaccattccttctaaagaaatgcaatagacacaggaaaaaaaaaacccatagcattgtatcagctagtttgttttgaacatccagcatatgcatgtaaaaagagtggaaaccttcttggattaggcaggtagtcaaacgaata

SEQ ID NO: 31576 - DNA, 601 bp, Human
gaatttttgttgggccacattcaaagccacgctgggctgcatgctgcctgcaggccacaggttggacaagcttgtcttagaagatatcaaaaattacaagaggttgatggtaagtttttattttacccctgggaagaggtaaacagccaaaaataagtaattactgataatagctgagcatgatgaagtcattggtgtgtttatttacttctaaaatttactttaaattaagcacataagcaaacatcaagtataaatgagtaagaaacaccaatcacagagctagaaagtacatcttggrttaactaaaaatcttcataatacttcaacagcaattctggaaagcagtcgttttttattgctactcaaatgtttcagtaactagaatcactgtattataaatcagcctactctataaattttaaaattaattgttaaaagatttaaatttttaattattaagctacaatatgcctcctaatgatttcctgtaatttgttcatgttctttttggactatacatgcaaaatgtttgccacttgtacatgacaacccttaaatatttgttctcttaagaaaatccttcttacagaagggaaaa

SEQ ID NO: 31577 - DNA, 601 bp, Human
tctaacgtctcttgtacttttatccttcattctacactcagatggagttgaacagtcacatactctcactgttaacatatgtgttgcaactaaaccatgcctgtcttttatttgaataggcacagaataatagttataatcaagattttgccgttgacgaagaatggcagttttacctagggaaaaaaaagacagaatatatatggattggctgtttagatggcagtattattcctactcaatattctcagtggaagggaatcaatttagaataaaaactcgaatttttctttttttttttgaatttgtgatttcccagaagagccagaaaagtaattgatgttgctttatgctgatattaaactaatctgtacttaacatgttgctcaaatgttaattaaaaagggacttatatgttttcttaaaagatattcagaacaagagtctaagctcaccacaatggcactaattttttttaaagattaggtattgttgtttttagggttaataaaataatttcctaaaataaatgtgtatttattatgataaactaaggtgaaagaaccatcaccaatctgaagtccgtattgactataaaatt

SEQ ID NO: 31578 - DNA, 601 bp, Human
tactatttgtagcttagagagattaataatagctctcttcccaggtccagaattaacttatatgtgtcttttatttcttctacattgaaatggtaacttcatctaactgatatttaagatagcatcattagtagttaaaatcatacagaacacacttaaagggcttaaaataacaagactaagaacattaggcataaatacaaacaagaaaggcaattacataaaattggtgtctggtttcaaaaatgtacatcaactaataaagtgctaagaggaatatccaatttaatctgaaactcaratcaatgaattaggatacagtaaagattataggaaaagtttgtaaatgcaaatgggttctttggggtcagagggagagagaaagaaaaagaaaaggaaaagaagagagaaacagaaagaaagaaagagaaaaaggcagtcttaattaagcgtgggcaatatttctattacttttgtacctccaaataacagtttgcacaatgcaaaatcttagcatcctttgcctgtattgcttttcctcagtggctcatatgaccatttttcactcacggaagtcttacgatgatgctaaatcacttca

SEQ ID NO: 31579 - DNA, 601 bp, Human
ttggcagaagctaggagagagtcctggaacagatccctccccagttccttcagagggagcacggacctgccaacaccttgatctctgatttctagtctccagatctgtgaaacaatacttgtctgttgtttaagtcactcagtttgttgtgacagccctagccctgtagaattgggaggtttaaatgatttaaaacactgagggcacttgaaactctgcttagcatagtaagtgctcaataaacattagtgatattatcattgacattgttgagtaataatctgtcatcatttgttcaccrtacaattcaaagggatgtgaaatctgatttaccgttacttcttctccaggtccttcagtatttgatacaattaaattttgctgggctatgtcttctggaaaacatttcttgactgttctcttagcagtgacacagaaacatgtaaacagaatacctaaaaagcaaaaaagatcaaagtaaaacacagacattaaatcatttgattacatgattttttaaagtcttcttgcatatgtctcaaaaattcattccacaaattgagctcttcaggtcacaagatttaaaaacagaatattttaa

SEQ ID NO: 31580 - DNA, 601 bp, Human
ctcagggctgcaattctttcatggaaatcttctcatgtaatcttcataaaatctctgcccctcaatttgctatgagcttgttctggtccttatctttccaagaaccctagaagttggagtgacctaacaacaaatccacatgggcagaggtccagggactgagctctgaaggatcctgaaagaaaacaatgctgggagcactgctctgaggagtacaaaagtgtaaaagagaaatgaacttaatcacaaaactgaagattgcactgaagaatacttaaaagtcctttttaaaccactcagktggagagaatgcaattatctggcaccaactatgttctaagaacataattctccccaagattttgaagaacatatttaattcgtacatctacaatgcaaattcatctttcattggcctctataatacccagctttcccaaatgctcttccacagcacaaaaagtaacatcagtttgcaaataaaaggtgcaagaaggtgtacagtacagtcgtgaaaagggcaatatatacatgcatataaaagagaattaacaaacaaaaccttgatttctagagaacatggaagttataccagacaagg

SEQ ID NO: 31581 - DNA, 601 bp, Human
gaaaatgctatttaaatatatagtttctttttagattaataaaatatactatcctattaaaatgttatacattcaaaattatttctgaatgtgtgcgttcatttattcatcattctacaaatgtttggtaagtgttgctgtaattgatttcaattttttttttttttttttgagacggagtttcgctcttgttgcccaggctggagtgcagtggcaatctcggctcactgcaacctccgcctcctggattcaagcgattctcctgcctcagcctcctgagtagctgggattacagtcattmgccaccatgtccggctaatttcttatatttttagtagagtgggggtttctcatatacattctagtccctaattctgactgcccattttcttaaagtaactgtaaatttaggctgagtcttaagttctaatacagatggtaattcaatttctggcatattcaaggtgctagtctctgtatatcagagttgcagcctaatgcatcagggctagttgtccaaatgcttggagatggcaggtggcaaccacagataaggcaggcctatgtcaaactcaagagtgaatgtttttgctaaagtatt

SEQ ID NO: 31582 - DNA, 601 bp, Human
tcctgggctgccggggtcctgagtgttgagggcgggcgcagcctgcaggggagaacgggctcaggagtgtgtgtgcggaattgaggacgggggtgggagagggcctggaggactgccttgctgccctcccccagggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcgggtgaggggcggggctgggggtggggccggggctggcccacgaggaggggcgggatcttggggaagggcggggcggggtcgtggggaagggcgggggcgggcccatggggaggggcggggtcgtgggcggggacgggattggtaccgcagggagaacgggcggcgccctttgacccagctcctcacctctgtcgcagtggccccgaggttcgagtcttgctcttcaatgctaccggggaccgggacccggcggccctgctgaagctgctgcaggtgaggggccaacttgggggtgggcggcaggcagtcctgaagcc

SEQ ID NO: 31583 - DNA, 601 bp, Human
tggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcytggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatggcaaagccttcgactgacccttgaccccctgc

SEQ ID NO: 31584 - DNA, 601 bp, Human
caattctcaaaactaacttttaaaaagcttaaacttaacctaaaggattttaaatgaaaatataaactagaatgaacaaacatgagaaatatttctttgaatcagggagctagcacctttgagttttccaaaaaagcacgtctccccagtgtgttcactgtgatgtggtgtaaaagatccacatttaacatacttaaactacttaaacttagataacatcactctgaagtatactaccaaaatgttaattgagaaaagctgaaaatagttttagtttactcattatcacatgctagaagaraattttgcatgagaaaacactgaagaggtaattttttaatccagatttttcacaaactcatggtgcaaaatgggtcccccagcttcctctattataactgctcttaattgcttgttggctgcctgtgaaaatgattgaagtaactcaaatgttcctaacaaaactagtcatagccacccatgctgttctgcccactgtagccggccccgtaacagccactcactgactggctctccaggccactgtaagtggcctgggcagcagacacccccatgccttgcatcacctggctgctatacg

SEQ ID NO: 31585 - DNA, 601 bp, Human
agaataggatcccagagggatacgagcctaactctttataactctgggcttcctttcccaggcttctgtgttgggatcttccagttcccctccccatttgcaggctgtctccactaggagaaaaaacccaagggaaatgaggctggcccaagagcagcagtgatcgtgggtaggtctcagggaggatttctagtgggaatttcctaatgttccacccttgtgcactggagggtttccactgactttccacagctttcatttctttctcgtttgtaagcatgttgaggggagggaatggagyggagtgagtgaggtccaaggagggaagaatgagaaagactgtgtatcagtcttggggtgaacttcaaaacagcctgcgaggagagccattggtggctgcactggctacagctggggaagggatggtggaagtccttagggcagggagggctccattacccgcctgcccccctccccaaaaagcccccagtctattgatttcaggaaatcactagggggatctgggcctgggtctttggccccggggctgcccctgaggtgctgcacaccccagctggaggtgatggcaccaaaatatctg

SEQ ID NO: 31586 - DNA, 601 bp, Human
atttctagtgggaatttcctaatgttccacccttgtgcactggagggtttccactgactttccacagctttcatttctttctcgtttgtaagcatgttgaggggagggaatggagcggagtgagtgaggtccaaggagggaagaatgagaaagactgtgtatcagtcttggggtgaacttcaaaacagcctgcgaggagagccattggtggctgcactggctacagctggggaagggatggtggaagtccttagggcagggagggctccattacccgcctgcccccctccccaaaaagccmccagtctattgatttcaggaaatcactagggggatctgggcctgggtctttggccccggggctgcccctgaggtgctgcacaccccagctggaggtgatggcaccaaaatatctggtacctccttcccctgaaaatcatcgtggaacttgcacagttctatccagttcaggtacatcattccatttgaccctcacaactttctgagcctggggggcagttagggctgaatgtgttattcccagaaatagaggccaggcaacacgaagggactcgcccagggccccccagggctcggtgct

SEQ ID NO: 31587 - DNA, 601 bp, Human
ggaggcgtcgcgccgtgccctcgagagggacgacttcgagatcgtcgttatcctcgagggcatggtggaagccacgggtgcgagcaggcctggggaggggagcggggttggcagagggtgggcgggaccgaggaaggcaggggcgagactaggggccaggggagctggggaggatggatggaggggctggtggaggatgagacagtgaggtgagacaggggtcggaggcgggagtggaaccgagcaacgccgcagaaggccaagagaaagcttggaggaattctccgaaatggcactggcktggggccctgggcccagaggaatgtgtcacttggaatagggacagtaataatagctagtgctcgcccagtattcaccctgtgtcatgcgcagttccaaagcactttctacctctgagtcgatttaatcctaacaagaaccctctgaaggtaacttcttgttattgtgctcactttttagagatgagattgctccaatgagaaattaaggaagttgtccactttcctaagccaataagtggccatgcctggattggacacaggcaatgtggcttcaatgtttagtggtcccgagttggaag

SEQ ID NO: 31588 - DNA, 601 bp, Human
gagacaggggtcggaggcgggagtggaaccgagcaacgccgcagaaggccaagagaaagcttggaggaattctccgaaatggcactggcgtggggccctgggcccagaggaatgtgtcacttggaatagggacagtaataatagctagtgctcgcccagtattcaccctgtgtcatgcgcagttccaaagcactttctacctctgagtcgatttaatcctaacaagaaccctctgaaggtaacttcttgttattgtgctcactttttagagatgagattgctccaatgagaaattaaggawgttgtccactttcctaagccaataagtggccatgcctggattggacacaggcaatgtggcttcaatgtttagtggtcccgagttggaaggaggggttaggttcaggggttttctcactgcagtcaggttcaggcccctggaatttgacggtgaaggttttccattgcctgagttatttctaggccggatcttgaggggagtttaatacctagtctcacttgtacctcggtttcccaattcatccatttccactgacaagggatatagatgatgttaccttttctagctcttttccaaaag

SEQ ID NO: 31589 - DNA, 601 bp, Human
atcactgttcccattcctgcttcaccccgactctttcctcttcccccactcaccccgttccctttcctctctctccagctgtcactccttttctgccagtatctcaggcaggcccctcaccctccagggaagttgctgcccggccctcttttctctttgtacccccagccctgccctctcctcctcgaagcccttctctccccagtgtcccttatgcctctttctcttctctcccactggatactttctattccaacttcaccgaggaataccaatgtctcagcgccaggctttccgagttgacagccactctccggttagctaatgttcactcttctgtttccccttgttccgagatggatatgggttgggggcaagaccctgtggcagaaaggagaatgacctgccctgaggggtgcaccagcccaacaggaagataggacacaagccccgggcagggaggaccaggacagaggagatgaggataggaatctgtctgtttttctagagagataaagctggaaaggatggtaatattttgggtgagacagtcaggattcaaaacgcttttgaaaagcaagaataatgagccaaaacccag

SEQ ID NO: 31590 - DNA, 601 bp, Human
accagtagacaactggtccactcagggctgccactaacctgtagaacacccctgtgcaaattttaaaaaggaacccttttcctccagacagatacagccccaaaccagggtgcatggcttggggagcagagtataggatggattgcagtccccagtcacctcttctgccagcctccccacatatggcacaactgtctaatgacacggtaggccaagctgaagtgaaggagaaaggagccggaccaagatgggcacatgaggagggtgccctcctagctccaccctcaccaggatgaaggcrtgcaaggggctcagcaaggtgtgaatgaccttagtccgcaagttcagggaagcaggcagagcggggaggtgcctgagctggggcctggagaggggcctgggaaaggaaaaccagggatagctattttcttacagtggagtgagatcttacaggtatcaggcacaggcaggaagagagagagagaggttctggggaggaagggccaggagagagatctagaaagtgggttcactagagctgggaaacagggagcccctaggaaagcagtgtgtccttggggcacagtcattcacatcactg

SEQ ID NO: 31591 - DNA, 601 bp, Human
agcggggaggtgcctgagctggggcctggagaggggcctgggaaaggaaaaccagggatagctattttcttacagtggagtgagatcttacaggtatcaggcacaggcaggaagagagagagagaggttctggggaggaagggccaggagagagatctagaaagtgggttcactagagctgggaaacagggagcccctaggaaagcagtgtgtccttggggcacagtcattcacatcactgattgggtgccatgtggagtggacattcaaaaacctggttcctgtcctcaaaataaggggyacctgggaaaacagaggaatctacctgtggtgactgaacgagggataattcaaactgacaacctgtgcagtcccgtggagggtaggggagtgtgggtgatcagaaggctggggccagtgtaaggcatagggaatatgtaagtcaggagttagaaatctccagtgtgcgttggaatcacctggagggcttggtaaaacacagatttttgggctccactccaagggtttctgacccaagaggtggggaccaaaaccatgcattcctaagaagtccccaggtcatgctgctgttgctggactg

SEQ ID NO: 31592 - DNA, 601 bp, Human
tgttaaaatcttttcaattattataaaaatttagtagcatgtaaatatagccccaaaatggttgctataataatccccatttcatactgggtctgccttaacaggaaaagctattaggagtctttatagtaatttatctaatgtgaaaaggaaatggccttataatagtttccattgccttgtaatttttttccatttttttctttttatagaaaaaatataatattttggggagagtgaccatgactaatagcagtggaaaggagacaaaacctttgtgaacagtgtaactttacattcrtcagggatgacaaactataggacatgatgcctagaagaatcatcatcaggaagcccataaatttgtgttccctcaatgtttcagtaaaaaccaattagaaggtctcaactgaaattagtaattaatccatttatgtgactagataaaacacagaatagggatgattcaaaagcttcattaatttgtttcacaccaacattcacaattggtaagaaaaataagaagtaatcaactgcatgcaccaaaaaccccaagacagaaatcttaggtattcagtttctttttcacaggcattgctag

SEQ ID NO: 31593 - DNA, 601 bp, Human
acaccaaattttccttccttcttctactagttattttgtttctttacctttttaaacagaaaccttgtatctctctcaaaagatcaaatacctagaagtatagtaaaactataacctaataggttaatatgcaggtagatcataatagtaaaacagaaactactgaaaaattctagacccaaagtgctatataacagactataattttagaaacgtatgttaaatgtgtaaagataaaaaatattttacaaaaacctgaattaaagcattaacataattttcatattactttttcaaaaaacaaagtggacaactagaaagattttgatttctaggtaggcaacactgaagttactacaccacttattccattaaaagcccttctacatgttaatcattttcaatataacaagtgcataaactctaaatttggggtgaaattacattccctcacaattttaggtgactttcaaagacacagcacaaaagaaggagcagagcagacaacagagtcagaattggctcaaattcccggttccgaacaccattagctgggtaaacttggataatagagctgaaatttggtaactcctctataaaa

SEQ ID NO: 31594 - DNA, 601 bp, Human
aatattttacaaaaacctgaattaaagcattaacataattttcatattactttttcaaaaaacaaagtggacaactagaaagattttgatttctaggtaggcaacactgaagttactacaccacttattccattaaaagcccttctacatgttaatcattttcaatataacaagtgcataaactctaaatttggggtgaaattacattccctcacaattttaggtgactttcaaagacacagcacaaaagaaggagcagagcagacaacagagtcagaattggctcaaattcccggttccraacaccattagctgggtaaacttggataatagagctgaaatttggtaactcctctataaaaatactaccactaccacccacccaaatgtcttttcctctattactagactatacagtaaacatgctgtaacaatgttcttaaataaaatgttaaacttcttataactaggctaactcgttattatatgacatagccactgagtgattcatttgcttaatatgtagtttttggaaaactaaaccctcaaagaaatagaatataaaatagcataataatgattattttaatagttttatgca

SEQ ID NO: 31595 - DNA, 601 bp, Human
agagtcagaattggctcaaattcccggttccgaacaccattagctgggtaaacttggataatagagctgaaatttggtaactcctctataaaaatactaccactaccacccacccaaatgtcttttcctctattactagactatacagtaaacatgctgtaacaatgttcttaaataaaatgttaaacttcttataactaggctaactcgttattatatgacatagccactgagtgattcatttgcttaatatgtagtttttggaaaactaaaccctcaaagaaatagaatataaaatagyataataatgattattttaatagttttatgcagctttgtcagatttaagagaactgtaatgcccaaattcttcaatctttcaaaacttttattttttaaaatatataatgccactgtttatccaatccaagcaattctatgctatacacacgattgtttttaagactgttaaagtgacaccatctcaaatcatcttttcatattcttttttatggttttcttttttaatgatgtatctaaaaagtttaaagtcttgcttttgtagaatagtcaagagtacagaaggctgtggagtcaaaca

SEQ ID NO: 31596 - DNA, 601 bp, Human
ctgtaacaatgttcttaaataaaatgttaaacttcttataactaggctaactcgttattatatgacatagccactgagtgattcatttgcttaatatgtagtttttggaaaactaaaccctcaaagaaatagaatataaaatagcataataatgattattttaatagttttatgcagctttgtcagatttaagagaactgtaatgcccaaattcttcaatctttcaaaacttttattttttaaaatatataatgccactgtttatccaatccaagcaattctatgctatacacacgattgyttttaagactgttaaagtgacaccatctcaaatcatcttttcatattcttttttatggttttcttttttaatgatgtatctaaaaagtttaaagtcttgcttttgtagaatagtcaagagtacagaaggctgtggagtcaaacaggcctaggtttcaatcccagcaccaccactaccgatgcagtctggagcaagttactccactgctctaatcccccaagaacttcatttataaaacagggatattacctacctcataaacattatttaaaaatttttattaaatattatatgcatggc

SEQ ID NO: 31597 - DNA, 601 bp, Human
acacactccctctctccccaggcctgtgggtcttcattgcccagctcctgcccacactcctgcctgctgccctgacgagagtcatcatgtctcttgagcagaggagtctgcactgcaagcctgaggaagcccttgaggcccaacaagaggccctgggcctggtgtgtgtgcaggctgccacctcctcctcctctcctctggtcctgggcaccctggaggaggtgcccactgctgggtcaacagatcctccccagagtcctcagggagcctccgcctttcccactaccatcaacttcactcracagaggcaacccagtgagggttccagcagccgtgaagaggaggggccaagcacctcttgtatcctggagtccttgttccgagcagtaatcactaagaaggtggctgatttggttggttttctgctcctcaaatatcgagccagggagccagtcacaaaggcagaaatgctggagagtgtcatcaaaaattacaagcactgttttcctgagatcttcggcaaagcctctgagtccttgcagctggtctttggcattgacgtgaaggaagcagaccccaccggccactcctatgtccttgt

SEQ ID NO: 31598 - DNA, 601 bp, Human
ggtgtccagggttaggcagtggggggtcttgtggaggctttgagcagtgatggccagaaatgggcaatggggctttcctaggtgggaaatgggaaatggtttggggtgggggaggcattggagggttctggggtaagcataggctgggagtgaacaggggcaaaccttatgcagctgtggggtagaaatgggctagaggcatccaggggtgagaaggagctgaggatgtctaaggaggggagatccctgggtggtcagaaagcactggtgtctggaaagcatttaatgctttattaaatgytagtccctgctgggcatgacggctcacacttgtaatcccagcactttgggaggctgaggtggtaggatcgctgaagctcaggagtttgagcccagcctaggcaacatagtaagatcctgtctctacaaaaaaattaaagaaatagccaggcacagtgatgtgcacctgtagttccagctatgcagaaggctgagatgggaggatcgcttgagtccaggaggtccaggctgcagtgggctgataccgtctctccgaaaaagaaaaagaaaaaagactccctccatgagtgtctggagggag

SEQ ID NO: 31599 - DNA, 601 bp, Human
atgtgtgtgtcccttcatccacaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggtgagccggggccgtgggggcagcggggtggggcggggaggccrggtctggctcttgggccagcggtgaacatgtcctgtcttggacgcgtccctgggtttcactatttaatgtgtggcccctggggagtgtccccacctctgagcctctgtttctccttcagggaaatggctcttgcaatccaagtcctcctgccagggccattgtgagggtctaagtagacaaaaaaaacaaacaaacaaacaaaaaaaaaaacagtctggaagcaatttatagatgagagcgtggacggcagagagcattgtgtatgttgaagtctctgcgatatggggtgtccctgctgc

SEQ ID NO: 31600 - DNA, 601 bp, Human
tcaccttcactcgcgtgtacagccgggacgcagacatcgtcatccagtttggtgtcgcgggtgagaacgtgaggagggaaaatccaagagacctgggcggggtcagggaagggaggaccacggagagcgtggaggcagcagtggccccggcttcctcttgcctgcccgcgctgccctggcttatacggcccctcctgccagacagtgcacagggccagggcgccaggctgggagagcttcgcgcaggcgggatttcagcccgcacttatttcggagcccttgccttgggcagcgcacaatytgcgcagcagtactcggctaaccctcttcctctcgacctgtttcttcagagcacggagacgggtatcccttcgacgggaaggacgggctcctggcacacgcctttcctcctggccccggcattcagggagacgcccatttcgacgatgacgagttgtggtccctgggcaagggcgtcggtgagattctgagtcctcctggcccctgattcccttcattctctcccactcatcacccgccgccctaactccggtcccccctcctcctgcagtggttccaactcggtttggaaacgcagatg

SEQ ID NO: 31601 - DNA, 601 bp, Human
ggagtgctctacagcgccccctaggccaccaagattgtttagctccctgtcgggtcggcccctgactccttattggactcatccatctggctcatccaaggccttgggtctctccagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggtaggcrtggtcccgcggctccggggctggggttcccggcagtggtggtggtggggtggccagggctgggggctcggcccggcgctcacgtctcaggctccctctccctccaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtgaggcaggggcagggatgggaggaggaggggaaagg

SEQ ID NO: 31602 - DNA, 601 bp, Human
gcaagtcactgcttctctactcttcgagcctcagtttccccatctgtaatatggggactatagctggaattacacttgacttccctttcttaccagtcacatccaaacagttgacaaggtgaacaagatttcctgccaccaaaatctttttcgagtctgtcattttttttgccatcttctttataaacaccccagcccaaaccatactggctgtccaggacctttaacaaattccatgagattagagagggggtaggagtgaagggcaatggtcttgggagtgaccccagatgaattccarggtcaaagaaattaagaggatctgacactccacccccgtgttctcatctcttcccactcctcctgttatttactctgctccacccacactggctgctctttgaacagatcaaggtcattcctagcttacagcctttgtgccagttgttccctctgtctggaaagcttcccctccagattgtcactgggccatcccactgtcttccttcaggtttcagtgctaaggccattgcttcaatgaggccttctttgatgcttattatctatttacttgtttttattttctccatagctttctata

SEQ ID NO: 31603 - DNA, 601 bp, Human
ccctccagcatctcacagaacctcacagcatctcacaggttggggggatggaggtgatatgtgaaaaccttagaaagttctagaaatggcagaagagatggttgtcaagatcttgttcctatttctgtatatgtgggagaattagaatcactcctcttatgcctgcctgtctcctgcagagaaagcctatttctgccaggaccgcttctactggcgcgtgagttcccggagtgagttgaaccaggtggaccaagtgggctacgtgacctatgacatcctgcagtgccctgaggactagggytcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttagaagcagactttatttatatatgtatgcacgtatgtatgcatgtatgtatttaactgatagagtgcaaaaaaaaaaaaaaaaaggaaaaacaaataactgatagagtgct

SEQ ID NO: 31604 - DNA, 601 bp, Human
agaatcactcctcttatgcctgcctgtctcctgcagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcaccttygttttttgttggagtgtttctaataaacttggattctctaacctttagaagcagactttatttatatatgtatgcacgtatgtatgcatgtatgtatttaactgatagagtgcaaaaaaaaaaaaaaaaaggaaaaacaaataactgatagagtgctttctacgtgccagaaagtgttctaggccgggcacggtagctcactcctagcactttgggaggccgaggcaggcggatcacgaggtcaggagattgagaccaccctggctaacacgatgaaaccctgtctctactaaaaaaaaa

SEQ ID NO: 31605 - DNA, 601 bp, Human
cacaattggtttatttttcaactcttagctctcttagcacagtaatatcttattcccatgatagatgtccacaatttttagtttaataagtatgcctgttaaacagttcttctgactaaattaaattttgtaggtgtcatttctgtttactttagactgaaaatgttcatgaataatttatattctatgatacatggctaactaatgccatatgactaccatccttctgggaaccttagaaaaacaaggtggatctctcatgaggtcttttcacagagaaaactattctgttactgtaaayaacccagggactgaaatgcataatgtataatgtgccatgttagaggaggccagttaaagataccctcaggacaggaaagacaaagtgtttctggtttttcctcttattagcaggtacctatttgtacttaaaattcagtacatgtttaaaaaaaaaagctcagttactttacatatttgaaggcttttgatttttgtttaacatattttataagcacagtaaatcagaagaccaaaatgaaattgagagtgtatttcctaggtgtttatatatagttgttatgtatattttgttgtattc

SEQ ID NO: 31606 - DNA, 601 bp, Human
atggctcctaccaggcagagctaaaccctgaagtctggggagcccgtaaccctcttgccatggctgtgaaagttgggcacatacatatatgacattagcagttatttctgaatgcattttcctatagaatcattattataaattgtggcttgttttatattaccattaatatacttaatgcacatgatgggttaattttgcttttgtggcctgtcctacaaacttctccacatttataacattaacaacatgtgtactgggttccaagtaattaacttccagagtttctatggcataacarttttctacattgggtgtgacttagaattgaggtagtcccagcagcgtggattttactcattatagttgtagctttacacacacacacacaaacacacacacacacacccctataaatattattttaaaataattgaaccatttttccctgcagttttctttgatacaattagaaacttcagccacaagagtaattgtcattgtttgagaagtactgtatcagcttataaataactgtgagaatggcatggattaaaatttaattctctttggatgtcatttgagatcatttgttctctct

SEQ ID NO: 31607 - DNA, 601 bp, Human
taaccctcttgccatggctgtgaaagttgggcacatacatatatgacattagcagttatttctgaatgcattttcctatagaatcattattataaattgtggcttgttttatattaccattaatatacttaatgcacatgatgggttaattttgcttttgtggcctgtcctacaaacttctccacatttataacattaacaacatgtgtactgggttccaagtaattaacttccagagtttctatggcataacagttttctacattgggtgtgacttagaattgaggtagtcccagcagcrtggattttactcattatagttgtagctttacacacacacacacaaacacacacacacacacccctataaatattattttaaaataattgaaccatttttccctgcagttttctttgatacaattagaaacttcagccacaagagtaattgtcattgtttgagaagtactgtatcagcttataaataactgtgagaatggcatggattaaaatttaattctctttggatgtcatttgagatcatttgttctctcttatgagatgttatcttaattctgcagtgttactctagcatttaagt

SEQ ID NO: 31608 - DNA, 601 bp, Human
gtatgcaaccaattaagcccttctattgttcttactatttaaaagccttgagtttaatgagcatttgttttgcttgttagacatttttggctctcataaaccaagtgtttcctgcagaagaggacagtaaaaaagatgtggaagataactgtaagtaccaagttaaaaattaactctccgcacagaaaaggagactgttcttttaaaaaaataaattagtggttatataactgatacactgtgcgggttcagaaacaatctagtcttttgacatgaatattcatgtgaatgaaggaactcragtcctccatgttgtctcacatttgcattttggtgaaagagtcttgagtgttcttttggtgttatttgagttgcataaatgtggggaatggtaattactgtaaggcttgaactaaaagtctcttgttaacagttttgaaagttattgaaccttatttagagtcaggtggtttttattgtagtatatgtggttcagtaatttggaagttgagtcagtaggagtcatttaacatcaccgtttgaagcaaacatgcatttaaaaaaattctatataattactaattgaaaaattaatttcaga

SEQ ID NO: 31609 - DNA, 601 bp, Human
tcttgttaacagttttgaaagttattgaaccttatttagagtcaggtggtttttattgtagtatatgtggttcagtaatttggaagttgagtcagtaggagtcatttaacatcaccgtttgaagcaaacatgcatttaaaaaaattctatataattactaattgaaaaattaatttcagaacaattatattaaaacacagcattaatttgacttataacatctttgcatgtttgatgaaaaaagctcttctcgatggaacaggccaatgtttattcttacatttttaagattaagcagtawtcatttcatattgggggcagcagtgttaacaattatgtacacttgtcatggatttcattaaaggtacttgacactaacaactctccatttaacaaaaaaaggtagtgttaacaattatgtacagttgtcaaggtacctaatactaaaaactctccatttgagaagaaaaggtaagagaaaggaatagatgtgttattattgattttctctggaattcacatttgagtaagactataaaacccccatatgtagaatggtggcagcatagactagtgggagtaatggggagccatggactgt

SEQ ID NO: 31610 - DNA, 601 bp, Human
ttattcttacatttttaagattaagcagtaatcatttcatattgggggcagcagtgttaacaattatgtacacttgtcatggatttcattaaaggtacttgacactaacaactctccatttaacaaaaaaaggtagtgttaacaattatgtacagttgtcaaggtacctaatactaaaaactctccatttgagaagaaaaggtaagagaaaggaatagatgtgttattattgattttctctggaattcacatttgagtaagactataaaacccccatatgtagaatggtggcagcatagamtagtgggagtaatggggagccatggactgtaactgtagagttaggcaagcctaaattctgattctatgttgttaggaggctgtctgctcgtgggcatttcgtctctcttctgaaattctcatctgtagaatggaagtaatgtgtatgttgtatgattagagatgatataaagtgctttgcacagcatctaatgactcttaataaatggtagctgtttttattaggtgcaagagattgaggaaaaaaatgtagaattcccttcctttccaaaattgctggagagtttgtctgattaaataa

SEQ ID NO: 31611 - DNA, 601 bp, Human
acttgtcatggatttcattaaaggtacttgacactaacaactctccatttaacaaaaaaaggtagtgttaacaattatgtacagttgtcaaggtacctaatactaaaaactctccatttgagaagaaaaggtaagagaaaggaatagatgtgttattattgattttctctggaattcacatttgagtaagactataaaacccccatatgtagaatggtggcagcatagactagtgggagtaatggggagccatggactgtaactgtagagttaggcaagcctaaattctgattctatgttrttaggaggctgtctgctcgtgggcatttcgtctctcttctgaaattctcatctgtagaatggaagtaatgtgtatgttgtatgattagagatgatataaagtgctttgcacagcatctaatgactcttaataaatggtagctgtttttattaggtgcaagagattgaggaaaaaaatgtagaattcccttcctttccaaaattgctggagagtttgtctgattaaataatacatttttgaatagcaatcagaataaaataataaggaatgagactgtaccatatctaaaatacaaatttt

SEQ ID NO: 31612 - DNA, 601 bp, Human
aaaataatagcatttttccatgctgattttgagctaccatgactttcatggcacataatgttcttcgtgaattattgtctattagatgttgataataataaagtatagagtataaaattggaaagaaaccgggcgcagtggcccactcctgtaatcccagcactttgggaagctgagatgggtggatcacctgaggtcaggactttgagaccagcctggccaacatggtgaaaccctgtctctactaaaagtacaaaaattagttgagcatggtggtgggcgccggtaatcccaactactygggaggccgaggcaggagactcccttgaacccaggaggcggagattgcagtgagccgagatcacgctgttgcactacagcctgggtgacaagagtgaagctctgtctctaaataataaataaataaaattggaaagaattctaaaagttgcctcagtctctttttctgtaatggaatgacttctacaacaacatatatttagaattgattgacttctgtgttgaagttgtttgtgggttctttttttcttttagtgagccagagctgtaatgattaaacaggatcttaaatgctcagata

SEQ ID NO: 31613 - DNA, 601 bp, Human
tggcactagaaagcagtgaggtgactgaggcaggagaatcgcttgaacccaggaggtggaggttacagtgagctgagatcgtgccactgcactccagccttggcaacagagtgagattttgtctcaaaaaaagaaaaaaaaaagcagtgaggtgaaagtgaactggctgcattaaatgattatagatggatgggcagtctgtggaggtagttatggcaagaggctcttgtttgacaccattggttaggtgttgaatagtatgttagacatacatgcagtgtaggcacatgagcagtttcartgagggatcaaacaaatgaatcaggcagcatcttgcccccaaggatctgatttagtagacaaaaccagatatgtaaaattatcataataacactggcagtgtgtggtaagaaccataaagaaattgcaaagatagtagttgtagtggtggtggtgagaatgggtaagtgtcatttgtagggtaacctttgtactgaccttaaagagtaggtaggtttttgacacctagaaatgtagaggatattctacatggaagccgatagatgaatgatacctgcatctaataaatagttcagtctgt

SEQ ID NO: 31614 - DNA, 601 bp, Human
cagaatattcaaaaatgaaagaaaatgctttcagtgtaaatagtcaaggtttacaccaaatcattcagatggatacttaacctagtatgttttaattataattattctttgggcatgcatgagactttattccagtatcacctaactgtgtagtcctttggtgactggagataaattaccccactgtagttctcctgttataaagatggggctgttcattatttttgaacgaagaaaacacatggcttctttgacacttactagatcaaatgacagtcttaatctattatatcactatcartttgcctaattgtacttacttaattctgactaaattacatttagtctctgccatctgtccaagtagtgacagctgggagatagaacttatttattctattccaaaagagtatacttgccatcttctagttatatgtagttttaagacttttctccctgattttttcaaaatcaactaaataaagaacatatttaagtttaaatgtggctattcttgattagaaatatatttagaggcaaaatttactcaatcagctgactcatgttgagtatctaatatgtgctaaattccaaaattaaa

SEQ ID NO: 31615 - DNA, 601 bp, Human
gtgactggagataaattaccccactgtagttctcctgttataaagatggggctgttcattatttttgaacgaagaaaacacatggcttctttgacacttactagatcaaatgacagtcttaatctattatatcactatcagtttgcctaattgtacttacttaattctgactaaattacatttagtctctgccatctgtccaagtagtgacagctgggagatagaacttatttattctattccaaaagagtatacttgccatcttctagttatatgtagttttaagacttttctccctgattttttcaaaatcaactaaataaagaacatatttaagtttaaatgtggctattcttgattagaaatatatttagaggcaaaatttactcaatcagctgactcatgttgagtatctaatatgtgctaaattccaaaattaaaagcaagcttaagttgctcattaaacatttaacccataaatgttctaggcaatggttaacatatattgtttggaagaaatctgggaccaaatggtcactacagagctaaatcaatccttggcattcagtgatagggatgggcccagaaggtgctacgagct

SEQ ID NO: 31616 - DNA, 601 bp, Human
tcagctgtaagagcagacttctgggcatcatcttgcatcaggggtttataaaattaaaggattaaaagtagtatatgcttcataccactggagaatctatgtgggaagacagtagtgtctctttgcctttctcagcctcttttattttgaagtcctccagctctgagtcatagaggttggaggttttagatcagaatgagcaattacccctcttcccaccaaatgcggaggtgttagctaaccctttgcattcagacataaagcagctaaatgacatgtattggaactagttcgtagtgcrtcctgtttctctttgggctttcccttcatgcttgtgttttggcctaaccagagttcacttccagatttggttgacctgtatgttgtctgctactaggtagagtgaatatggctgacataattactctaccagggcagcagcagatttacttttggcttgaagaagctatgacaggcatcgttgtgttgcagcctgcaaaacggtgccccatcccttagaacctgaatacgagcaaacatcactggagaaaagttacatgtttaaaatgtaaataaactagcttttatttttagcttttta

SEQ ID NO: 31617 - DNA, 601 bp, Human
ggttgacctgtatgttgtctgctactaggtagagtgaatatggctgacataattactctaccagggcagcagcagatttacttttggcttgaagaagctatgacaggcatcgttgtgttgcagcctgcaaaacggtgccccatcccttagaacctgaatacgagcaaacatcactggagaaaagttacatgtttaaaatgtaaataaactagcttttatttttagctttttactgcgaaaaaacaagtgtttggaatgattctttaaaaatgtgtggaggatgggtgtggtggcttatgcstgtaatccaagcacttcggggagggcggatcgcttgagcctgggaagtcaagaccagcctgggcaaacatgcaaaatcttgtctctataaaaaaaatgaaaaaattagccgggcatgtgcttgcctatagtcccagctactctggaggcagtggtgggaagatcgcttgagctcaggagatcgaggctgcagtgaggtgaagtcatgccactatacttcaacctgggtgacagagagataccctgtctcaaaaaaaaaaaaaaagaaaaaagcgctgctgataaattggacaaagggatg

SEQ ID NO: 31618 - DNA, 601 bp, Human
aaactagcttttatttttagctttttactgcgaaaaaacaagtgtttggaatgattctttaaaaatgtgtggaggatgggtgtggtggcttatgcctgtaatccaagcacttcggggagggcggatcgcttgagcctgggaagtcaagaccagcctgggcaaacatgcaaaatcttgtctctataaaaaaaatgaaaaaattagccgggcatgtgcttgcctatagtcccagctactctggaggcagtggtgggaagatcgcttgagctcaggagatcgaggctgcagtgaggtgaagtcrtgccactatacttcaacctgggtgacagagagataccctgtctcaaaaaaaaaaaaaaagaaaaaagcgctgctgataaattggacaaagggatgtgtgcgctcttgtatatggtttgcattctccccttagagtaaaagccgtttctgaagtcttcttggcacatgtctgaggtgagaaatagttgtcttatagagccaaattgtgatgacctagttttgaattaaagttgtcttaatttgagactgctttaacagcattaaattgctttcaacttgtctgtgtagtcttaacatttaa

SEQ ID NO: 31619 - DNA, 601 bp, Human
ttggaatgattctttaaaaatgtgtggaggatgggtgtggtggcttatgcctgtaatccaagcacttcggggagggcggatcgcttgagcctgggaagtcaagaccagcctgggcaaacatgcaaaatcttgtctctataaaaaaaatgaaaaaattagccgggcatgtgcttgcctatagtcccagctactctggaggcagtggtgggaagatcgcttgagctcaggagatcgaggctgcagtgaggtgaagtcatgccactatacttcaacctgggtgacagagagataccctgtctcaaaaaaaaaaaaaaagaaaaaagcgctgctgataaattggacaaagggatgtgtgcgctcttgtatatggtttgcattctccccttagagtaaaagccgtttctgaagtcttcttggcacatgtctgaggtgagaaatagttgtcttatagagccaaattgtgatgacctagttttgaattaaagttgtcttaatttgagactgctttaacagcattaaattgctttcaacttgtctgtgtagtcttaacatttaatacagtttatagcctaaattgttggagtctaatgaagatagttaa

SEQ ID NO: 31620 - DNA, 601 bp, Human
acagtttatagcctaaattgttggagtctaatgaagatagttaaaaaatatatatgtaaacagaggcaaatctaggaaatttaaagctgttaattttgcctagttgtaaaatgttgacaaattgtaaatttaatagttgtattagaggaaaaaaccccacagatataatctaggaaatttaaagctgttaattttgcctaattgtaaaatgttgacaaattctaaatttaatagttgtattagagaaaaaaacccaagttgccattatgtatttttttttccagctgaatttttggttgcyagatttcttaattggaagctcattaattcttgcttttcactggggacttcattagttatgcatagtgaccatttttttaatccctctgcagatcagctctggaattaggaagagatgagccacagcccataatatcaagacattctgtcagaaacttaagagttgtttatttggatttcatattacttaacttttaggataataagatagaacatttaaagtaaatacttttaaaatgatttgaacacttttgaatgactttattttaaaatttcattaacattgaatagacatttatga

SEQ ID NO: 31621 - DNA, 601 bp, Human
catagtagcattaagtatattcacgttgttgtgcagccaatctgtaccatctccagaactttcatcttggaaaactaaaacttgacccatgcaacaacaactccatttatccactcacctagcaaccaccattctactttccagtttttctgtgaatttaactactttagctatttctcatgtaagtgaaattacacagtatttgtctttctgtgactggcctattttatttaactcaacttaagattcatccatgttgtagtatgtgtcagaatttccttccttttatttttattttttwgtattttggatcccatccttcctttttaaggctgaatactattttattgtagatctgtggtacattttgtttatccatgcatttgtcaatggacatttaggttacttccacctcttggctattgtcaatagtgctgttatgaacatgggtgtgcaaatatttctttgagaatttgaaaaggttgacttttaatacctttgcatacttcatgacatagtttggaatggtgggctctatcctttttaagatacagacatcttatatggaagctagtctatagattactgaaagccagctctg

SEQ ID NO: 31622 - DNA, 601 bp, Human
cctttttaagatacagacatcttatatggaagctagtctatagattactgaaagccagctctgacatgttattcacacgaggatcttggaggatactggtactggttagacaaagggtgatctagaaatattccttaagaatctcacatttacgttctgtctatatttctgttgttagcatggttaaaaccattttttaccttaagcttacgataatttgcctccttatttctatttccctatagtctgcctcctaatgtgttctctttgctgccattaaattaaactctctgcattgtgtttttttgtttgtttgtttgtttggtttggtttgtttttttttgaaaacagggtcttgctctgttgcccagtcacccaggctgtagggcagtggtgcaatcatagctcactgcatcctcgacctcctggggccaagtgatcctcctacctcagcctcccaagtaactgggacccacaggcatgtgccaccatcctggctaattttttatttttttgtagagacagggttatgctatgttgtccaggctggtgtccagctcctggactcaagtgatgctcccactttgacctcctaaagtgc

SEQ ID NO: 31623 - DNA, 601 bp, Human
ggtaatccaccctccttggcctcccaaaatgctgggattacaggcatgagccaccacacctgaccccaaatagaattttaaataaatttaaaaagctatgacagaatagttgcatttaattacacatttgttataatgatgatctaggtttcagttttatatgtactagataattataaattattgtacaccatattattgtcatcaacattttttatcctatattttaaacagatacctgactgaatcctatggaacaggtcaagatattgatgacagaattgttgaaggtattgctaayttttcagttgttacgcgtgtactgaaattaatttacaagacttcttttagtggtctggaatgttcttctctcagagatgcaaaagactctcttatctcctactaatcattgctcatatatcatcttgttatttacctaatatcaattgtttctgcccccacccgcacctcatgaaaacactaagaaggcagggatttttgtttcatattccaaacccttagaatggtaactgatacagagcataaatatctgttgaatgaatgaaagaatacaggaatgtctttagcttccagtttgttt

SEQ ID NO: 31624 - DNA, 601 bp, Human
tggaatagataaaaggatagatgttaaaccctacgtcaatttaaactcaattagaaattgataatagctctgtaatactagctttaaagttacctttgacttatctgtaaaaatgtttgaacactaaattaatattaataaaggacacatgattgaatttcttaatttacttcaacaacaaatatttattgcttgcccattgggtgccaggcattgggccaggattaaaaagataaataatacacagtccctgctcttgatcaacttagatgtggtgggaaacgcacacacacacacatgaacacacacacacacacacacctgagcattacaagcgagtagagtttctaggagcggtgactggggatggtttggttaacacaattttcagattctcaggttagaaaacagtgtacttgtatggagtatgggaatgtagtttatacaaaggaatgcaatgtgagtaaggaatgtcgtctgtatagagttccccagctgattctgatagtcttttttggtcagaaagcctccatttgagaatcataacacacataattactgctctgtggttgtgtgtgtgcgtgtgtgtttgcagacagct

SEQ ID NO: 31625 - DNA, 601 bp, Human
ttataatggagaaggaaagatagaggcattgattgtctaaaatattaatttatccccaaatcattcaaatttttataaaattttttttggtatgtgtatgatgaggtgtatttaatttgggaattcatgccatggtacaataaaatcatagcaacctgatttaagagaagctgagatgtttaaaaaaacttgtccatcctgttctctgtgtacatcctttctgatcagatttgcccaattccatctaaatgtctttaggctgtgtgtaattttcagaaaaatgcagtacttttagtctacygtatagcaaatatgttcattcactttttattagaaacagtttttaaatgaagcaagccttcaattgtgagactaataaatgggagcagtagattcttgttgataccagtagattttctttttttgaactactcctcttgttctatattttggaagcatttagcttttgaaagcctttggtaagtgaagtaaatcactgaaataagaaaactttaaattatttgatccataaagcataaagcaagtagtgtaatttatgtacagtcattgttagctttcaataaatgtgaaaagcatgttt

SEQ ID NO: 31626 - DNA, 601 bp, Human
ttctatattttggaagcatttagcttttgaaagcctttggtaagtgaagtaaatcactgaaataagaaaactttaaattatttgatccataaagcataaagcaagtagtgtaatttatgtacagtcattgttagctttcaataaatgtgaaaagcatgttttaaaaaactgactctaaaaatcaaaaattaagaaaatcaaggatagaatttcttaacttctcagaatttaaaatattacttgaaaaattaaaccatactatcggttcttacttgagattctacatatttagtaggaaggygattttcatgattttatacactatgtttagatttttgatactgaaaagatataaaattgttgccctttaaaagtagaaaacttttatgtcattgatttttaatcattttatttaatctatgctcagagattaggatttttaatattcctggttttattagtaggaagaaaatgcttataaaatatagaagtattgatttgaatggtgagattatacagtactcaagttgtgtttagaaattcttcatggttggcactatttggtaagttgtgttttctcctgtattatttccctgtggat

SEQ ID NO: 31627 - DNA, 601 bp, Human
acagtcattgttagctttcaataaatgtgaaaagcatgttttaaaaaactgactctaaaaatcaaaaattaagaaaatcaaggatagaatttcttaacttctcagaatttaaaatattacttgaaaaattaaaccatactatcggttcttacttgagattctacatatttagtaggaaggtgattttcatgattttatacactatgtttagatttttgatactgaaaagatataaaattgttgccctttaaaagtagaaaacttttatgtcattgatttttaatcattttatttaatctaygctcagagattaggatttttaatattcctggttttattagtaggaagaaaatgcttataaaatatagaagtattgatttgaatggtgagattatacagtactcaagttgtgtttagaaattcttcatggttggcactatttggtaagttgtgttttctcctgtattatttccctgtggatcatatatgttaattatatttaatttgttttgtcatagtatttaaaccgaggctgcactagatactttgctaacaaagaaactgacaaacagattttacagaaccgcaaaagtcctgaggt

SEQ ID NO: 31628 - DNA, 601 bp, Human
ccagctcggccaacatgatgagaccctgtctctaccaaaaaattacaaaaattagccaggtgtcgtggtgtgtgcctgtaatcccagctacttgggaggctgaggcaggagaatcgcttgaacccaggagatagaggctgttgtaagtggagatcgcaccactgtactccagcctgggcgacagaacgagactctgtctcaaaaaaaaaaaaagcttatatattattgtagttctgtttaaaacatcatatttatgtaatatattatgaaaaatttatatattggtttcagtaaattatawttctaagaataattagatataattataccattaagtattatttttaacacattaagttcttaatgtaaaaatttacaacccttataaattttaatatgcagtgtttaataagtgatattaagttacacgtactcaaggggcttaagttatgaaatactaaagtaaggattaatgatagatactggttaatgttacttttattaattttattaaatatttaaattgagtaatcgaacaagtttttataatagtcagtttttaatgcttctacatttgtaagcccgatattttttactcttc

SEQ ID NO: 31629 - DNA, 601 bp, Human
ctgtttaaaacatcatatttatgtaatatattatgaaaaatttatatattggtttcagtaaattatatttctaagaataattagatataattataccattaagtattatttttaacacattaagttcttaatgtaaaaatttacaacccttataaattttaatatgcagtgtttaataagtgatattaagttacacgtactcaaggggcttaagttatgaaatactaaagtaaggattaatgatagatactggttaatgttacttttattaattttattaaatatttaaattgagtaatcraacaagtttttataatagtcagtttttaatgcttctacatttgtaagcccgatattttttactcttcttaaaatgaatgagatgatttatatttttagcatatttatataaaaggatagaaagcaaataaaatattccattatttaaaattctaagcagacaaccctacagttaatttttgtttaatttggcattttatatatcattatagatacagaatctgaattacaaactataaactttgctatagccatggttggtacttttaagaagcaacattaatatttattattgtatctt

SEQ ID NO: 31630 - DNA, 601 bp, Human
atatttattattgtatctttctttgtcttgataagactatgtttttctgagatatcaaaatatagtagctatattcctttcactaagataatggagacctttcctagtgggacatttcagcagttctgaaggggggaaaaagatataaatttgatcatttgccatggaaaaaaatggagtagagaggaaagaaaacgagtttactctccaaagagtagcatgtactctccaaagaagaaaattgccctcttattctagagtcagtatactctttcagaaatcttattcacattgagtgtgygtttatatgtacagttaaataatggattaatatgtttaaattactttttatgtcttctttatcaggaggatgaggtgatcattttgactaattaaaccctttgcccaattccatctgaatgtctttaggttgtgtgtaatttttagaaaaatgcagtatttttagtctgccatacagcaaatatgttcattaacttttgattagaaacagtttttaaatgaagcaattctttgactgcaagactaaaaattctgcatgatgtgtgttttctgctgaacagttttggctgcatgtgattgt

SEQ ID NO: 31631 - DNA, 601 bp, Human
tcctttgcttcttttaagaataaaattgaattttattgtcttagatattttccagaaatgttacacattcataattgaacattttaaataattttgtggaaagacaattatagcttgagctgggaatcatttgtttactgggaggaaaaaatatccatctccaggaggcatctttaatgatcagttaatcatgatcctgttatttaatgtttaacttgtatattctcaagttctggaaaatttctagtacaatcttttcgtgtccagtaacttttatgtttctccttctagtttctgcagwcctgactttcttctttttttcttctgagttggtatagagtctaacaaatgagcacattagatgcaagttcttttaggagagaaaacaaattttcttctcattttttctgaaatgttttaagtcattgtgtaaattattagagtaagtataatgcttactaatatactttaccatatatatatatgcatataaaaaggtttaaaaaagaattctaaggcatgaaaattgtatcagcctgacccctatttactacaacttaatattggtgcagttggtggcagttaacctaaaggagtcata

SEQ ID NO: 31632 - DNA, 601 bp, Human
cttttaagaataaaattgaattttattgtcttagatattttccagaaatgttacacattcataattgaacattttaaataattttgtggaaagacaattatagcttgagctgggaatcatttgtttactgggaggaaaaaatatccatctccaggaggcatctttaatgatcagttaatcatgatcctgttatttaatgtttaacttgtatattctcaagttctggaaaatttctagtacaatcttttcgtgtccagtaacttttatgtttctccttctagtttctgcagtcctgacttttttctttttttcttctgagttggtatagagtctaacaaatgagcacattagatgcaagttcttttaggagagaaaacaaattttcttctcattttttctgaaatgttttaagtcattgtgtaaattattagagtaagtataatgcttactaatatactttaccatatatatatatgcatataaaaaggtttaaaaaagaattctaaggcatgaaaattgtatcagcctgacccctatttactacaacttaatattggtgcagttggtggcagttaacctaaaggagtcatactgattgtca

SEQ ID NO: 31633 - DNA, 601 bp, Human
agagtaagtataatgcttactaatatactttaccatatatatatatgcatataaaaaggtttaaaaaagaattctaaggcatgaaaattgtatcagcctgacccctatttactacaacttaatattggtgcagttggtggcagttaacctaaaggagtcatactgattgtcacatttaaattttttattgcaccttttaacttactttttctttttttaattaacaagaataatgtatatttatacagtacattggaatacaatgtaatgtttgatacatgtatacattgtggaataattmaatgaatatatttatcattacctcatttaaaaaaactgtaatgttgattcaagtattgatattccctcctttttcactcaatttttgtctttttctaatatgctaggattataagactttagagcgaaaattgtaatttaattgaaaaacatctaatttcattattttaattgaaatttttacggataagtgtagattcacatgtagtaaatagtgaaatagaacagagagatcctgtgtatacttttcatggtcatttagtttttgaatgttagaatagtaaagattttcccattgaca

SEQ ID NO: 31634 - DNA, 601 bp, Human
ggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtttgctttttatttttttaagaggaaaaaaattaaatagaatttctgttatttatttgtcatatgaaaattgtctctttatatgcagtttgcttaaaaactttaagaagtatctaaaatatactgagttamatgttgaatctcccaaatgaagaatgtttcattatcagtcattctgagctctgttttgaacaaatcagtgatattgcttaggaataaacctctcatttttgaaggataaataactgactattttatcctgataaatttagggtaatttttagttaaattttccagttatattacacttttccaataggtgagaagattaattctctatcatctattaaggcatttttgaaaattttcaggatcattgggtgaattaattagggcaatttaatatataaaagcccatgtactttattaatg

SEQ ID NO: 31635 - DNA, 601 bp, Human
cacagaggcttgtgataattgtcccttctttctcccaggccactgaaatttgtcatctatgaatgaacagactaaaacagatgtcttaatgattttcagatctaatgttctgtaatgctgtgaaatcaataatgtgagatgcaacataacatagtggatgggagcacgtgctcctgatccagatgctttaccacatactgtctgtatgaccttaggcagggaacttagccttttcgtgtcttagtttcctcactgtaaactgaagataatagtacctacctcatgttgtaaagaggaataygcgagttaaatatttgtaaatgatttgagtacttgtgtctggcacatagtaatcattataagtgctttaaatgagtaagtacaattaaaatacagattgctcccaatttaaaatgaaaaaaaaaaattcaagcaaaattagatatgttcttaatgtgcattaaaattttttgtttttttttgaaggattggaaaatttgttttgaaaacgtaatgaatgttagcatacatttcatttgctctctagcattgttataccaaaggagcatatgtgggagattctaacacaaaaaaaagtctt

SEQ ID NO: 31636 - DNA, 601 bp, Human
gctgtgaaatcaataatgtgagatgcaacataacatagtggatgggagcacgtgctcctgatccagatgctttaccacatactgtctgtatgaccttaggcagggaacttagccttttcgtgtcttagtttcctcactgtaaactgaagataatagtacctacctcatgttgtaaagaggaatacgcgagttaaatatttgtaaatgatttgagtacttgtgtctggcacatagtaatcattataagtgctttaaatgagtaagtacaattaaaatacagattgctcccaatttaaaatgaaaaaaaaaaattcaagcaaaattagatatgttcttaatgtgcattaaaattttttgtttttttttgaaggattggaaaatttgttttgaaaacgtaatgaatgttagcatacatttcatttgctctctagcattgttataccaaaggagcatatgtgggagattctaacacaaaaaaaagtctttacaataattaatacacactttagaaatgttgttagaagtgataaatggcatcttcacacctcttattattaccctgtggtagaagatgcagttgtatagagtattataagtgttg

SEQ ID NO: 31637 - DNA, 601 bp, Human
tcattcttttgcatgtggacatccagttgttccagtacctttattgaagaagctgttctttcctcagtgaattgtcccaacatcttattattgtaaggtctcatttttcacatttttttctcatatatattctaagattggtatgttaagtagtttatgaatttgtcataaaattgtcatgattttcacacattctttgtagtttttaattaggtagtcttagaatatatcgtttattaatattaatctgaaaatatttgtaaaatgctattttttattataatgcaaataaatataaagmatagttaatcgttagtactttctctgtaccagacactattccaagcatttcacatacataacctcattaatctaaatagcaaccatgtaaggtaggtaaagtaattatcccagttttatggacgaagaaactgtgcacaaagagaataagtaacttattcaaggtcacatagctagtagttgtagagcctgatcagccctgagactaaagcactttctttctttatagtactttttaaagcagcccttataaatagaaatctgtagatatgatgtactaaggcaaaaatgacctgcctgg

SEQ ID NO: 31638 - DNA, 601 bp, Human
acatcttattattgtaaggtctcatttttcacatttttttctcatatatattctaagattggtatgttaagtagtttatgaatttgtcataaaattgtcatgattttcacacattctttgtagtttttaattaggtagtcttagaatatatcgtttattaatattaatctgaaaatatttgtaaaatgctattttttattataatgcaaataaatataaagaatagttaatcgttagtactttctctgtaccagacactattccaagcatttcacatacataacctcattaatctaaatarcaaccatgtaaggtaggtaaagtaattatcccagttttatggacgaagaaactgtgcacaaagagaataagtaacttattcaaggtcacatagctagtagttgtagagcctgatcagccctgagactaaagcactttctttctttatagtactttttaaagcagcccttataaatagaaatctgtagatatgatgtactaaggcaaaaatgacctgcctggccaccttctgctgcaatatatcttttcctcacatacccctgtgcaagcacacaaaaaataaaatggcacacgtgcaggc

SEQ ID NO: 31639 - DNA, 601 bp, Human
tattgtaaggtctcatttttcacatttttttctcatatatattctaagattggtatgttaagtagtttatgaatttgtcataaaattgtcatgattttcacacattctttgtagtttttaattaggtagtcttagaatatatcgtttattaatattaatctgaaaatatttgtaaaatgctattttttattataatgcaaataaatataaagaatagttaatcgttagtactttctctgtaccagacactattccaagcatttcacatacataacctcattaatctaaatagcaaccatgtaaggtaggtaaagtaattatcccagttttatggacgaagaaactgtgcacaaagagaataagtaacttattcaaggtcacatagctagtagttgtagagcctgatcagccctgagactaaagcactttctttctttatagtactttttaaagcagcccttataaatagaaatctgtagatatgatgtactaaggcaaaaatgacctgcctggccaccttctgctgcaatatatcttttcctcacatacccctgtgcaagcacacaaaaaataaaatggcacacgtgcaggctggatgtgc

SEQ ID NO: 31640 - DNA, 601 bp, Human
tgtaccagacactattccaagcatttcacatacataacctcattaatctaaatagcaaccatgtaaggtaggtaaagtaattatcccagttttatggacgaagaaactgtgcacaaagagaataagtaacttattcaaggtcacatagctagtagttgtagagcctgatcagccctgagactaaagcactttctttctttatagtactttttaaagcagcccttataaatagaaatctgtagatatgatgtactaaggcaaaaatgacctgcctggccaccttctgctgcaatatatcttytcctcacatacccctgtgcaagcacacaaaaaataaaatggcacacgtgcaggctggatgtgccaatggcagatttctcaaaatgcccacatgggtcaagacctaactgcattgcttttttttttttttttttttttttttttgctattctctgctctgcagtgtaaagatattgaaaatgtcaaaaaggcttgcagatacccctaagggtaacagtaaataaggaaaagaggaagcatttgtactgatctctagcacagaaagtcaagctgttggaggaactggacaggggtatacatg

SEQ ID NO: 31641 - DNA, 601 bp, Human
attcagccttgtcattctgaggcactgcaggatcttcatttgtggagggaagaagaccctttatctcttactaataagataggcagtgagctctagtgacatatttccgaaaaagttgcaacaaatttaaacaaagaattttttgaaaaagcttttagcctctcagaaaattggctatctcttattcttttgaaaattttagcaaggtatgcttagcctgattctttgctaagcaaattcaaaattgttcttgttataaagaaaaactctggaagaagtttgtagagtaccaccctacagyctacagttacttggttccttagagatatctctgcggcccaagggaaagcccataaatgtgcaggtgggtggttctcaggcattgcttcctccattttcccattttctccttgttccaaagcagttttttgttgttgtttccttttttcaatcaatgccattccagaatccaaagcagctcttttatgtactctatatatagcgtgtccacatgaaacttcaagaaagggttccattgcagaaaatataagtgagaaatcactgtttagagaggcttaagtatcaaatgtcaggctgatct

SEQ ID NO: 31642 - DNA, 601 bp, Human
atgggacagttcaaattttaagatgtaaacattttatcctaaacagtgtaaagaagttaccaaactttaaagttatcctgaattaaacactgtttcctttgcatttaaggaaaaccaaaagggaggttattcctttgaataattttgtatgtattcaggatgtaaattaaggtcaaaatgattttttaagcctaattttttttaccccaataatagacttttgatctaattttaggtaattccattagttttcttgtagcagttttctacttagccccatttatctgtgcctattctcacrtgacctttggtaactctttattttgttcttctctgtgggtatgtttaggtgcactctgtggcattttcacagtgcactattataaagaatttttactagcatagttttcttttatagggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttggtaagtagagtttcttttgtgagta

SEQ ID NO: 31643 - DNA, 601 bp, Human
aagtagttaaacaactgtagagctgttcaaccagaaatgaaatgggtcaccagcatgtgaatgctgctttgctctgagtgacaaaaatataaaaatcttgaaatgtaaatctaatgggttttgtattgggctttatcaatgtgggcattctttctgactgtgaaggagtagtgtcttctttgtggtttttgccaaagaaatgtatgagtgtttacatttggggagggatggagttttgcttttgatgtaatacgtattttaaactttataattctctaccttttgttcaaaggtagagaaatattattattattaattttttttccttttctacaacagttttagcataacacatacaaaggattataaaattgtaaagccgagtgtatcttagacatcatgcaatataatctcttgattttagaaatgaattggtatccacagcatttttgataagtaattttacagattatgcagaaaaaaatcttctaaagcacttgtattttaagtaatttttgtgcttaatttagattgctttaatacctgtgctttaaaaaattgttggccgggtgcggtggctcatgcctgtaatcccaacatt

SEQ ID NO: 31644 - DNA, 601 bp, Human
gcagatcacttgaggccaggagttcgagaccagcctgggtaacatggtgaaaccctgtctctactaaaaatacaaaaattagctgggtgtggtggcacatgtttgtaattccagctacttgggaggctcaggcatgagaatcacttgaacccgggggcggaggttgcagtgagccaagattgtagcactgcactccagcctgtgtgacagggatcctatctcaaaaataaataaataaatagttaacatgtggcttacattttatatcttttagtatacaacatttatctcatttgagaarcaccttatttgtcaactgaagcagggtatttttaatacttttaatgcctataaagttttgtcttgaaatgagaacatttgggaagtatagaacaaatatatataatatacaaatttaacctaattttaaattaagccattattacaattacattttatcctatgataaatttatatgaagttgatctcataatgactcttggttctggttttatattttcagagtactttgagcataacagttttgaacaattttgcatcaactattgcaatgaaaaacttcaacaattttttaatgaaa

SEQ ID NO: 31645 - DNA, 601 bp, Human
cggctcactgcagcctccgtttcccgggttcaagcgattctcctgcctcagcctccccagtagctgggacaacaggcgtgggctaccatgcccaacaaatttttgtatttttagtagagacagggtttcacaattttggctaggctagtctcgaactcttggcctcaagtaatctgcctgcctcatcttcccaaagttctgggcttacaggcgtgagccaccgcgcctggcctgttgtctctacttctaccacaccaaacaaccttctacccgcatccctgcctttggcatctcccactctttttttttttttttttttgagacgaagtcttgctcaggctggaatgcagtggcgcgatctcggctcactgcaacctctgcctcccaggttcaagcgattctcctgcctcagcctcctgagtagctgggactacaggcacgcgccaccatggccggctaatttttatatttttagtagagatggggtttcaccatgttgaccaggctggtcttgaacttctgacctcaggtgatctgcctgcctcagcctctaacagtgctgggattacaggcgtgagccatcatgcccgactgtagctcc

SEQ ID NO: 31646 - DNA, 601 bp, Human
tatagccgcacagccagttttcagtcttccatttctttcccaccccatctctaaaataaactgttgggcaaaccttgtttttaaaacagtttgataatcctgtcagtaactgatgtgctggatttgaaaaacatagtataataataatactactttacatcagtataaattttcaaagcactttcacatttcacttggtccactccacatttccttaacacacggaccctttctaacctctgagtctttgactgtgtggtttgatatggctggaactcttccccttccatttgtctttcarcccactttcacctcatgctacatctatcaaaatactcccatttgtagcttagttcagcatgcccctcctgccctaccactaattacccaagaagcatcattttctcactaatgtagttagaatctttctcttcctatgtcttatagctttgttccacttaatcattgttatatactgtattcaagcagtttacattttatagttagttttggacaggaaggaatttcaaacgaatggaaagagcgtaaaaatgtgttgttacagattttgtttgaaagcgtttacatcagtttctaaaag

SEQ ID NO: 31647 - DNA, 601 bp, Human
ttcctatgtcttatagctttgttccacttaatcattgttatatactgtattcaagcagtttacattttatagttagttttggacaggaaggaatttcaaacgaatggaaagagcgtaaaaatgtgttgttacagattttgtttgaaagcgtttacatcagtttctaaaagtattattaaaaagctatgcatgtagaagtttctgtagttttactttactttgaatatagctgtcatttcgaaaaggaggaatttccaattccttagcctcttctcctggtttacaaatggaatggttattrtagtcatttgctttctttatgtagtagcttttctaaaacctatattaaatatatactgttacttttttataaacggccagatttgaaataaaaatccgtcagctctctataacttttgagagaacacatatagaatcacatgctatgttgtttctgatcagtccttgaaatctgtgattagtgaattgttcacatatctttaaaatgttatgtttttacactattgtgagtgttttcattttttgaaatagatttaattgaagccaaattagtgggaatactggatattttggatgaaga

SEQ ID NO: 31648 - DNA, 601 bp, Human
gtacaatgtgcctgtagtctgagatactagggaagctgaggtgggaggacagcttgagcctgggagtcgaggctacagtgagttgttagcatgccactgcactccagcctggccaaaagagcaagatcctgtgtcaaaaaaataaaagtacaatgagaattacctgctgtcttcatggtctcccttctgagctaagtgggtatcagttgctttgttttgtgaccttaatcacattccaggagttggcactcggagtcgcaagcagccatctgtctgcttatttgtaagaccagcagttaargttgtggcttagaactcttgactggtgcaggcaatacaaattagataatgatcagccaattcattttgaccctctttcctaaggagttttgagtggaaaatacactcagagagggaaattgaatctgaagcaatagagagattaggtagagtaaagagaaaagcagacagacagcagtagaaacaaatgagaggtgcactctaaaaggccagaagacctggtttctgttttcctttcttttttttttgagacagagtttcgctattgtcacccaggctggagtgcaatggtgcgatctcg

SEQ ID NO: 31649 - DNA, 601 bp, Human
tgttagcatgccactgcactccagcctggccaaaagagcaagatcctgtgtcaaaaaaataaaagtacaatgagaattacctgctgtcttcatggtctcccttctgagctaagtgggtatcagttgctttgttttgtgaccttaatcacattccaggagttggcactcggagtcgcaagcagccatctgtctgcttatttgtaagaccagcagttaaggttgtggcttagaactcttgactggtgcaggcaatacaaattagataatgatcagccaattcattttgaccctctttcctaargagttttgagtggaaaatacactcagagagggaaattgaatctgaagcaatagagagattaggtagagtaaagagaaaagcagacagacagcagtagaaacaaatgagaggtgcactctaaaaggccagaagacctggtttctgttttcctttcttttttttttgagacagagtttcgctattgtcacccaggctggagtgcaatggtgcgatctcggctcactgcaacctccgcatcttggtttcaagtgattctcctacctcagcctcctgagtaactgggattataggcatgcacca

SEQ ID NO: 31650 - DNA, 601 bp, Human
ggagttggcactcggagtcgcaagcagccatctgtctgcttatttgtaagaccagcagttaaggttgtggcttagaactcttgactggtgcaggcaatacaaattagataatgatcagccaattcattttgaccctctttcctaaggagttttgagtggaaaatacactcagagagggaaattgaatctgaagcaatagagagattaggtagagtaaagagaaaagcagacagacagcagtagaaacaaatgagaggtgcactctaaaaggccagaagacctggtttctgttttcctttcttttttttttgagacagagtttcgctattgtcacccaggctggagtgcaatggtgcgatctcggctcactgcaacctccgcatcttggtttcaagtgattctcctacctcagcctcctgagtaactgggattataggcatgcaccaccacgcccggctaatttttgtatttttagtagagacggggtttcaccaggttggccaggagagtctcaatctcttgacctcatgatctccctgccttggcttcccaaagtgctgggattacaggtgtgagccaccgtgcccggctcagaagacct

SEQ ID NO: 31651 - DNA, 601 bp, Human
cctagtggaattagggaactaataggcaaaattgcctctcaaacaaactgtatattattttgagattgtaacatagtataatgattattgctttgatgaatccagaaacttaagtgaatggtaacaagtagttttgtttctattcatcattaacaaaatcagtggtaaataggtgaattggatttacctgaaaagctcatgtaattgtgttaaccttcactagggactaaaatctcacatccacctgctccattgacttgcaattcttctgtatccctatatatttcttgtaatgtggaayctatttctgttacttcagtggagatagaaataaaacaatatgtatcctcaacaaaacttctgctaaaattgaagatatatatccaatcctattccttaatagctcgctggtctttgttatgaccagcctatggatgcatgattacctttaccaggagttggcacctagagtcataagcaggtgacttaccaggggcactaattgctagtcaacagaattgtcacgagtgtctcagaggcatgtgacttaaaagacagtaaactgaagcatcaagaatggaccttggctgcttttgtcaac

SEQ ID NO: 31652 - DNA, 601 bp, Human
cttggctgcttttgtcaaccaagaacaagagtaaagcagtaaatcctattttatataggttattccttttgttgtattttttgaaaataaataaaataatcatttattgaacacttagatgtggcaggcactattctaatgtttttacttgaattatttaatcctgttagatgtgtatgctacagatgagacatacaaggagaggttaagtgacatgcctaatatggcatgtaaagaaatggtaggttgggagtcaggctaggcactttggctgcagagccggcactctgacttgtcctgrtgtattgcctcccacagggaacagcctctctgttctgctacctctttaaccttgagcaagcctctaaggttcccaagtcagttttctcaattttatttttttgatttttctttttctttttttttttgtagagacagaattttgctgtgttgcccaggctagtcttgaactcctgagctcaagcaacccacccgcttcagcctcccaaagtgctggaattataggcatgagccaccgtgcctggccagtactaactgggcctgaccctgcttagcttttgagatcagatgagattaggcg

SEQ ID NO: 31653 - DNA, 601 bp, Human
ctctgtgtgtgtgtgtgtgtgtgtgtgtgtgtgtgtcttacacctattttctttcctaagagattataccaaatatttgctagattttattgatactttaaggcatactcaatacataaaagcagtataattgtgaaaagtgtgaaaatttcctgtataattttaagtgttttacatctcagttgttttgtaaagaatgattatgtaatatatttttgatcatttaataactcatatatgtattgtttttcagattcccagaaaatctaagctggcagttcataggaatatcagagacgaygaaggcttcattatcaggcattttgcgggggcagtgtgctatgaaacagtgagtataacttttacaaggagaaaaccatttcatgttgaagctgcactgtacagtatgatagcttctagtcacgtggttattaattatttcacgtggttatttaaattaagtaaaattacaagttcaattcctcagtacactagccacacttcaggtgcccagtgtccacactgactagtggtgactgcgttggacagtgcagatacagaacatttctgtcatcacagaaagttcctttggacagagcca

SEQ ID NO: 31654 - DNA, 601 bp, Human
atgtattgtttttcagattcccagaaaatctaagctggcagttcataggaatatcagagacgacgaaggcttcattatcaggcattttgcgggggcagtgtgctatgaaacagtgagtataacttttacaaggagaaaaccatttcatgttgaagctgcactgtacagtatgatagcttctagtcacgtggttattaattatttcacgtggttatttaaattaagtaaaattacaagttcaattcctcagtacactagccacacttcaggtgcccagtgtccacactgactagtggtgackgcgttggacagtgcagatacagaacatttctgtcatcacagaaagttcctttggacagagccatgttaagtgatgttatcacaagatggacagaaacattcctgtttgatttatttttcagacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaaggtatt

SEQ ID NO: 31655 - DNA, 601 bp, Human
cagaaaatctaagctggcagttcataggaatatcagagacgacgaaggcttcattatcaggcattttgcgggggcagtgtgctatgaaacagtgagtataacttttacaaggagaaaaccatttcatgttgaagctgcactgtacagtatgatagcttctagtcacgtggttattaattatttcacgtggttatttaaattaagtaaaattacaagttcaattcctcagtacactagccacacttcaggtgcccagtgtccacactgactagtggtgactgcgttggacagtgcagatacrgaacatttctgtcatcacagaaagttcctttggacagagccatgttaagtgatgttatcacaagatggacagaaacattcctgtttgatttatttttcagacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaaggtatttgtgttatttaattttttttt

SEQ ID NO: 31656 - DNA, 601 bp, Human
agataagtttatacgggaattatttgaatcatccacaaataacaacaaagatactaaacaaaaagcaggaaaacttagcttcatcagcgtgggaaacaagtttaaggtatttgtgttatttaattttttttttactatatttaaaatgaaattattgttttatattctaaaatggataatgtagatcactgtcagaaatctcacagtgaagttcaagagcagaccctgcattgttgatatttgtatgtaaaatatcataatgtaggcctagtaattgaacatacagaaatgcttgtaattwtctgaatgtgttcattcttggttcttaacatatctgattgcctctcctaatgttcttgcttctgcatactgtctggttgaccttcaaaccttctctttcccatgtgttttctgtttccttcctcattcagcggttttgttttagctggagtagtccagctcgggatggctagagaggactagttgagttgagagaggaaagcaggcacagccaggggcttcaggtaaatgatcgccttcatggactcctatttataaagtggctgccatgttaaaaagagcccatctgaagttaatgatt

SEQ ID NO: 31657 - DNA, 601 bp, Human
ttgcctttcactatatgtactttaaatatttaaaataatgtaattaggaaaaagatttaagtgtctgaatgttatggtactgataatataagcctccccaaatttattttggattgaaatgggctctaaataactaaattgataaaatatttataagagctagtttttttttaagcttaaacataaatatagggaaaaacctcataatacatttttaggtaactgaataaaaagccttgaattttgttataagttatattcattattatgagtttctgattcagtgaacaatctttttttwatttgagtattcttctatttctgaatcgacatttgatagcagattggtttaaaaatagtatatttgcctatatgaaatggatgtcattcactattttcctactctaatattattgtagtattgctgataagagcatacttgaaattttagaaaatataaataaagacattcttacagtttttctttggattacataatcttttatgttgagccttgaaacttcttataattgcttatatttaatacaatgtatttttttacattaagccactgaaagtgatagctgaatgatactaataa

SEQ ID NO: 31658 - DNA, 601 bp, Human
caaattagtcactttaatacttttcaggcatggtggttcagattgattacggttgtcagaactctgtcagtgagataagtgggatacaactgtatttctttaattcaatgacaaatccattccattttaataacttaagcttctcagtatatgtgatgtatactgtaatagtatcactcacaggagaatgaaatttggtgtcaggccgatgttggaatcatgactttgccattattagctccgtaacctcgggcaagttatttatttccttggattgtcatgttctatccttaattagatyaaacataataactcctgtgaaaagctttgagcagtacctgacttatagatgacattcagtaaactatacttactaattatagctatgattaatacaatgttagtttaaaaattaacattagtcttttgtaagtagtttaataaatacctcagtataaaatccagatagaaaaattttacataattaacttattttgcagagtagtaaggcaaataaatgattttaatacactgaaccacaccacatcataatcaatgttataaaaacaagaaagcatagtaacttgtaatgttcattgtg

SEQ ID NO: 31659 - DNA, 601 bp, Human
caaacataataactcctgtgaaaagctttgagcagtacctgacttatagatgacattcagtaaactatacttactaattatagctatgattaatacaatgttagtttaaaaattaacattagtcttttgtaagtagtttaataaatacctcagtataaaatccagatagaaaaattttacataattaacttattttgcagagtagtaaggcaaataaatgattttaatacactgaaccacaccacatcataatcaatgttataaaaacaagaaagcatagtaacttgtaatgttcattgtsaattttttttgagaaaattgtccaagcatttaaaaataactgaaatgtaaaatgttttaaaatgttaaagaggcagggtgcggtggctcatgcctgtaatcctagcactttgggaggctgaggcgtgtggatcacgaggtcaggagatcgagaccatcctggctaacatggtaaaaccctgtctctactaaaaatacaaaaaaatttgctgggcgtggtggtgggcgcctgtaatcccagctactcgggaggctgaggcaggagaatggcgtgaacccgggaggtggagcttgcagtgag

SEQ ID NO: 31660 - DNA, 601 bp, Human
taatattaactcatgacactgtgtactttggctttttgaaataataaactgatttcctttctttcacagacacagttaaatttgcttctggataaacttcgaagtactgtgagtatgcttaaaaagaaaacaggtttttatgggtcatctaaaactattattagtaattatgcaagtaggcatagtaaccctgtactaattaaaaatacattttaaactttattctcttattttaaaaaattagttttttttctgaagaaaggtcaaatatatatgtgaagtcagattattttataaatayatagaattcttgactatttaaaaattaagattatcttacagtttcaagaaagtgaaaataagtggtaatagtggagaatttttcttaggattaaagattagttatgaaattcaatcttattttattactcttacagtaacattctccagacatggcaatgttgatgtggaaaaaatggacaaaatatttttgtgccctgctatagagacaaaatttattagaagcctgttttttaactatacattttagtaattcaccccattttcttaaatgagaaaaacatcatagaaagaaattata

SEQ ID NO: 31661 - DNA, 601 bp, Human
aacctggttgacagaatgagactctctctcaaaaataaaaataaaaataaaaataaatgaataaataaataaaagtgtttgtagggagcttcattgttgaaataattatttgcaaggtaactactttgaagagaaacagttatttggatgtctattagcttcagtactcaacaatacgtttcattgtatacataatcagtattctttctacctcattcagcataatctgataattgattccaaatgaatgcctttaagctttaaaaaatattgtttgacaaacaaatgttaaaatgtacamcagtgcagcttagggacctactgtatgtttttgaaatagaatgattgaaaatattgttttgttttcttttacactttggcctaagtcttaaggggcataattttatttactccttttgtcatagggaaatttccttatcatagaaatatggcatacataaatacatttaaatatagaaaaaaatcacatgtacatcagcctgcaaagtgtgttgtttaaatatgttaaacaattaaatgtgttaaactttacagtgaaagacttctctttttacagtttttgacattcaaatctaaaatg

SEQ ID NO: 31662 - DNA, 601 bp, Human
gttgtttattgtgaaataaacaatttcacattaaacatttatgaaaactctctaacagcaaaactggatcttccttaagtgggcagctttctcaatccagcagtagttcatttctcattccacacatgatggtcagaaggtaggttttgttgtcctttcttcccactccacgacttgtaaagaaaatgaaacacgattccctctgcatctgtgacacttcatccatttgcttaaactatcacttcctacccctcaccctgccatgtctgaccttgctcaggcaccaggcttgctctgtttrctttatgccttgcccatcctcccttctcaccaacactacccctaatttttcccaaggtatcagccttctcctttcttgtttaccttttgatccaactcagcttcctgacacttccttaaactttcttctctgactccttattttgctcttttgagaggtagatttactatgaagctaagattacttaagcttcagggtccttcatttaaataaaccccttccaaagccctgcatgtaattttctgcttcgctaaaggcctctccccaactatataagcttcagcccccgcctcacaaatc

SEQ ID NO: 31663 - DNA, 601 bp, Human
tgcttcgctaaaggcctctccccaactatataagcttcagcccccgcctcacaaatctagatctacccttgacctctctcacaaaaccatagctattgagaaatctaattctgttctttcttattgtctgcacagggttggtagacaagacaggatggcaccagttaaattcatcgtcattatctttaaagggctctcaaacctgtcctgccaagttttcctggtcagcatgttctgtttctcatcagagactggtcagacccatcctgctttcctcaaatctctgcgcctctgctgtcaratgggcttacctccttaactaaatatcctaaagcttctcttgtctgctatcaagcacttctgcctaccacttaaccttccctcctgttgagaaagtaggggttgcctctctgcctggttgaggcttatagttctttgaaagccatctcttcctagtttttcatggatcttcagcattgtttatgtttgtcatactattccctttcagatggatctttcccattaccatttaaacatgctgaaatctcatctctaagccacatttctcttacagctacctcttcctccttatttttctcca

SEQ ID NO: 31664 - DNA, 601 bp, Human
aaccatagctattgagaaatctaattctgttctttcttattgtctgcacagggttggtagacaagacaggatggcaccagttaaattcatcgtcattatctttaaagggctctcaaacctgtcctgccaagttttcctggtcagcatgttctgtttctcatcagagactggtcagacccatcctgctttcctcaaatctctgcgcctctgctgtcagatgggcttacctccttaactaaatatcctaaagcttctcttgtctgctatcaagcacttctgcctaccacttaaccttccctcytgttgagaaagtaggggttgcctctctgcctggttgaggcttatagttctttgaaagccatctcttcctagtttttcatggatcttcagcattgtttatgtttgtcatactattccctttcagatggatctttcccattaccatttaaacatgctgaaatctcatctctaagccacatttctcttacagctacctcttcctccttatttttctccagttccttttctctccaagaataggttattgttgctttttcagtttcatgcattctacttactctttaactccaggataatttag

SEQ ID NO: 31665 - DNA, 601 bp, Human
cttttctctccaagaataggttattgttgctttttcagtttcatgcattctacttactctttaactccaggataatttagctcccaccttgatgaggtcaccagtgattgccttgttctgaagcaaatgtcccttttgcagtccttattttagtggacttcatagccacatttgactctggccaacccttttaacatatccttttcttggttcctgacatggcgtatgcccctgcttttcttttgaattctctgaccattcctgattcccctgcaggctcattttcttctacctggacatwtgttatcatttttcaggatttaagttaggcctctttttcttctcattctatgtcagtactgtccagaagacctttacatgatgatggagattttccatatctgtcagtttagtagccatgagacacatttgactcctaagtacttgaaatgtggctaagaatgagtgagttactaaattttaaattttgtttaattaaaaatttttttttggttgggaggggcagggtttattctgttacccaggctggagtgcagtggcacaatcatggctcactgcagcctcaacctcccaggctcaa

SEQ ID NO: 31666 - DNA, 601 bp, Human
gtactgtccagaagacctttacatgatgatggagattttccatatctgtcagtttagtagccatgagacacatttgactcctaagtacttgaaatgtggctaagaatgagtgagttactaaattttaaattttgtttaattaaaaatttttttttggttgggaggggcagggtttattctgttacccaggctggagtgcagtggcacaatcatggctcactgcagcctcaacctcccaggctcaagtgatccttctgcttcagcctctcaagtagctggaactagaggcatgtgccaccaygcccagctaattaaaaaaaattttttttgtacagacaggatctcactgtgttgctcatgctggtctcctggtctcaaactcctgggctcaagtgatcctcctccctcagccttccaaagtgatgggattataggcatgagctgccatgcctggccttaattttaatttttaaaaatttaaatttaagtagtcttatgtggctagtcccgctgtagagcatgtggctagtgactgccaagttgaacagcacagatgtgtattcccttaggtaggctccccagttctgctattgtaaccttc

SEQ ID NO: 31667 - DNA, 601 bp, Human
acatgatgatggagattttccatatctgtcagtttagtagccatgagacacatttgactcctaagtacttgaaatgtggctaagaatgagtgagttactaaattttaaattttgtttaattaaaaatttttttttggttgggaggggcagggtttattctgttacccaggctggagtgcagtggcacaatcatggctcactgcagcctcaacctcccaggctcaagtgatccttctgcttcagcctctcaagtagctggaactagaggcatgtgccaccacgcccagctaattaaaaaaawttttttttgtacagacaggatctcactgtgttgctcatgctggtctcctggtctcaaactcctgggctcaagtgatcctcctccctcagccttccaaagtgatgggattataggcatgagctgccatgcctggccttaattttaatttttaaaaatttaaatttaagtagtcttatgtggctagtcccgctgtagagcatgtggctagtgactgccaagttgaacagcacagatgtgtattcccttaggtaggctccccagttctgctattgtaaccttctaaatagtgagtcctgatag

SEQ ID NO: 31668 - DNA, 601 bp, Human
tgcttcagcctctcaagtagctggaactagaggcatgtgccaccacgcccagctaattaaaaaaaattttttttgtacagacaggatctcactgtgttgctcatgctggtctcctggtctcaaactcctgggctcaagtgatcctcctccctcagccttccaaagtgatgggattataggcatgagctgccatgcctggccttaattttaatttttaaaaatttaaatttaagtagtcttatgtggctagtcccgctgtagagcatgtggctagtgactgccaagttgaacagcacagatrtgtattcccttaggtaggctccccagttctgctattgtaaccttctaaatagtgagtcctgatagtctctaatccaagctgtcaccatctcttacctggatttttgctgtagcttcctaagtattctcctatctcttcagtctgtttttcacatgcatccagaattatcactccacaactcatctctaatcatcatgtccttttactgcttaaaatgctctaatggcttcagatgagtattagggtgaagaggtcccatagagcctggcccgtgtgtccctagcttcatttgtttacact

SEQ ID NO: 31669 - DNA, 601 bp, Human
gacatggaggggagcctgaatttggggtgctgagctcaagtgcctttatttcacagttgtagttacaaattttatacatatttgtataattattttatttttccctcctttattccataagccccatgagggtgggaactgcatctgttttggcttacacatacattcctatttccctggcatatactagactcagtaaatatttgttgaatggaatgaacagtgtagaaaatatgaagatttatttgtgactaatgctaacaaatactggaaaattaagtaattcatgtctgttgtattmttccataaagtagagatgtatttttgtaatattcaagtccatttttttccccattggaattcctctttatttcctaagtgaacacctagtgtcctggcaagttgcacctgtttagatttagctatatatgctatcagattagtggagagggtataggctactgatgaatgctttagctaggattcctctttcaataagcagtatatttcaacatcttaagacatgttggcactttaacagataataccaattcattatactttgatttttttaagtatcaataatagatatcataatagt

SEQ ID NO: 31670 - DNA, 601 bp, Human
ttatttcctaagtgaacacctagtgtcctggcaagttgcacctgtttagatttagctatatatgctatcagattagtggagagggtataggctactgatgaatgctttagctaggattcctctttcaataagcagtatatttcaacatcttaagacatgttggcactttaacagataataccaattcattatactttgatttttttaagtatcaataatagatatcataatagtaataatgataatgatatagaatttgttccagtcatgtagctaggtgatgagaaaatgcaaaaatccrtaagttgtagaaataaaaatatttacgaagctttctaaaataaagatatttaagatttgaattgtactttaactttccattttcattttaaagagaattaataaatttaagtcaccttttactaaaattactatttttttttttgagacggagtttcgctcttgttgcctaggctggagtgcaatggtgcgctcttggctcaccaccgtaagctccgcctcccaggttcaagcaattctcctgcctcagcctcccaagtagctgggattataggcatgcaccaccatgctggctaatttt

SEQ ID NO: 31671 - DNA, 601 bp, Human
ttaatgtgtttcattaattaatattgaaaattcacagtaacagaaattaaatagtacagaataatataagtaacaagaaatctcagctcttaggggtgaccacttaactctacgtcttgggtatattttttatgctggttagattaagctctgctttattcttttaaatatgtcatatcccatcatatggttgtaacataatcaattgagattttagtttttttctggttttttttctattaccaacagtgacccagaggacatctggacattgtccacatgcatatctttgcccacaagkgtgaaaaatcatagaatagatttaccgagccaaagggatatttccaaattgccatccaaaattgttacactggcttacttttctactaagaatgcatctgtgtgttttcctacactgtcatcagctctgagtactagttgttatcttatacctttgccagtcaaatgggttaaaattcaatctgactgtctgtaaaggccatctttcctgtgagattactttaaaataaaaattcactggtttaaaaagtcttagagtttgttttaatttaaatttttggctagcaggaatttattttgg

SEQ ID NO: 31672 - DNA, 601 bp, Human
gttctaaaattcacctcaggcctttgaaagtggtttaatgcagggctttgccttatatactgtgtttgtgacacagagtcttctaacagaaaaaaagatacaaactagacttgatctttccttagttttgttttgttttgttttgatacagtgtctcactttgtcacccaggctggaatacagtgtcctgcaaggctcactgcagcctccacctcctttggctcagatgatcctcctgtctcagccccctgagtagctgagactgcaggcatgcactagcatgcctggctgatttctctattttttttttttttttttgtagagatggggttttgccatgttgcccaggctggtcttgaactcctaggctcaagcagtttgcctggcgtggcctcccaaagtactgggattataggcatgagccactgcacccagttagacttgatctgtctagagaccaataatttgcctctagaaaagagtcttattgggtttacaggaaatttgactatagtagttttaggtggtggataagttgggacataatgagcataaatattttcctatataatatttagttgctgataattctcataaattg

SEQ ID NO: 31673 - DNA, 601 bp, Human
tatttaataatttgtattattcttgaattatatggtcactaacaacatgaattgctattttccataccatttctcagaaaagaaaaaaaagttgagaggaagataattatatataatgttcataatttgtttagctttactcatacatatttattctaaactccccatttattttagagcacaggtgtccagtcttttggcttccctgagccacattggaagaagaacagttgtcctgggccacacataaaatacaccaacactaatgatagctgatgagctaaataaacaaaacaattgsaataaaaatctcataatgttttaagaaagtttatgagtttgtgttgggcctcattcaaagctgtcctgggccacatgtggcccatggactacagcgtggacaatcttgtcttagagctttaataattatttgagaactaatagtctcatagagaaagcactttttcttgtttaaactcctgaaaaattagaaatatttattgaaagcttaagacaaagatttaaatatcttttctctcgttatgttacctttaatttaattttgactataagaagccgttatattggttgatgggttttt

SEQ ID NO: 31674 - DNA, 601 bp, Human
gagctaaataaacaaaacaattgcaataaaaatctcataatgttttaagaaagtttatgagtttgtgttgggcctcattcaaagctgtcctgggccacatgtggcccatggactacagcgtggacaatcttgtcttagagctttaataattatttgagaactaatagtctcatagagaaagcactttttcttgtttaaactcctgaaaaattagaaatatttattgaaagcttaagacaaagatttaaatatcttttctctcgttatgttacctttaatttaattttgactataagaagcygttatattggttgatgggtttttgacattcttaatattatagtgggttatttggtaaaggattgaaatcattatggaattttgtggtatatagtggaaataatgtattttattagttaagaacctactagctgttttatttgtgttgtctgtcacttagtagcaaaaatttctcatctctgtttaaaatggaaatgggggttgggcgctgtggctcacgcctataatcccagcactttgggaggctgaagcagtgggattgcttggttccaggagtttgagaccagcttgggcaacatgg

SEQ ID NO: 31675 - DNA, 601 bp, Human
acaaaaattagccgggtgtggtggtgcgtgcctgtaatctcagctacttgggtggctgaggtggggaggattgcctgagcctgggaagttgaggctgcagtgaaccaagattgcgccactgcaaaaaaggttgggggtgggtaatgggagttaggagagacagaataattttggcggtacctggtattatatagctaatatgcacttatcaaaagctccataaggatatctgagaatgtgggtgagccaattcagagatacagtagtcctttttcattcttttcttaataaagtcttctcrctagccatctgtaatttaaaagtcatcccccccccccacttttgttattgaatatgctacctagcattaagtaacctccttacctccaaaaaagctcctgaagaaagaaaggaagcaaaacgtggccaagtgtgtttgtgtttgttgtattctctgccaaggcctatgtaattgacatgtgaccattttcagacagttagattttggatttgaattctgtttacatcatgtctttatgtgttcaaatgcatttatattttaatactgatactaaattatttcacttcctagtttgcagaa

SEQ ID NO: 31676 - DNA, 601 bp, Human
ctacataattaaaaaatgctaacaatttaagatagtgaaaataaaaacaaagaaaaaaaaaacacccaaaactaaaaaggaagtttgacataaaaaaaagtgtatcacagggacagattataggcagttgcatggagatagtccataagagctggctgtctttctcagtcattaactatattttgaagtcttgtaccacgaataataggtgctttttttcttttaggacatggttcttggagaatatgttcatattcattttcttcatgagattgctctttttggaattcttctgtgattsctctgattgggatttttaggatttttgatgttagggattttaatctaggaattttgatcttttgggatttcaacatttgggattatggcttttgggattaggaattcaaacccctttgacatactgggctaagctgcttttatgtgtggtttggccaggtcatagcagctacatagctggcccaagacaaaagtgagggacagaacattttggggttacctaaggatctgtggcaaacctttaattgttgggagctgtgtaggaatcagtaacttgattacatttacagttgccccttat

SEQ ID NO: 31677 - DNA, 601 bp, Human
aggacatacctattcacatttcatagaacaaatgttgcctaagacagtttgggaggtagcagtgtagcatactaaggaaataatgcatttaaaatgtaagcctaaccagatacatgatattgtaactgcccagtgggttctccttgcccactacccagacagagctgatttatcaagataggaattgcagtagagagacagtaattaatgtagagtcggctgtacgggacactggagttttatgattactcaaatcagtctctctgaaaactcggagatctgaatttttaaggataatttagtaggggcttgggttggagatgaaatcatagggggtcaaaattgagtttttcttgcttgcttctgttcctgtgtgggagcacagaactggctgggccggattacctatctaggtggcatcagctggtgcattggaaggtctgcaaaatatctggagcactgattttaggtgttacaactgtgatgttatacctgggagcaatttgaggaggttcagattcatgcagctggaggctgtgtggctcctaaaccgtaatttctaatcttggagctaatttgttagtcctacaaaggctgactg

SEQ ID NO: 31678 - DNA, 601 bp, Human
atgacaataaagtcataataaaaagcagtttggatactcaggttttctcatgttctttgtaaaatgatgtattagtcttttatttgtaatatttatttgaagttagttaattcatttattaccttattacttgcctcattctataaaaggatttgaagtggcatacaaaaatgtgtaaagactataaaacaagaagtaagtagttgagagaagctcttttattctgattattttagttatttgagtttcttgataatgtcaaggtgacattttttaaaaaacatctcactaatatgtttacataattttcaagattatctgtaggaattacattgtcccattataaattagtctatttcttatttgaatctttcatttttaatttacacttttaaaaattggaagtctgaatatctctattgatccatcacaccttttcaaagagactagattaatttcctctgtgatttgaattctcaaagttgtagaaggctttaatcccattgacaggcatcagtgtcattcacactcatatttgattttttttagccttcaacaagagatctgaaaaagagaatagtagataatattgaaaacagaa

SEQ ID NO: 31679 - DNA, 601 bp, Human
atttcttctgttgctaagaaagatatccctcgcaacttaatacctaggtgatgggatgatctgtgcatcaaacccaccatggcacacgtttacctgtgtaacaaacctgcacatcctgcacgtgcatccctgaaattaaaataaaagttggaggccatacatggtggctcatgcctgtaatcccagcactttgggatgctgaggcggacggatcatgaggtcaggagatcgagaccatcatggccaacatggtgaaaccctgtctctactaaaaatacaaaactagctgggtgtggtggcrtgcacctgtaattccagctgcttgggaggctgaggcaggagaatcgcttgaacctgggaggcggagattgcagtgagccaagattgtgccactgcactccagcctggtgacagagtgagactccatctcaaaaaaaaaaaaaaaaatgaaaaaagaaaactaaagttggagcaaaaagaaaatggccgggcacggtgggtcacgcctgtaatcccagcactttgggaggccgaggcaggcggatcacaaggtcaggagattgagaccatcctggctaacatggtgaaaccttgtctctac

SEQ ID NO: 31680 - DNA, 601 bp, Human
catccctgaaattaaaataaaagttggaggccatacatggtggctcatgcctgtaatcccagcactttgggatgctgaggcggacggatcatgaggtcaggagatcgagaccatcatggccaacatggtgaaaccctgtctctactaaaaatacaaaactagctgggtgtggtggcatgcacctgtaattccagctgcttgggaggctgaggcaggagaatcgcttgaacctgggaggcggagattgcagtgagccaagattgtgccactgcactccagcctggtgacagagtgagactcyatctcaaaaaaaaaaaaaaaaatgaaaaaagaaaactaaagttggagcaaaaagaaaatggccgggcacggtgggtcacgcctgtaatcccagcactttgggaggccgaggcaggcggatcacaaggtcaggagattgagaccatcctggctaacatggtgaaaccttgtctctactaaaaatacaaaaaaaaaaaattagccaggcgtgatggggggcacctgtagccccagctacttgggaggctgaggcaggagaatggagtgaaccgggggggcggagcttgcagtgagccgagat

SEQ ID NO: 31681 - DNA, 601 bp, Human
gaatcgcttgaacctgggaggcggagattgcagtgagccaagattgtgccactgcactccagcctggtgacagagtgagactccatctcaaaaaaaaaaaaaaaaatgaaaaaagaaaactaaagttggagcaaaaagaaaatggccgggcacggtgggtcacgcctgtaatcccagcactttgggaggccgaggcaggcggatcacaaggtcaggagattgagaccatcctggctaacatggtgaaaccttgtctctactaaaaatacaaaaaaaaaaaattagccaggcgtgatggggkgcacctgtagccccagctacttgggaggctgaggcaggagaatggagtgaaccgggggggcggagcttgcagtgagccgagatcgcgccactgcactccagcctgggtgacagagcaagactccgtctcaaaaaaaataaataaataaaaataaaagtggtggggcatggtggctcctgcctgtaatcccagcactttgggaggccgaggtgggcggattatttgaggtcaggaggttgagaccagcccagccaacatagtgaatcgccgtctctactgaaaataccaaagttagccagg

SEQ ID NO: 31682 - DNA, 601 bp, Human
gcaaaaagaaaatggccgggcacggtgggtcacgcctgtaatcccagcactttgggaggccgaggcaggcggatcacaaggtcaggagattgagaccatcctggctaacatggtgaaaccttgtctctactaaaaatacaaaaaaaaaaaattagccaggcgtgatggggggcacctgtagccccagctacttgggaggctgaggcaggagaatggagtgaaccgggggggcggagcttgcagtgagccgagatcgcgccactgcactccagcctgggtgacagagcaagactccgtctcaaaaaaaataaataaataaaaataaaagtggtggggcatggtggctcctgcctgtaatcccagcactttgggaggccgaggtgggcggattatttgaggtcaggaggttgagaccagcccagccaacatagtgaatcgccgtctctactgaaaataccaaagttagccaggtgtgatcgcacgcgcctgtagttccagctacttgaggcaggagaattgcttgaacccaggaggcagaggttgcagtgagccaagattgtgccactgcactcctgcctcagcgacagagagagactacgtc

SEQ ID NO: 31683 - DNA, 601 bp, Human
gactccgtctcaaaaaaaataaataaataaaaataaaagtggtggggcatggtggctcctgcctgtaatcccagcactttgggaggccgaggtgggcggattatttgaggtcaggaggttgagaccagcccagccaacatagtgaatcgccgtctctactgaaaataccaaagttagccaggtgtgatcgcacgcgcctgtagttccagctacttgaggcaggagaattgcttgaacccaggaggcagaggttgcagtgagccaagattgtgccactgcactcctgcctcagcgacagagwgagactacgtctaaaaataaataaataaatgataaaagtaatataatactataaaaaatttggaggccagatgtgatggctcacacctgtaatcccagcactttgggaggcccaggcgcagggatcacctgagctcaggagttagagaccaacctgatcaacatggccaaaacctgtctccaccaaaaatacaaaaaattatttgggcatggtggtatgagcctgaggtcccaaggaagctgaggttagaggattgcttgagcctaggagatggaggttgcagtgaacagagattgcacc

SEQ ID NO: 31684 - DNA, 601 bp, Human
ccaggtgtgatcgcacgcgcctgtagttccagctacttgaggcaggagaattgcttgaacccaggaggcagaggttgcagtgagccaagattgtgccactgcactcctgcctcagcgacagagagagactacgtctaaaaataaataaataaatgataaaagtaatataatactataaaaaatttggaggccagatgtgatggctcacacctgtaatcccagcactttgggaggcccaggcgcagggatcacctgagctcaggagttagagaccaacctgatcaacatggccaaaacctgyctccaccaaaaatacaaaaaattatttgggcatggtggtatgagcctgaggtcccaaggaagctgaggttagaggattgcttgagcctaggagatggaggttgcagtgaacagagattgcaccactgcactccagcctgggtgacagtgagacccctggctaaaaaaaaaaaaaaattggagaaaccaccaaaaacctcttaatacctccacattaacaaattcagttagttactgttatttttacagtataattttacttgtttttactttaccttacattctcttttatgcatacatt

SEQ ID NO: 31685 - DNA, 601 bp, Human
gctgaggttagaggattgcttgagcctaggagatggaggttgcagtgaacagagattgcaccactgcactccagcctgggtgacagtgagacccctggctaaaaaaaaaaaaaaattggagaaaccaccaaaaacctcttaatacctccacattaacaaattcagttagttactgttatttttacagtataattttacttgtttttactttaccttacattctcttttatgcatacatttttacagttcttatcataatatacatttcaatttctatctctaccattgttatatacttgtgcatgttaatacattatcttcatagatacgataatgtaattaattttgtgaaaatagcaatttcctctccaattttgtaggaaaaaaatgggatcccttattttgttttgatttttatttatttgattactagtggagttgaagacttttctatatgcttgttaattatatttcatatttcattaattacatttcatatcttctcattatattttagagttttaatgctttttctcagtttcataggtcagtgcaagtatgtgggatataatgaatatcttaaagtgagcgttttatattt

SEQ ID NO: 31686 - DNA, 601 bp, Human
taatattctgaaggccctgatatatttgagctaaaataattttaaaattatttgtatcgactttcatactcaagtgaatgagataattgatttttcatcatattattaaattgttgacaaataagactaaaatttcactaatgagtactctattaagaaaatatatcaacctttaccctgaaattgtttaagagtatagtatattaggtagacacctaatttctaaatacctgtcatcaaacactggcattgaaataagtgactgtgttatataatgcagtgtaatgtatttgtagttgakatttttctaatgcaaaaaaatttaatgtattaaatatcctgtcagttgaaatgagaactctactctgcaatgcctcagaataaatgagtttccctttacaagaagggagggttaaattcattgaaatattttggcttcttgggtttctgaattatctctaagcactccactatagtggagtgtataggaatgtggaagctcttattaaaagttgcagaaaggtttaatagattcagtttaaaaaaatttagtatgtagaggcattaattattttgattatttataataacaaaactaatt

SEQ ID NO: 31687 - DNA, 601 bp, Human
ttattaagatttcactgtaattaaaatattttggcccagatagggcttttataaatgcagactcagctcagctgctgttctgttccttccacctgtgttgcatcagaatgattgggagtctttatgtgtaactgactagccgcctagggcaggctcttaaacgaaccaaactcttacagctgctatccctgatgtctgtgaggaagtactgcagttgacagagttgattttattatggcagaagtcaatttctaagggacttgttaatggagtcattgttggtactcatcatcaagctttrtatttatgcacttgaaatgttaagctgtatccagtgccattccatatactgtatacaagatactgtctcatatgtggaccccttcccatcttcagaaaggtacatgtcttccaggttgagaagagtggatcgtttaggacctttaacataaacaagttacctgtaatttaaattaagcagaattagctaggtaatgggaccatattaagtaatgaggagatattcaaacccttatgacctgaaaggcagaagagctagttttagttatgtggttcaggcctaggggtggtatgaagaatg

SEQ ID NO: 31688 - DNA, 601 bp, Human
gatgcaacctatgtaaacaactctccaaacaatatatgtaaaggagaaatacaaggatagtcatttataataaaatgtttatttaatatgaaagtgcttctgcataactgcagtagaagacatgataagcgatcagatgtttttgcttacgtatagaatcaccacgaatgctgtatctacaaatacaaattgatataggaatgttgtgttgggcattcacatgccatgaaattgtgaacaatcctttgtgaagttctgaacagagccaagtacaatattctctcaattacacagtatttgygtaagccctagacaaattctgtgaatattaaaggcatgcaaaaaatacgttgtttacatgtataactttgtttacatgtaaaatatgtgtttgtatgtgtttttcacctctgtatgtctcacagacatgttaaagttaaatggggcatggagtagttcttccttgggtaggacatttggcattcctttccccttacctcagcagatgccaggagtatactcacacattgttgttaccacaatactgccccaaattttgaaaatatctctgagtgggcactcttgccctccattgccacaa

SEQ ID NO: 31689 - DNA, 601 bp, Human
atcaatcctctttaagaggaagtatattttaggtagtaggtggataatggagaatttccttgtgtcacacctaagaagcaatatttttgttctttaatagttagttagtttaatattttgtgccaccttcttttcatgtcttgaaatgtgatgtatttaaacgcttctcgttaccttgagcttaaagtcttgcagcttattctgagtgtctgctatttgcaagtgtaatcttttgctgaaaaataagtttattattacagaaaagaaattgttcccatattttctgattaatgatctcaarttatatgcataaaagtcttaaaggccaggtgtggtggctcacgcctgtaatcccagcactttgggaggctgaggtgggcagatcacttgagctcaggagttcgagaccagcctgggcaacatggcaagaccccatctctacaaaaattataaaaattagcctggcttgttggtgggtgcctgtagtcccagctatttaggaggctgaggtgggagaattgcttgagcccgggtggtggaggttgcagtgagccaagattgtaccactgcactccagcctgggtgaaagagccagacccct

SEQ ID NO: 31690 - DNA, 601 bp, Human
caaaaaagcaggccttaaagcactgcgtagcactgttttgaaaaagttgaatttatttcattttattgactgctttggattttatttctttcctctttccccatatgtgctactaaatgagtcatgatacagcacttgtgccctttgaaatctctgttatttacctcatgagctaaaacctcttgaatttactagttttcttattacttatgagggtgtgttttttgtgtgcttatagaacttttctaagtgttcttatagcagtgaagcctacaaagtaagagtttccagattccatccrttcttttagctgacttgaatgactctaatgcagtgggttgcaggtttggctacttacctatgtactctgtaaacatccagaggcccagggatattctgagccactgtgtgtgaatggagtttggccatctgtagatttccgcagtctctccaggtgatcgcactgtgcagcctcattgctcataaacaaaactttaatatgcttttaatgatctttcaagtgtgttgaggatttctttcttgattttgaggaatatatgtcagtatatttttcaactttaagtgttcgtatatatattag

SEQ ID NO: 31691 - DNA, 601 bp, Human
gcttatagaacttttctaagtgttcttatagcagtgaagcctacaaagtaagagtttccagattccatccgttcttttagctgacttgaatgactctaatgcagtgggttgcaggtttggctacttacctatgtactctgtaaacatccagaggcccagggatattctgagccactgtgtgtgaatggagtttggccatctgtagatttccgcagtctctccaggtgatcgcactgtgcagcctcattgctcataaacaaaactttaatatgcttttaatgatctttcaagtgtgttgagratttctttcttgattttgaggaatatatgtcagtatatttttcaactttaagtgttcgtatatatattagtaaaaacattgaaactgaagtctgggggaagtttgtggaactagaatattagaatcaaaagtttggatttaaaatctaatgtgactatcgagtggcatgctggaaatttttaatttatttggccatcttttagtatgccattcttaatctcatctgtcaaagaaacaaaaattatgtttttctagtagctgtttccggttttcaaacttatgcatgctttcttgcctctt

SEQ ID NO: 31692 - DNA, 601 bp, Human
ttatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaargctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataag

SEQ ID NO: 31693 - DNA, 601 bp, Human
tgatatgtcctattagatctgttttatattttgttttaattttctctgcatagaacagccttttgaaagtaaaaaataaaatttttcaccattttaaaacattaggcaatatatgtttgaaaaagttaaaagtcacaaagagatcaagactgtttaatagttacttttttgagggaaatccagtcacatttgcctgtaccattacatacaccattacttggacattcacactcaattgggaacataaattacaaaagagagaggaacttttaaaaccacatttaatttttaataccaaatytgttgcactattacagaagtgaccctttcatgcacagataaatttcgcatctaccagtatggaagaggaaaaaatgtagttttattgttctcccaaaatattggcaaatttaaagtaacttttaatctttgtgctctctgatgccaaggcaaacctgttttgtctttttatattttcaagagacaggtggatctgtgaaaaatgaatatagagacatgaaagtatttagggccatctttacctgggattactttaaattatgctttacctacatatatcaaacatgccaggttactaggc

SEQ ID NO: 31694 - DNA, 601 bp, Human
agcttggtgtggctggggggagggagagagagagagagaaaagtaggagttaagtaaggggagtggcacggctaaatcagggcttgtggaacattgtaaggacgctgcctttaactctgagtgagacaggaagccctgggagggttttcaaagaataagtgacatgctctgacttatattttaaaagcactactctgccatcagtgttgagaatagcctaccttagagggctggggttggtaaactacagtaaaattaggccacgcccatttatcacataatgtctatggctgctttagcrctacaatagcagaattgcagagttgcagcagagaccgcgcggcctgtaaagtctaaaatatttagttggccaacctctgctctatagagtcaggggagaatattacaataatccaggagtgagatgactgtgacttggaccagagtggaacactggaggtggtataaaatgctcagattatgaacatattttgaaggtagagccaacaggattttctgataggttagatatggaataacagagaaaaagatggtgccaggatttttggtttgagcaacaggaagcttggaagtactgtta

SEQ ID NO: 31695 - DNA, 601 bp, Human
tttttttcttgtcactgaagggaaaatggtcaggtaaagaaaatataaatttaatgggcccactaaattgaataaaccattaccttatagggaaagcaatgttacacatcacaatatgaagacttagttcatgcattacttcctttgaaaaactccatgaaccttccctgcaactctctccttgccagttggttttaggtgttacttcagcatccataacttatgtggagtctaagaaagtaggctcactaatgttttcagagaactgattgatttactcctccaaatgccttatgatcaytgacaatgtttagattgccattatataaaaagggatcaaaagtcatttgaagagaaagtccaaactcatggctctgggaagacaaaatattacaatctacatgatttcccccatgatctttttagtttaatggattattatgtagcattataaagcaattttaatctttctttcttacctggatatttaccacccttgtttcttctgatgaagcaaacaatcagcaaaattaagataaggagagcaacagcacacatcagaccaatgaaccagccctgagttgcaatatccacctgccgg

SEQ ID NO: 31696 - DNA, 601 bp, Human
ctggggacttacagtgagaacttacagtcaacacaaagatttctgaatgtttcaacatgtattaaattgacatttcaccgtgctcgcacgattcaaggttttgagtttcagtaactcattcctgattcagctgaaaatacattagtacaaacctgtgacaggcacccatttagttattctcttcctttttctctcttgtcatttacatttatatttaataaaaccatcctctcaaaacacataatgactttgcctttagatggactcaaacctaatattttaaaaagaggcagtacttgtytgacgcatgaatggtgtcttaatagaagcaaactagctaccaagtgaaactattctaactggatctgagtggaagcagctgtgttctggaccattaaggactgttttctctaacaaaccaggtgtctccaaacagtcagaatgccctgcctgctgggctttgggccagcatgcccaggtgcagaaacgttcttatcctgagagctgacagctgcccaggatctggtggtgaatggacaaaagcccaaccttggcacacccccagccctggggaaggcccgaggggtctcaggttctctgt

SEQ ID NO: 31697 - DNA, 601 bp, Human
aagtcaactctggcagtggctacctgaggcaatgagcgaaatgaactcttcagtccacaagttcacaaagcaatgaaacaaataagccccacctcctgtggtgtgcatgacaagtggcattcgctgcagcccttactaaataaagccacaaaaggtcccctttcacttgcccgatagccttgtaggtgtcctcggatgcttttcagaggtactgggtcccagtgcacctcggctaaggtactgttcaccacattcacacgcacgttcccaggagccaccattgggactaggaaaaggacarggaagtggtagaagtatcaatgttatttttaatttcatccataaatatgactctctctaataattttggcttgaagcatactgcagacctattctatggattattaaggcttgaacacagattttggggtatctgtttgactttgtgagagatttttttttttaagagatggcatcttgctatgttgcccaggctagactcaaattccttgactcaagggatcctcccaccatcagtgggtaggaaaacacgattttttaaaaagtacaattgacccttgaacaacacaggtttgaactg

SEQ ID NO: 31698 - DNA, 601 bp, Human
tattttttcttttcaaccaaatgcagggaagccagttgtgctatttttgttttcgttcttaccaacaacgctaagcacagcgctggcggagacgctgtccagagtggtgttggccacacacgtgtaggtcccgctgtcatcgtcactgacatcagctaccactagatgatccttgtcaacagtgaacctgtggatagaatgcattcagagcagctgaaatggacatgcagccgtaccctataattgcttcactggcaggaaaaaaactgtaaatttgataaaggagaaagatggtaaacaytttcaaaagttagagcaaaatacatatcactttaagaatgattaaagttgaaaaacaatgagaatcaattagaatattgggttagaagggatatgtcctctggcacagtatttttcaaccaggcctctagagcacgggtccccaaaccctgggccaagaactgggtactgtcctgttaggaactgggctgcagaggggaccgctgctctagagggtgtggtaggagtttccttaggccccaggggaatggggcgagtgaagctgagctccgcctcctgtcagattagtggcagcattaga

SEQ ID NO: 31699 - DNA, 601 bp, Human
ggtcagctgtaggtgaaccacacaaatgatttcgaccagaatacagcattccttctaatagagagtgaggcctatagccactttgctaaaactaacacatatctactctgtactactatgtcaaattgagggtctcatctggaaaatgccatgacctttcttccattcttaatgaaatctgcagcatgcttgggctcttttaaatgctctacctgtttttgtttttccttcccctttcactggctttaggtaaaatcaaaagaaaaactccctatccaaataaaaacgagtgtcttaaaakactgacaaggatttgagcagtctttggtgattaaagaggtcatatttctgcttatttgtagaaaggtaatgaaaacatctgttgagacttcgctgttcaaggtataaaacaatggatgctgtccaggcctgagggttttttcccatcctgaattacacaagagaccagcacgcaaagatagacaaacattctcagggtcctatttcaatcacctgataccttcttgggtgcatatattttacagtagggagaaaatgcttatctctctattttggagacagcagacttcagaaactaaaa

SEQ ID NO: 31700 - DNA, 601 bp, Human
atgaaagtatttaacacagagccagtagttaataaatatttgtgaaataatgaatgaatttaataattaacagtgtaggccaagcacagtggctcatacctataatcccagcactttgggaggctgaggcgggcggataacctgaggttacgagtttgagattagcctggccaacatggtgaaaccctctctctattaaaaatacaaaaaattagccaggtgtggtggcaggcggctgtaggcccagatactctagaggctgaggcaggagatatgcttgaacccaggaggcagaggctgyagtgagctgtgattgtgccactgcactccagcctgggtaatgaagtgagactctgtctcacaagaaaaaaaaaatatattaacagtgtaatggattgtgtggtgcctttccctgtttgtttttgaataaaacccaacatatttagaatatgaagcctttagcaaacattttaagtattgaaaaacacacagagctgctacttaccactcgatggttgggagaggagacccaaagaaggcacagtctagtaaagcaggcctgtttgcaatgacctggtagagtgtgtttgcaggtgtgagg

SEQ ID NO: 31701 - DNA, 601 bp, Human
ataattaacagtgtaggccaagcacagtggctcatacctataatcccagcactttgggaggctgaggcgggcggataacctgaggttacgagtttgagattagcctggccaacatggtgaaaccctctctctattaaaaatacaaaaaattagccaggtgtggtggcaggcggctgtaggcccagatactctagaggctgaggcaggagatatgcttgaacccaggaggcagaggctgcagtgagctgtgattgtgccactgcactccagcctgggtaatgaagtgagactctgtctcacragaaaaaaaaaatatattaacagtgtaatggattgtgtggtgcctttccctgtttgtttttgaataaaacccaacatatttagaatatgaagcctttagcaaacattttaagtattgaaaaacacacagagctgctacttaccactcgatggttgggagaggagacccaaagaaggcacagtctagtaaagcaggcctgtttgcaatgacctggtagagtgtgtttgcaggtgtgaggattcgtggtggctcagctacaaatatttttaaaaggtaaagtaaatattagaatacatttta

SEQ ID NO: 31702 - DNA, 601 bp, Human
attaacagtgtaggccaagcacagtggctcatacctataatcccagcactttgggaggctgaggcgggcggataacctgaggttacgagtttgagattagcctggccaacatggtgaaaccctctctctattaaaaatacaaaaaattagccaggtgtggtggcaggcggctgtaggcccagatactctagaggctgaggcaggagatatgcttgaacccaggaggcagaggctgcagtgagctgtgattgtgccactgcactccagcctgggtaatgaagtgagactctgtctcacaagaaaaaaaaaatatattaacagtgtaatggattgtgtggtgcctttccctgtttgtttttgaataaaacccaacatatttagaatatgaagcctttagcaaacattttaagtattgaaaaacacacagagctgctacttaccactcgatggttgggagaggagacccaaagaaggcacagtctagtaaagcaggcctgtttgcaatgacctggtagagtgtgtttgcaggtgtgaggattcgtggtggctcagctacaaatatttttaaaaggtaaagtaaatattagaatacattttagga

SEQ ID NO: 31703 - DNA, 601 bp, Human
gatttactgtgagtccactgcagtcagggaatgagacttttgtcttatccccagcacagtgtctggcacaaaaataacagccaagtatatttttgttgaatgactcactcatcataaccctagtgggtaggaacggtggggaacacataagctggcagaaaaaagcagagtgatgagtgtgatggctgaataaatggaaccacagcaacaaaaacaaaaatagacaaatgggattacaccagactaaaaagcttgcacagccaaagagatagtcaacaaagtgaagaaacaacctatggamggggagaaaacatttgcaaaccatgtatctggtaaggggttaataccaaaatatataaagaactcaaataattcaatagtaagaaaatgaataacctggttaaaaatgggcaaggcattggactagacagttctcaaaagaagatatacaaacggccaacaggtatatgggaaaatgcccaattatcaccaatcgccagataaatgtaaattaaaaccacaatgagatattatatcacacttattagaatggctattatcaaaaagaggagatctaagtgttggcaagaatgtagagaaa

SEQ ID NO: 31704 - DNA, 601 bp, Human
cagtgtctggcacaaaaataacagccaagtatatttttgttgaatgactcactcatcataaccctagtgggtaggaacggtggggaacacataagctggcagaaaaaagcagagtgatgagtgtgatggctgaataaatggaaccacagcaacaaaaacaaaaatagacaaatgggattacaccagactaaaaagcttgcacagccaaagagatagtcaacaaagtgaagaaacaacctatggaaggggagaaaacatttgcaaaccatgtatctggtaaggggttaataccaaaatatayaaagaactcaaataattcaatagtaagaaaatgaataacctggttaaaaatgggcaaggcattggactagacagttctcaaaagaagatatacaaacggccaacaggtatatgggaaaatgcccaattatcaccaatcgccagataaatgtaaattaaaaccacaatgagatattatatcacacttattagaatggctattatcaaaaagaggagatctaagtgttggcaagaatgtagagaaaaggggacacttaaacattgtgggagggaatataagttagtacagccattatggaaa

SEQ ID NO: 31705 - DNA, 601 bp, Human
tggttggcttactgatggtaattttgtttgaaaaggaagcatactaattttaaagggctgaagtataattccctggcaccatgaaaacaattctcacaaaaattttaacaaatgtggtattttggtagttttgtccaatataagaaatacaatgttcacataagccaattatttgagaatatgtttcagtatatcacactttttaaaatatgtttttacaaataaaataaatgtacatctgtgacttggataaaggccaagcattatgattcatgcattagtttttaaaaatcagaatcaytgttattcaacttgtcagtgtcttacaacgaagagcaataatattcagatgctaatagcagacaaatgctattttccttttgagggtttgacacttagtctaaccatctgtaagtagaacagcttatttgactagttctacaatgaagaatttgccattgtaaaaactgtgttatggaagaacattaagactgcaatattctttggggcaaggtttatatcttatccatcccttatagctccaagtactgtgcattgcacatagtagatgctcaatatatttttgctgattgaacagaaa

SEQ ID NO: 31706 - DNA, 601 bp, Human
tttggaacttctgtgagattggagatgaattcctttctgtgaatgatacactttaggctttgagcttatattgctttagaagtacactaagagggatttaggtctctgtctcagcacgatgatcaaaatcaaaactaaataacagcaccttttctcttaaactgctcctgcaacttgaagcatttaagaagactttatgttctttctaagcaccatttctttttccttggtgaaaggaaaaggatgtgcatctaagacacactcatcactgtatttagactcttttatcacttttaaaataaaaaaaaatttgtttcatctgtggtttattaacccactgtaataaaaatcaaccaaaccatagtacatccttgttttatgacccaaactcgaagtatttggctccctcattctgtaatagttttccacggttgctgtaacaacttaccacaaatgtagtggcttagaacaacacaaatttactgtcatacagttctgtaggttagaagtctgacatgggtcacactgctctaaaaccaatgcgtgagcagagctgcgtcgctttctgaaggttctaggggagaatccatgtccttgcctt

SEQ ID NO: 31707 - DNA, 601 bp, Human
cactcatcactgtatttagactcttttatcacttttaaaataaaaaaaaatttgtttcatctgtggtttattaacccactgtaataaaaatcaaccaaaccatagtacatccttgttttatgacccaaactcgaagtatttggctccctcattctgtaatagttttccacggttgctgtaacaacttaccacaaatgtagtggcttagaacaacacaaatttactgtcatacagttctgtaggttagaagtctgacatgggtcacactgctctaaaaccaatgcgtgagcagagctgcgtygctttctgaaggttctaggggagaatccatgtccttgccttttccagcctctggaggctgcccacattccttggcccatggtcctcttcctccattttcaaagctgtcgatgttgcatctctctgatcattcttccatagtcacctttctttccaaccaaagccggaaaaggcactctgcttttgggggctcatgtaattaaattgggcccaaattagatagtccaggataacctccccatctcaaggcccttaaccttaatcacatgtgcaaattcccttttgccatgtaaggtgacat

SEQ ID NO: 31708 - DNA, 601 bp, Human
acatattcatagtttctagggattgggatgtagacatcgtggcggggtggggtagaaggagggattattctgtctaccacatactgtatcacatttatagcctaaaagtcttttagatgttttagactagaatattttaaaaattcgccatacatttaagttcagaataagtttttagcatccaaggattattaaaactctaacttacaagttactcctcatggactgattaacgtcttcattcccaaggaaaaatgtaacaaaaaagcagttgttcaacactctgattaccatcagtaaytcatttatgaaatcatcttagatactccaggttgttcaactagttatgtgggggtgtcgagatactttgaattgacttcttagcttacatctcctatttatgactctaataatttcaaaattgccttaaggaacatgttcttccaaatcaaagacaaatacaagtcataattccttcaacagggtatatagattcgttgataaaagacagcagaggatggatatgacacactggcctagaaagggaactgtagctgtggcaggcagccatggatcctgaaaacacagtgtaccttagggc

SEQ ID NO: 31709 - DNA, 601 bp, Human
gtgtggggggcagcgaggcataaaagactatatattgggtacagtgtgtacactgctcgggtggccggtgcaccaaaatctcagaacttattcatgtaaccaaatgccacctgttgcccaaaaatctatggaaataaaaaataatacaagaataaagtagagaaacaaactaaatttttaaggtcggtaaaaaaaaaaaaaaaaagaaaaagattcttagcacttctggacccagcacttgggctctcagtgctgggactcttcagggcactctcggtgcccaccatgtgcccaccctgaycgcatctctgtggatgttccaggcagtggaatagagtggctgtgtattttagactgtgatgaatcccaggcagagctctgggccgaatctctctggatgggtggcagactacataagagttcctcaaattccttaaatgtattgagtttttaaaagttacaccaccacgcgatatttaatggctaaagggctctagttctgaagatctgttgcacaatgtgaaaatgcttaacactactgaactgtacacttaaaatggttaagatggtaaattttgttatgtgtttttaccacaataat

SEQ ID NO: 31710 - DNA, 601 bp, Human
tgtttttaccacaataataataataatgttacacgaccatgaacttggagggcaaagctcaacaatgtcagtaggacaattttccccaagtggagactcatcagtcacaaacaaaccatgtcagaaagcttttctgttgctctcagttgcacttttctttgctatcaactctttgggaaggtatttttttacctgaaaggcatctgactgtatctgccttatatatgctaaatagagcagtcttcaaatatttatttttggcaaggtatttaggaacaaaataaaccctttaggtaataayaatgagtaagcagacctctctccatgggagttttccttaagtacttgtttaaaaaatgcaaacaaacccaggaactgtcacggtgacatatggaggctcggttggtagctggacacagagtaaaatcactaatgtagagacatttggagcctttggatgggctggctagtgggtagagtaactctctagcatgcaaatccaaattatccagaggaataatcattaattctaggaataaccaacttcatctgctgtcaataaacactggagaaagaaatttaaaagcacagaatccctaca

SEQ ID NO: 31711 - DNA, 601 bp, Human
atagagcagtcttcaaatatttatttttggcaaggtatttaggaacaaaataaaccctttaggtaataataatgagtaagcagacctctctccatgggagttttccttaagtacttgtttaaaaaatgcaaacaaacccaggaactgtcacggtgacatatggaggctcggttggtagctggacacagagtaaaatcactaatgtagagacatttggagcctttggatgggctggctagtgggtagagtaactctctagcatgcaaatccaaattatccagaggaataatcattaattctrggaataaccaacttcatctgctgtcaataaacactggagaaagaaatttaaaagcacagaatccctacaaataacttaaagccacaaagataaggtccagaactggggtgatggccttcagaaaatacttataacccaactctcctgatgttggtaggtaaaaatataaacactttcaacatatagataatgagaataataataataatcatgccatcttacatgaacagagtacgatcaatctttaaaatgcttttacatttactgcataatttcattttaaaaagaactttgtgaaac

SEQ ID NO: 31712 - DNA, 601 bp, Human
cggttggtagctggacacagagtaaaatcactaatgtagagacatttggagcctttggatgggctggctagtgggtagagtaactctctagcatgcaaatccaaattatccagaggaataatcattaattctaggaataaccaacttcatctgctgtcaataaacactggagaaagaaatttaaaagcacagaatccctacaaataacttaaagccacaaagataaggtccagaactggggtgatggccttcagaaaatacttataacccaactctcctgatgttggtaggtaaaaatatraacactttcaacatatagataatgagaataataataataatcatgccatcttacatgaacagagtacgatcaatctttaaaatgcttttacatttactgcataatttcattttaaaaagaactttgtgaaacaggctaatcatatagtattttatgcattttggagatgagagactacaaatggcagcatgtactggtttgttcaaatgaggttactgctcaggttttctcagttagtcaactttgtaaacatttcctggaacgtgaacatttgggcataatgtagaacacatttctggg

SEQ ID NO: 31713 - DNA, 601 bp, Human
gctaatcatatagtattttatgcattttggagatgagagactacaaatggcagcatgtactggtttgttcaaatgaggttactgctcaggttttctcagttagtcaactttgtaaacatttcctggaacgtgaacatttgggcataatgtagaacacatttctgggagaagagttaaatttccctcttcatttacttattccatccctacaagaggatgccactgagccccttagttttgtgaaaaggaagaagggaggatgccttgatgaaatcccaggaatatcctggaccagtcctcyattctcctggtgcttatcttacattcctggctttcaacatctttcattgtgagaaaaatatgtcacagtgccaggaagaggtcttctgcccattctcattctcttagttcttttccctcctcatccctgagaggacaggggccttttaacacaataacggtgtgatcttatccacgtttcatgcagaagagtctgacagacctaatacaacgcacgctggaaactatcaaggatctgcaagtgttagactctcctgcagagataggaatcacagtggccacagccttgggcaccaccacc

SEQ ID NO: 31714 - DNA, 601 bp, Human
taaaattaaagctctctttcagcactagttctctgcagctgtgttcttttatctgacttctgtagattgttttaaaactattttaggtggttttgggaaatttccacatttatttaatacagcctgtaatttttgcttcaaggaaagctttaagtaatctggccagtcctggggatgggggaagggtaaagctttaggagacaatgaaataaaagcccagacacttttggagttaatttttccagtttttttttttttaaaacaacagctttcaggtcttaaatgcagtcacagatcaatracattgcattttgctaaaagaacccttcttaccattcccctccctgaaccagcttctccttttacagtatttatgtgcactcggcagccagagcctgcagaggcgaaaggagacagtcagtgtccttaggtgctcgcctgcaagtcaggagtggggaggctgtgtacctggcagtatggtcccctgactgtatctctgttgtgtggcacaggagacaaacttcaggcacctggaggggacactgcacagcccctgacaacagtagttcagaagcacagctgtttcctgtgcctcacccgc

SEQ ID NO: 31715 - DNA, 601 bp, Human
cagatcaatgacattgcattttgctaaaagaacccttcttaccattcccctccctgaaccagcttctccttttacagtatttatgtgcactcggcagccagagcctgcagaggcgaaaggagacagtcagtgtccttaggtgctcgcctgcaagtcaggagtggggaggctgtgtacctggcagtatggtcccctgactgtatctctgttgtgtggcacaggagacaaacttcaggcacctggaggggacactgcacagcccctgacaacagtagttcagaagcacagctgtttcctgtgyctcacccgcagcagctggtccacctgcaatttctgcagtctcttggatagaaagtgctgtcagcaagccagcttgtgctcccagctcacttctggcgcctatgctaggaccccatgatgaaggcaaggagtcttcattgtgctaattcagccctgtcacacatggtggcagactgtgccctcagttcctaccttcacctctctgcatctccctgtcatccttcccccgtctcccagccgtgctagatgtggggtgcacaagtcagcaaactccagatgggaagcaagcactggtgctccg

SEQ ID NO: 31716 - DNA, 601 bp, Human
aacttcaggcacctggaggggacactgcacagcccctgacaacagtagttcagaagcacagctgtttcctgtgcctcacccgcagcagctggtccacctgcaatttctgcagtctcttggatagaaagtgctgtcagcaagccagcttgtgctcccagctcacttctggcgcctatgctaggaccccatgatgaaggcaaggagtcttcattgtgctaattcagccctgtcacacatggtggcagactgtgccctcagttcctaccttcacctctctgcatctccctgtcatccttccccygtctcccagccgtgctagatgtggggtgcacaagtcagcaaactccagatgggaagcaagcactggtgctccgtttccaggatggtccctaaccctcaaaggcaattcccttcaggggcctctaaattcatgggacaattaccaagaaggggatgaaaaagagagcggcacagggctccttaaatgtctattaatgttttggatagtttctgcacccccctcattctctcattattttggatcaggggagatcaacacacagtgggggcatgcagggttcactttgaacttagctgttga

SEQ ID NO: 31717 - DNA, 601 bp, Human
ctttctgctattactactctgtacccccaaagcaggccttttatggttgattctccccacaaaaatgtaatttaaaaggggagtgttattatgttatgagtgtattttcaaagctgttaagatgactggatttacaaggttccctcagaggcactgcatactctggtactatggtctgaatatttgtgtccctccaaaattcatgttgaaacctaactccaaggttaagaggtggggtctctgggaggtgatcaggaaatgagggtttccccctcatgaatgagattggtgctgttctaawggtcttgagggagcccgtatgctccttctaccatgtgaggacacatagcagcatctgtgaggaacaggccatcaccagacatgaaatctgctggttctttgatcttggactttccagcctccagaactgtgagcaatatatttctgttgtttataaattacccagtctaaggcattttgttatagcagcaggaatggactaagatggctggtttggaaggacaacaagctgagcaaatcaagaagaaaaatcagcttcattatttaatcctcccctgcttatgtcatccacccacatctc

SEQ ID NO: 31718 - DNA, 601 bp, Human
ttttagttctaggctttcttctactttttcctctcagttttcactcatattcccctgagagtagcaagagcttcctgaaacacaaccacaaagtactctctgccatttctctggatcctgatcctggttaaaattgggaatggaaatacccaaaccctatttgctggcctctagcatctgttttctcccaggaatacacttccttctacagtgaagacagtctgcctgtttcaaagtatctgacagctactgtactacgagacacaagtgaacttccaataaatattcatggggcaggctrcaacgactcagtcaccctgcagttgtcagaccttgatggtaagaaacagagacttgtgccactttaaatctgccagcaggtttttggaaccatcttaggggaagtgtgtgtgttactttgggaaagtcaattcggcagaccttttggttatgtaaatgtagaaccaatattggattctgacttggaggcagtcaaagccaatctgtcctgtatcataagcctgagggctatctttattgtgagtaaagaatacctttgcaggtaatcatgttattgactgggagagtgaacctaaggctg

SEQ ID NO: 31719 - DNA, 601 bp, Human
catgttattgactgggagagtgaacctaaggctgggtttgatgctgaaactgactttctctgtcttggtgtctaagaggaggtctgaactccaagaaggggaaaatgttgaaagatgctcctctcggcagtagctggtggtgggtggggtagaggaagaggagagtctagtgggttctctgttcatggccatggcttaggaattaaggagcagtgaggtgcaacatccatttaaagattttttctttgctataattcccttgactctccccaagcctttagccaagttttgtaaagctggyctttgctatgatttagcagattaatgggagggcctgaagccacacgctgggaagcatagtggtagcttggagatattggctaatgaagtggaaggagtggagcatcggagcagggaggctgctgaacggggcaacaagtatagccaggatgcccaggtgctgctcaaggatgatagcagcagctctcagggagggagcactagtcaaaggtaaagcatcctgcatacgatcagggtcagaggatgtgttcttctttgggtatcaaatgggacggtgaccttggaagacagtgagaacacc

SEQ ID NO: 31720 - DNA, 601 bp, Human
aggaggtctgaactccaagaaggggaaaatgttgaaagatgctcctctcggcagtagctggtggtgggtggggtagaggaagaggagagtctagtgggttctctgttcatggccatggcttaggaattaaggagcagtgaggtgcaacatccatttaaagattttttctttgctataattcccttgactctccccaagcctttagccaagttttgtaaagctggcctttgctatgatttagcagattaatgggagggcctgaagccacacgctgggaagcatagtggtagcttggagataytggctaatgaagtggaaggagtggagcatcggagcagggaggctgctgaacggggcaacaagtatagccaggatgcccaggtgctgctcaaggatgatagcagcagctctcagggagggagcactagtcaaaggtaaagcatcctgcatacgatcagggtcagaggatgtgttcttctttgggtatcaaatgggacggtgaccttggaagacagtgagaacacctgggctatacttgctatacttatgactgaaaactctttatattaagacagctgggtttcttatgcttgtcatatcc

SEQ ID NO: 31721 - DNA, 601 bp, Human
ttctaatattgacttttctatttccttcattattcctatattcattaactgggattcttctgtgaggaagatttgaacaagtaaatttttaacctgatttagatgcactaccaatagcaatgagaagagagtcaaggtaccatgaatgttgacataactttacatttaccattactaaaaatgtaatgaaaaccacatttaattaaagtttcagggtctctcatgaaggcaagaagaatggattttaaacaatatacctttaactctaacagaaatggtatggtggatggctcctaatgcrttttttgctatacattggtaatttccagagtctgcttctgaaacatgaatgatctgcaaggttttctcaaagttcttataaactgtcctgtttttgggtagcattccatcttcctttgcccagtaaataattggggtaggcctgataggataaataaataatgatgttacaaaaaaggaatccacctatgactacttttgaggatgaattttcatgcaactttgtaacaaatctttattaaaaaatcataagaaatacatagatattttaattagcaccacacttttataaataatgctc

SEQ ID NO: 31722 - DNA, 601 bp, Human
aagtctggagctccctcaggcagaaaaaggcaggaaaatgtggaggcagagcttcaaagaaagaacatcggttcatcatgttaatcaaattattggttaagatgggggtttggttggtggttgcaaatttatggttttaagccattagttcccgggaaaaggactgtttaaacaataacccaagccgggcttggtggctcatgtctgtaatcccagcactttgggaggccaaggtgggtggatcacctgaggtgaggagttcaagaccagtctggccaacatggcaaaaccctgtctctaytaaaaatacgaaaattagccaggcgtggtggtttgcacctgtaatctcagttactcgggaagctgaggcaggagaatcacctgaacccgggaggcagaggctgcagtgagctgagattgtgccactgcactccagcctgggtgacagagcgagactccatctaaaacaaaaaaaaaaaccctcagaagaattaggtacattttgtttaacaaagagtttaagacaaaaacatttcttgtcctctgtttctcctgctgtagcaataaaataataaattgaagggtgttggcagaccaaatg

SEQ ID NO: 31723 - DNA, 601 bp, Human
aaaggcaggaaaatgtggaggcagagcttcaaagaaagaacatcggttcatcatgttaatcaaattattggttaagatgggggtttggttggtggttgcaaatttatggttttaagccattagttcccgggaaaaggactgtttaaacaataacccaagccgggcttggtggctcatgtctgtaatcccagcactttgggaggccaaggtgggtggatcacctgaggtgaggagttcaagaccagtctggccaacatggcaaaaccctgtctctactaaaaatacgaaaattagccaggcktggtggtttgcacctgtaatctcagttactcgggaagctgaggcaggagaatcacctgaacccgggaggcagaggctgcagtgagctgagattgtgccactgcactccagcctgggtgacagagcgagactccatctaaaacaaaaaaaaaaaccctcagaagaattaggtacattttgtttaacaaagagtttaagacaaaaacatttcttgtcctctgtttctcctgctgtagcaataaaataataaattgaagggtgttggcagaccaaatgttaggcgatgggacttcatgagggt

SEQ ID NO: 31724 - DNA, 601 bp, Human
ggtagacaagtttgaaattgcctaatgaatagcttcattatatctgcctcagtttcctcatctggaaagtggaaaaaataattggacatgcctcatagggttgttgtaaaaattaatgaaataacccatgttaagcccttagtaaaaggcctgacacttggtaaaggcccaataactattagctattgctggggattaaaaaaactaacagaaacataacatatccccaacagcttgacttcctccccgccatgggtttctgggaatggcaattccattttatcattttggagttgttcartctccaaaggtagttatccttgattcctctctctcatgctcccacccccaccccagtaaatcctggaggcttgaccctcaaaatatatccagaatcttaccatttcttacccattctactgctaccactcaagtccaagtcaccaacaaatttcatctagattacagcagtggccccaacagtctctctactctctcttttgcccgctatattctctacatatcaactgaagtgatactgttactacttattttatttcagataaagtcactccttcaacatttccctacttcattccaa

SEQ ID NO: 31725 - DNA, 601 bp, Human
ctctcatgctcccacccccaccccagtaaatcctggaggcttgaccctcaaaatatatccagaatcttaccatttcttacccattctactgctaccactcaagtccaagtcaccaacaaatttcatctagattacagcagtggccccaacagtctctctactctctcttttgcccgctatattctctacatatcaactgaagtgatactgttactacttattttatttcagataaagtcactccttcaacatttccctacttcattccaagctaaagccaaagtcctttccattgagtccygtgacctttctcaccttctccatcaccctcccgctcggctccttcattagttcattagtctggccaccttgtcctccttgcttttatttttacacacagcagagatgctccttccttaggggctagcactagttttccctttctactcagatatttaggggcatggcttgctctctcatttccttaggtctctgctcaaaactctgcttttttttttttcatagaacttattgccaacaaacacagattttctaaatgtacttattgcatttatcatctgcctccttccccactcctatc

SEQ ID NO: 31726 - DNA, 601 bp, Human
tgttactacttattttatttcagataaagtcactccttcaacatttccctacttcattccaagctaaagccaaagtcctttccattgagtcctgtgacctttctcaccttctccatcaccctcccgctcggctccttcattagttcattagtctggccaccttgtcctccttgcttttatttttacacacagcagagatgctccttccttaggggctagcactagttttccctttctactcagatatttaggggcatggcttgctctctcatttccttaggtctctgctcaaaactctgcttttttttttttcatagaacttattgccaacaaacacagattttctaaatgtacttattgcatttatcatctgcctccttccccactcctatctcctcccactgcaaagaatataagcaagatacatagtaaatgtccaataaaattgagtgagtgaatgagatgacatgttatttattttgaagagcagctgttttcctgagcatctctaaaacattttatgaatcataagaggtaataatgtattatgactgtaaacaatcctaagacttttaaagaaagaaagttcatattatcaaaa

SEQ ID NO: 31727 - DNA, 601 bp, Human
aggggctagcactagttttccctttctactcagatatttaggggcatggcttgctctctcatttccttaggtctctgctcaaaactctgcttttttttttttcatagaacttattgccaacaaacacagattttctaaatgtacttattgcatttatcatctgcctccttccccactcctatctcctcccactgcaaagaatataagcaagatacatagtaaatgtccaataaaattgagtgagtgaatgagatgacatgttatttattttgaagagcagctgttttcctgagcatctctraaacattttatgaatcataagaggtaataatgtattatgactgtaaacaatcctaagacttttaaagaaagaaagttcatattatcaaaacttacaattatccatccaaaatattataggtggtggtaatccaattgggggtctgcagggaagtactaaagactgaccactttgaagtgtgattggttcaagtttttctttggtccacaatggtgatcctattaaataaaaaaataacttctcagttatttctgcattgaaaagtacaaaaagaaagccctacaaataaaggcaaactga

SEQ ID NO: 31728 - DNA, 601 bp, Human
acttacaattatccatccaaaatattataggtggtggtaatccaattgggggtctgcagggaagtactaaagactgaccactttgaagtgtgattggttcaagtttttctttggtccacaatggtgatcctattaaataaaaaaataacttctcagttatttctgcattgaaaagtacaaaaagaaagccctacaaataaaggcaaactgaagttttggagaaataatttgtaatttatgtacactaaattaatgagaaaatatttttaaatacaatgttaaaagaaaaaagtaaaaattyaaaaaatgacaattctcatgcattgccactgatagtataaattctcagtcagtgattccacagctgagaatttatactacatacatcatcaggaagacaaacagttttgacacaagcatgttcttcacaaaagaatggaaaacatttaaatgtaaaaagatttgctaaataaagaattacacatctacacctctgaataccatagagtattatataagtacacttatttataagatcgctatgggaatatacacgatatgtcaataagtcagaaaaggttgtaagatagtatttcagaaa

SEQ ID NO: 31729 - DNA, 601 bp, Human
gagaatttatactacatacatcatcaggaagacaaacagttttgacacaagcatgttcttcacaaaagaatggaaaacatttaaatgtaaaaagatttgctaaataaagaattacacatctacacctctgaataccatagagtattatataagtacacttatttataagatcgctatgggaatatacacgatatgtcaataagtcagaaaaggttgtaagatagtatttcagaaaatgagctggttttaaacacatacatacatatctgcctaggaaaaaatagaaagaatatttcagcastagttatttccttgaatggaaggattcatgaacagtttttaaatttcttttttgtttaattagtttttctacaacgaacatgtattatacatgtaattttttttaaatgaccagaactgaaaaatgtgactgttatttaaatacatgctcttaaggtttttgagaggattttggtactaaccattgcaaaaagagccttaataatatcaaggtagtgaggacactccacttccagtaaaattttgaaacaaaaatgtttaaagaaatagcatttagaccttgatcacccatatcatactg

SEQ ID NO: 31730 - DNA, 601 bp, Human
gaaacactttttttttttaaccccaatgtcttacacaggacttctgtaaaagatatattggattggtaaagcattggactaaggagcttcctagggtaaggtggaaaggagcaataactttcatgcaaaacaaagtcagaatattggaagcaatgccactgctttgttgaatagtatttggatgatgtcacagaagctgagtcttggagcaatactttaaaaagggtcatgttggttgacaagtttccacttactggatgggcggacaacaatgttattagaaactgcagctccgcgttcrttccttgctgtacactgatagactccttcataggtctcagctttcccttcgctcatgatgttaattatgagcgttcctgtgccaggcttcatggtgaccagagggtctttatcgatgtcaaaatgagtcccattacgggtccaggaaaagctgcccaacacacgaagtgttaagtgtattaatggtccagaaaaatgggattaccttaacaaattcctagcagttttatgggtttctagaaataattaccagattttaatattcagtaagagagcaataagccctcatatctaaaatgtt

SEQ ID NO: 31731 - DNA, 601 bp, Human
gtcatcatttattgtgtactattatatgcagggtactgggcagtgtcagtttcccttccctttggaatatcccatccccctccttgtctttccagctgcccttcccccctccgtcatccatatggaatcctcatttttctagccttgtcagtttccaaggtggcctgattgttaagcactagtctgtttcttactagctgtgagatttcaagccaatttcttaacttctataagtcctagtttcctgagagggaaaataaagtttaaaagtagtattaccacctaggatagctagcaggaktaagaaaataattactataaaattctcagtgtataccaatgttataatggttcaataacatcagctattttaaaattattatcataatcattttttatttggaccagattcacctctgaatgatccttcaggctctgggagtatatagaatttgggataatggaaggaagcctggaattccacatccaaggaatagtggccatagggagtgggggaggggattcttaggagtgactcagttcaattccttgtgcttttctgggagtgacacaggtgcaaatctggtggcttcagaggcag

SEQ ID NO: 31732 - DNA, 601 bp, Human
ggctcagatgtcactcctaactgccaggagtttactgtctggatatacctccttaaacagtgcttgggtcacctgctaattaacaaatgcttttcagtagtaagaaaaacagtgattttacataattttcctggttaatctaacatcaaaggaaattatcaaatgcctgaaaactgactatttttaaactaggtgataaatgccacctgtcaaaggcagtggaaagttttgctcagagcaagccattcaaataccatgtgagtgggagctgcttatcttttgtccacttcaagacaagatycaaattcgctgggttagtctactgatggcacctagaaatactagtctacatagtcacgaaggctgaagaagcataaaaggacatacagctgccatcttgtgtaaagcttttgcctgcacccaccttctaaaagacacaaaaagacctatctttgttccagaaagcattaattagcctttacaacagatcagcattctctctaaattttgagaattttctcattgagttacatcagatgtgaataaagcttggaagttagtagagcagcacactggtaaaagaaagagtaatagccaagtt

SEQ ID NO: 31733 - DNA, 601 bp, Human
cttcccatttcctgtgacttggtgtggcacggtaagtagtgaaattggaattttgtcaaggttcctctgctcttgaataaaatatctcttagtttaaacattgtgttatattacacactgaatcctgttctttttcttttttgtctgacagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttckcccgaggacacctcttacgatgactcagatatactcaactccacagcagctgatgaggtgacagctcatctggcagctgcaggtagtgttgtttggattagaagctcttctttaattttttttttttttttttttggagacagcgtctcactctgttgctcaggctggggtgcagcagcacaatcatgattcactgcagccttgatcttccgggttcaagtgattctcccatctcagcctctggagtagctgggactgctgatgtgtaccaccacatctggctaatttttgtatattttg

SEQ ID NO: 31734 - DNA, 601 bp, Human
ttctctgggaccttcctggaaacctctctgttttataaggttagaatttaaggagtcataaacacaccccagatgtctttcatgagtattgatgaccacactgttctcttccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtgagagttcctctgactgagttgcctrgttgcttttccatcctaaattaaccacctcaatttttgtcatttctacatcttgtgctagaaagtctttgtgtaatagttaagcctgtccctccaaagactgatattctttgatttatagccttttccatttgtcgctccatcactatactataaagagaagactgggttgagttgatgaatttaaaatgtgtcttcggggttgccttttggagcagttttaattttatgaagtgcttgggaaagtcaaagaaacttgaagtaaaagtattaatcactttgaacacttagaaatgctttt

SEQ ID NO: 31735 - DNA, 601 bp, Human
tgactgagttgcctggttgcttttccatcctaaattaaccacctcaatttttgtcatttctacatcttgtgctagaaagtctttgtgtaatagttaagcctgtccctccaaagactgatattctttgatttatagccttttccatttgtcgctccatcactatactataaagagaagactgggttgagttgatgaatttaaaatgtgtcttcggggttgccttttggagcagttttaattttatgaagtgcttgggaaagtcaaagaaacttgaagtaaaagtattaatcactttgaacayttagaaatgcttttatttctggttactaaaaatcattgttgaaaatgtaaatatggaattagagggatatgaagtctgccagctgagtctgctaataacaaaacttttacaagaaagactaaactacctaccattccttactttttttgcgtatttatttttctttttctttcttttctttcttttttttttttttttttgagacagagtctcactcttgttgcccaggctggagtgcaatgacgtgacctcggctcgccgcaacctctgcctcccgggttcaagcaattcttctgtctc

SEQ ID NO: 31736 - DNA, 601 bp, Human
agttgatgaatttaaaatgtgtcttcggggttgccttttggagcagttttaattttatgaagtgcttgggaaagtcaaagaaacttgaagtaaaagtattaatcactttgaacacttagaaatgcttttatttctggttactaaaaatcattgttgaaaatgtaaatatggaattagagggatatgaagtctgccagctgagtctgctaataacaaaacttttacaagaaagactaaactacctaccattccttactttttttgcgtatttatttttctttttctttcttttctttctttyttttttttttttttgagacagagtctcactcttgttgcccaggctggagtgcaatgacgtgacctcggctcgccgcaacctctgcctcccgggttcaagcaattcttctgtctcagcctcccgagtagttgggattacaggcatgcaccaccatgcccagctaattttgtattttcagtagagatggggtttctccatgctggtcaggctggtctcgaactcccgacctcaggccatccgccctcctcagcctcccaaagtgctgggattacaggcgtgagccaccatgcctggccacgt

SEQ ID NO: 31737 - DNA, 601 bp, Human
acgtatttatttttcatttagcttggaagtttactgagaatcttaatatgccattcttgatcagaataatctttctttgcaagaagtttaagagtttggcctcaggttggaatagggtgtaaactagactttgatcaagaagaaaccaatgagaagccctctttgatacttcgtacacagcttctttctaccagaaccagtctgtgggaggtaatcctaggagagtctaataagaggtttggtttggtttgatttgataaagaagtagctgcttattgcatattgggactaaataaccaamgttctttgtggcttaatgtgcttttccggtcatttggtgacaggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggtgagtaaacctgagggctaccagactgtggcttctgagatggatcagtgggcacctca

SEQ ID NO: 31738 - DNA, 601 bp, Human
tgatagtctctgaactatgattttagtgagctatgattttagatttcacatcataaggcatattctttgttatctgtgctgaatttgggattaaatgagtctcagcttctgagtaaagaggtggaaggatccatccactgacacttaaccactttccatatttttctttaggttggtacgggggcaacagtagccacattggctgatgcttcagaattgccaaccacggtcaccgttgcccaagtgaattattctgccgtggctgatggagaggtaagaaagagattccatctgcatcttsttaaatacttgaatgtataatgagggaaaagcaagggtccagaagatggagtagcctgcatgtctgcggcactctttcatttaaaccttttaaagagcatgagaccatgaaagttttagaaagtgtcttatgctatgtgtattaattgtaacaattaagattcatggattagtatgtcaggaacttagaattttacatttgaatgtatagcatttggtattatacacaatacaaagggattatccctttaccatttttatgctgtgaatcccaaagaatttcatctttggtctttatgaa

SEQ ID NO: 31739 - DNA, 601 bp, Human
agaaagagattccatctgcatcttcttaaatacttgaatgtataatgagggaaaagcaagggtccagaagatggagtagcctgcatgtctgcggcactctttcatttaaaccttttaaagagcatgagaccatgaaagttttagaaagtgtcttatgctatgtgtattaattgtaacaattaagattcatggattagtatgtcaggaacttagaattttacatttgaatgtatagcatttggtattatacacaatacaaagggattatccctttaccatttttatgctgtgaatcccaaaraatttcatctttggtctttatgaaaaaaaaatggcacattaaaactggaactgactaagggaagccttctttgaaaggataaatatgtttgcaagtcagtaacatgatttattacatcttaaatatgcctttgaaaagatttcttaggagaattcttccttaccaaaattgggataattatgggacattaacctaaagacagccaacctttattgatcacttggtgggctaaacactcaaccctatgaagtataaagttctgttatcatcttcactttagagatgagaaaaccgagacat

SEQ ID NO: 31740 - DNA, 601 bp, Human
gcttagatgatttgcccaaagtcccatagcagtgttgaagctggataatgcattgagaaaaacattacctaggctctgagccattggtgaagatgcaacagtgaaggaaggggtttgttacgtcaccatgagtgtttcccttgaagatactgatgtggtgtgctgaagtttgaaaaatagccaacagatgtcaaagagcagtatcagaaataaagctaagagtattatctcacccttgttgagagccatggagcatttccccttagaacaccacaaagtcactttcatttgtgcccctcargagagggggagagctggcaaaggccacatggctgggagatggagggagagtgcaccacaggctccttggccaccctgcatgtgccaaacccctgtgtagctgcagctgtgtggagttgattcgcacaggatccttgctgtcatgggactccagtctagtggggaagagagatgtctacgtgaatgaactctagccttcctgtaagggatgctgcaaagcgtatgtgcctcctttccacctaaggagcctgggaaagtttgggacactgaaaaacttggttattgggtgaggaaaggtgaa

SEQ ID NO: 31741 - DNA, 601 bp, Human
gcccaaagtcccatagcagtgttgaagctggataatgcattgagaaaaacattacctaggctctgagccattggtgaagatgcaacagtgaaggaaggggtttgttacgtcaccatgagtgtttcccttgaagatactgatgtggtgtgctgaagtttgaaaaatagccaacagatgtcaaagagcagtatcagaaataaagctaagagtattatctcacccttgttgagagccatggagcatttccccttagaacaccacaaagtcactttcatttgtgcccctcaggagagggggagarctggcaaaggccacatggctgggagatggagggagagtgcaccacaggctccttggccaccctgcatgtgccaaacccctgtgtagctgcagctgtgtggagttgattcgcacaggatccttgctgtcatgggactccagtctagtggggaagagagatgtctacgtgaatgaactctagccttcctgtaagggatgctgcaaagcgtatgtgcctcctttccacctaaggagcctgggaaagtttgggacactgaaaaacttggttattgggtgaggaaaggtgaaggttgacaggaca

SEQ ID NO: 31742 - DNA, 601 bp, Human
ctagaacaagatgacactccttaaagtctgaaagaggtggaaaagacaacgaggggtacagttaggagatgtgttagtttttggcttagacaaagttatcaaccatatgtctctactgaatgtttcttggtactatttaaagaaagtaacttcgtttccttctgtataaaataatttgtttttgacacataatatttataacattaatggagttgcgtttccttttttttttttttttttcctgagacggaatctcactctgtggcccaggctggagtgtagtggcacgatctcagctcaytgcaacctccgcctcccaggttcaagcgattcttctgcctcagcctcccgagtagcaccaggcacgcaccaccatgcccagctaatttttgtattttcagtagaaacggggttttaccatgttggccaggatggtctcgatctcttgacctcatgatccgcctgccttggcctcccaaagtgctaggatgatatatagtatatataattctgttagaagagaaagccaaagtgcaaaaacattagagacgtgaattttaaactgaaccatcaatatatgtaacagttttgaattgcataa

SEQ ID NO: 31743 - DNA, 601 bp, Human
agtgcagcttgcctcttatggtggcagtgttggtagtgatgttcattggagcaatgagatcaaagcaaccaaccttggaaagcaagagctttggagttcctgaggggcaattttgcagctctaggatatctctgcctcaggagtgatgggccctgaaggcttgctggcacaatccactgcccatgagaactcagggcaaacacgaaggtaactcaaaggaatgtctctttctctgagaggcttttggcaaacattctgaaaagcattatcataatctaagtatggtaatataactaaagcmggaagcatttaaaatatctacctcctagagcttggagcactttctttgggacacagtaacaagcaggcacaaggtaactactcactaggccccagcaatgtgaagcaggaatagcaagagctgcagtaagcactgctaaggtcctgagacccaggagtccaaagacagatacacctgagctgatggatcacctgctgtacttccaaatagaaattgcttttactgcccctgctgcttttcagttttgagggtgggtagttaatcaaccagtatttattgagcaaaacggactgaagtaac

SEQ ID NO: 31744 - DNA, 601 bp, Human
aaaagcattatcataatctaagtatggtaatataactaaagcaggaagcatttaaaatatctacctcctagagcttggagcactttctttgggacacagtaacaagcaggcacaaggtaactactcactaggccccagcaatgtgaagcaggaatagcaagagctgcagtaagcactgctaaggtcctgagacccaggagtccaaagacagatacacctgagctgatggatcacctgctgtacttccaaatagaaattgcttttactgcccctgctgcttttcagttttgagggtgggtarttaatcaaccagtatttattgagcaaaacggactgaagtaactagatacaggtattcagaactaagtctctaaacacagagaattgtactaaaatcagtagttctgtaccccagaccagaggggacatttggcaatacctggagacattttttaccgtcctgactggggagggtgctattggcatctagcgggtacaagccgggatgctgctaaccatcctgcaatgcacaggacagccccacaaccaaggatacctgggccaaaatgttagcatgccaagactgagagactgtaggcct

SEQ ID NO: 31745 - DNA, 601 bp, Human
atgtggaggttgcagtgagccaagatcgtgccattgcactccggcttgggcgacagagggagactccctctcaaaaaaaaaaaaaggtacagtggaaggtcttgctttctgtctcccatccaacttgtttccaactcctctcaaccccacacatacaatccagagaatatattcagtggcttttgtgtgtccttccagaatttcttcatgcaaatgcaagcaaattcaggtatatattctaatacccccttttttatgcaaaaggtagcatgcttaaagctctgttctgtatattgcaggkcatgttaattttaaagagtatgtgtatttagccaaaaagtagcaattattagaaaaattacttgtaaaattgtacttttgtggctttgtttttttactatcttgtcctttctgcctcaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacaggtggtggcaagagtgtgggaata

SEQ ID NO: 31746 - DNA, 601 bp, Human
tacttgtaaaattgtacttttgtggctttgtttttttactatcttgtcctttctgcctcaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacaggtggtggcaagagtgtgggaataagtgaggatcgcaaatctgtccctgcagatatgggtggaggccccttaaagagaaatgygtctctgtttgccacagttggcagttggaacttaacactcttggcccatacgatattgtagtttggcctataataggtcagtccttaccaagaaaaattaaacttctttccttcaggtgtgcttaggaaaggtgatgtgaaatggaatcctccagtaaaaggtagtttccaaaactcaatgtattgtttcctgcttagttccttctactggctgttgatggaaagatcatctccgcatcattcttcactcctgccgccacccagccccaacaaccagtgtagcctttctgacttccagcc

SEQ ID NO: 31747 - DNA, 601 bp, Human
ttttaagtgaacataatctttttctaggctgggcgtggtggctcacgcctgtaatcccagcactttgggaagccgaggtgggtgaatcacctgtggtcaggagtttgagaccagcctcaacatggagaaaccccgtctctactaaaaatacaaaagtagccgggcgtggtggtgcatgcctgtaatcccagctagtcgggaggctgaggcaggagaattgcttgaacctgggaggcggaggttgcagtgagccgagatcacaccagtgcactccagcctgggccacaagagcgaaactccrtctcagaaaaaaaaaaaaaaaatctttctagcagtttagtttggtcgtttcccataaagttgagtgtaaaaggttagaatcactctggaaatgatagccctgcttaccataggcatcatcgttgtcttcatgccccacgtaaagaccttaactggggactgaataattaatcgtactgacctgtcaacctgtcacccccattgcattggacccctcatccctggcattccagattgttttaggttgttgctggttttcagcttttcttctaccataccacattttagaaagaagttaaag

SEQ ID NO: 31748 - DNA, 601 bp, Human
cgtaaagaccttaactggggactgaataattaatcgtactgacctgtcaacctgtcacccccattgcattggacccctcatccctggcattccagattgttttaggttgttgctggttttcagcttttcttctaccataccacattttagaaagaagttaaagaagataacttcaagtttttagggctttaagtggaaatgagtatgatcagttgcaggtacactttcctgtcaaggcttggggagctgccctctcccttcactgcccatgaaactcattctgccagagtgtgttcaggakgtacaggagtggcaggatgtcatctttgatggtcataaagatgagattattgtaaattgtaagaataattacaggaaataagcagtcactgaggtgacctataaacaaagatcctaattccatataaacaattctcatttacagttttcttcttcagactatcacacagctttttccaaagagtatacttttctgctttccataaagtctcaggtcacagcgtaaatatttgtatcattaatcattgacaggtggatgctgtaaaattggctggtcatatatttatgtatctttttcttt

SEQ ID NO: 31749 - DNA, 601 bp, Human
ctttatgccagtactatacactgttttgattactacagctttgtgttaagttttgaaatcagaagtgtgagtggtggtgctgggaaaactggatatctacatacaaaagaatgaagttggacctttacctaacacagtgtataaaaattaactcagagtggttccatgacctacaactataaaactctttgaagaaaacatggggcaaaacttcatgacattggatttgccagtaatttcttggatatggcaaaggaaaaatagacaaattggactttacgaaaattcttaaaatgtgtgyatcaaaagactatcagtagaggaaaaaggcaagccacagaatgggagaaaatatttgcaaattgtatctgataagggattgatatccagaatatatagggaatgtctaaaactcaacaacaacaaaaactctattcaaaaatgggcaaaggtcttgaatagacatttctccaaatttctccagagaagatatgcagatggccaataagcacaggaaaagatgtgcagcatcactaatccaaactacaatgagatatcacctcacacccattaagatggccacaatccaaaaaacagaaaa

SEQ ID NO: 31750 - DNA, 601 bp, Human
aattggactttacgaaaattcttaaaatgtgtgcatcaaaagactatcagtagaggaaaaaggcaagccacagaatgggagaaaatatttgcaaattgtatctgataagggattgatatccagaatatatagggaatgtctaaaactcaacaacaacaaaaactctattcaaaaatgggcaaaggtcttgaatagacatttctccaaatttctccagagaagatatgcagatggccaataagcacaggaaaagatgtgcagcatcactaatccaaactacaatgagatatcacctcacacscattaagatggccacaatccaaaaaacagaaaataacaagtgttggtgaggatgtggagaaattggaacccttgtgcactgttggtgggaatgtaaaatgacatagccactgtggaaaacaatatgataattcatcaaaaagttaaaaatgggactaccgtatgttgcagcaaatccacttctgggtacatatcccaaagaattgaaagcaggatctcagagaaatatttgtatgcccatgttcacagcagcattattcacaatagctaaaacatgggagcaaccaagtgatcatcgaca

SEQ ID NO: 31751 - DNA, 601 bp, Human
gtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccakgtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatac

SEQ ID NO: 31752 - DNA, 601 bp, Human
tggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcrgatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctc

SEQ ID NO: 31753 - DNA, 601 bp, Human
ggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcakcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctg

SEQ ID NO: 31754 - DNA, 601 bp, Human
acaggacagaactccttagcatgctctcatatttaattataattataatataatagaaccacagggaagggggatcccttgtcccagccactcaggtgcctgctggccgcctggatgctggtggccctgccccaggagtgggggtgcagtgtgtggatgtgaggagtggataggccacggcgggggtactaggccccgggggaacgcctgtaccttcccacccaggccctggtgggagcccggccaacccctttaaataatttcaggaatgggttccaaggagagctcccagggtgggcayatggggggccctaggtgcctgcacttctgccctcccaacacccaggtggccacagctgggaggggcctgagtcaaccccagccctgccctcctgaccttgggaccgtaggatgtccctctcccgagtggtgtgaggggctggggtggaatgcggcggcaggaggccagagtgctggctgggcctgaaaggcctccagctctgcctgcccgcttactgcctcagcttccctgccccacaaagggcctgaggtgctgcctgggcatgtgtaaaggtggaggggtttcctgccctgcccacca

SEQ ID NO: 31755 - DNA, 601 bp, Human
ccctgcagctggagccctcggctcaaacctgggggcctggtaccctgcggctcccgaaccgggcccttctggtcaacgttaagtttgagggcagcgaggtgagcccatgcgtggcctgcggcatccaggctgctctgtccatggggagcacttcctctgtgaaactcctcagtcatccgcaagcccccctcccccagtggcatcagatggtgtttgccaggtgtctgtgcatgtgtggggctcaactgaacgtccccccaggcaagctcaacgtggcaggataaccaagtggcgtggggcrttgggcatcagtttgttcattctttgaacaaatatttcccagtgtcatttgtgaactccccagaccctacccttgggggcaaataggcaaccctgccctgtgccccagaaccccggggggcctcgagggcagaggactgacctccctcctccccacaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatg

SEQ ID NO: 31756 - DNA, 601 bp, Human
cggctgggaggggtgcagaccccggagagccagtacagccccttgctgggccactcaccactctcctcccggcaagcacgcagcctggggatgggggtcctgggattgcttgtggaccccagcctcctcacccaccctagtctggccaccagccctgctcgagggacactctgggctcctgggctcctgtgcatgcggcctcagaatatctggcctgggctgtggtcctgcaggaacctgcaggtagtgccctgggatggaaggacaagcacagtgtcatccctggagcagaaaagcctgwgtcagcggctggccgggaggcgtagtggctgggtgctgagtcacggtcccaggatatggctcccctcggagctgactcactccgagctgagctgggctggcctctggggctgggctgtctgtttggggatttctcaagaagccaggagggccaggcgtggtggctcatgcctgtaatcccagcactttgggaggccaaggtggtcggcttacaaggtcaggagtttgagaccagcctggccaatatggtgaaaccctgtctctactgaaaatacaaaaaaattagccgggcgtggaggca

SEQ ID NO: 31757 - DNA, 601 bp, Human
agccgggcgtggaggcacatgcctgtaatctcagctacttgggaggctgaggcaggataattgcttgaaccaaggaggcagaggttgcaatgagccgagatcgtgccactgcactccagcctgggtgacagagcaagactccgtctcaaaaaaaaaaaaaaagcctgagtaggggtgaggtgggaacaggagggtgcagcaggtgtcagctggcttcaccactggagccctcagaggaaagaggaaaaagcggctcctctccttccccaagcagggtctcccaggggtctggttgggagaygttagctgggctctgggtcttctcgggtggggtgcctgggggagggcagggaagctgggtctggaggcccctgagtggctgtcctcacctgccctgtccttctgcaggactgccccattgcctgggccaacctcatgctgtttgactacaaggaccagcttaagaccggggaacgctgcctctacatgtggccctccgtcccaggtcggcccaggcccaggagggagaggcgttgggagtgtgagggtcccagagatgctggtcacccctctacaacttcatctgcccctgtgttcagat

SEQ ID NO: 31758 - DNA, 601 bp, Human
catccaactcaacaagagcaacatggcagccacagccgccttcaacaaggatgccctgctcaactggctgaagtccaagaacccggggtgggtttcaggcccagggataggttccctctcctttccaagaggtgtggagtgggagggcctcgcctgtcagaacaaaggagcggggaggggcctcagaccatctttgtggctacttggctcagttgaggaccagcctgtgtctgggttggggtgaggtaggtctctcttccccaagtatcagtgtctcttgctatgcaacaccatccaaagygcagggctttaaaaaacagccatttacgattggctcacagatctgcagctggggctgggctcagccgggtggcttttctgctggttccacataatcactcatgcagctgttctcatctggtgccttaactgggccagtggggtctgagataacccatctcattcctggggccttggcgccagctgtctgtgatgcctctctgcatgtggtctcctcatttagcagcctcaccttccttccgtggctctgtattgagggtatggggttcaagatctgcaggggtcttcatgccttggctct

SEQ ID NO: 31759 - DNA, 601 bp, Human
ttggaatcaaccgcgagcgtgtcccattcatcctcacctacgactttgtccatgtgattcagcaggggaagactaataatagtgagaaatttgaacggtgagagtgcctgagccccaccagatgcccctcggtgtggggccccagggaacagggcagaggttcccaggcagggtgcaggatggggctcaggtctcaaccccacacctggcccctcaccccaactgttgatgggtttggaacatgcccctgctccaccctgcagtgccccttttgggcaatgtgggcaggtttgtgggtcaygtagcaggaggctggctggggcacgggggtcagttagcagaactggaggccttgtgtccacccattatcagggcaagggcaggtgtccttggggaaggggctggttggatgcagagcggccctctggcctgtggctgggagttcccagagcctcacttcctctgtcccctacctgcaggttccggggctactgtgaaagggcctacaccatcctgcggcgccacgggcttctcttcctccacctctttgccctgatgcgggcggcaggcctgcctgagctcagctgctccaaagacatcc

SEQ ID NO: 31760 - DNA, 601 bp, Human
aaagaaccgacatggctgccttttgtttacactggttatttatttatgacttgaaatagtttaaggagctaaacagccataaacggaaacgcctccttcatgcagcggcggtgctgggccccccgaggctgcacctggctctcggctgaggattgtcaccccaagtcttccagctggtggatctgggcccagcaaagactgttctcctcccgagggaaccttcttcccaggcctcccgccagactgcctgggtcctggcgcctggcggtcacctggtgcctactgtccgacaggatgcctygatcctcgtgcgacccaccctgtgtatcctccctagactgagttctggcagctccccgaggcagccggggtaccctctagattcagggatgcttgctctccacttttcaagtgggtcttgggtacgagaattccctcatctttctctactgtaaagtgattttgtttgcaggtaagaaaataatagatgactcaccacacctctacggctggggagatcaggcccagccccataaaggagaatctacgctggtcctcaggacgtgttaaagagatctgggcctcatgtagctcaccccgg

SEQ ID NO: 31761 - DNA, 601 bp, Human
ctccgggcctgctccggcggaccagcctaggcagccatcccctccgcgaaactgagcagtcaccggccggagccgcattccgcccttggaatcccccaaatcccgggaacccccgcctcctcggggcttttccgcgagcgtcagactccgctcacctcgctcccctccgatgtccacgtcaaagaagactcgagggttactggggttggagggcttggcttggggggacgggtgcgacatcttgacttgcagacgtgtttagtacggaatatcagagtacctagtggccgcccgggccgcycaaactccagagtccgtctccgccggagaccggcagcgacgctgaccggccacttccgacgcaagaaccggaagccatggcctgacttccggcaccgccccgctcccccgcgcggtgtttcaaagagcctgagcgactccgtgcagcgaaccgcgtgccctccgccacctgttcctggcttctcatttaatgaagttgcgatcccagttctcattattcttctcgcttgtgtttcgttgtctttcccaccctcgtggcgtagagagctttggagtcaaccccatgccagcgtcagctctg

SEQ ID NO: 31762 - DNA, 601 bp, Human
cctagatctccgggcctgctccggcggaccagcctaggcagccatcccctccgcgaaactgagcagtcaccggccggagccgcattccgcccttggaatcccccaaatcccgggaacccccgcctcctcggggcttttccgcgagcgtcagactccgctcacctcgctcccctccgatgtccacgtcaaagaagactcgagggttactggggttggagggcttggcttggggggacgggtgcgacatcttgacttgcagacgtgtttagtacggaatatcagagtacctagtggccgcccsggccgcccaaactccagagtccgtctccgccggagaccggcagcgacgctgaccggccacttccgacgcaagaaccggaagccatggcctgacttccggcaccgccccgctcccccgcgcggtgtttcaaagagcctgagcgactccgtgcagcgaaccgcgtgccctccgccacctgttcctggcttctcatttaatgaagttgcgatcccagttctcattattcttctcgcttgtgtttcgttgtctttcccaccctcgtggcgtagagagctttggagtcaaccccatgccagcgtc

SEQ ID NO: 31763 - DNA, 601 bp, Human
ctactaactatagtcattatgttatacaatagatctcttaaatttattccccctttctaactgaaattaggtctctcgtgatcaacatctacccaacccctgaaatccaccattccattctctacttcaaggtcaactttttagaaaccacatgtaagtgagatcatgccttgtcttcctgtgcccagcttatttcatgtaacataatgtcctccatattaattcatgttgtcagaagtgacaagatttcattattttttatgggtgaatagtactccactgtgcacatatatcaaatttwaaaaaaaatccatctgtagatggaaacctagtttgattccattatcttggctatcatgaataatgctgcaatgaacatgggagtgcagatacctctttgacatacaaacttcatttcctttgaatatactcactagaattagtgaatcttattttattctaatattcaaatttagtctacctactgtcatgtatgtatataaacagatttgaaacattacactaaggatcataaccaattatagtagccaaaagattagcaccatgtaagagatatcattaaatacaaatagttttaaat

SEQ ID NO: 31764 - DNA, 601 bp, Human
aaaatgttgctcttgtgattattgcttatttgcctatttattaaacaaatacttactgagttcttactcaataactgtattagatgccaaaaacaaaatggtgaaaacatacagttcttgaactcatagagcctgcagtctattgggagaaccattatcactaaacaaaagtatgattcattacaaagtgtaataagcagtatgaaatggcatattttgaccacactatcacccatgtgcccaaaacactgaatcttcaaatctgctgccttcccaagcactcaggcccaaaaattatgcatttttttgtttgtttgtttgtttgtttgtttgaggcagagtctcactctgtcgcccaggatggagtgcagtggcgtgatctcggctcactgcaagctccaccttctgagttcatgccattctactgcctcagcctcccgagtagctgggactacaggcgcccaccaccacacccggcttattttttgtatttttagtagagacggggtttcaccgcgttagccaagatggtctcgatctcctgacctcgtgattcacccgcctcagcctcccaaagtgctgggattacaggcgtgagcca

SEQ ID NO: 31765 - DNA, 601 bp, Human
ctcagcacccaaggtatttattgggcacactctacctagcatgtaccaaaattccagactccccaaaagagagcacacattcatgtttgtacaaataggctaggcatagtaaatcaccattactatttaggaaatggtacaagtgtcaagttcccagactccaaacaagtgctactcttgcaggcagacctttctaaagatagcagtctcacacttgctatgttaaatattttctgcatatagtttattagcatatttcaagtttttattaaacatgaaagtaaacattttaaatatttttaaaaagttaattttttcttaataaatcgtttaaaaaatgttgctcttgtgattattgcttatttgcctatttattaaacaaatacttactgagttcttactcaataactgtattagatgccaaaaacaaaatggtgaaaacatacagttcttgaactcatagagcctgcagtctattgggagaaccattatcactaaacaaaagtatgattcattacaaagtgtaataagcagtatgaaatggcatattttgaccacactatcacccatgtgcccaaaacactgaatcttcaaatctgct

SEQ ID NO: 31766 - DNA, 601 bp, Human
tgttctaccctaatggaaaattttcagcaaatatatcactttgtgtcaaaggttaccaagattgctttcatgttcagagaaccctagagctcacacaaatcagtatgtggttggatcacagtggtaaggatacacagcgagatgacgggaaagacacaggcagagtctggaaaaatccatgtgcaggcttccttatgctttctccgtcccatgaagtgctacagaacacacacttcccccagcaacaaaaatgcagcaacatgtacacagtatttctgcccaggagagccaattagagacycagcacccaaggtatttattgggcacactctacctagcatgtaccaaaattccagactccccaaaagagagcacacattcatgtttgtacaaataggctaggcatagtaaatcaccattactatttaggaaatggtacaagtgtcaagttcccagactccaaacaagtgctactcttgcaggcagacctttctaaagatagcagtctcacacttgctatgttaaatattttctgcatatagtttattagcatatttcaagtttttattaaacatgaaagtaaacattttaaatattttta

SEQ ID NO: 31767 - DNA, 601 bp, Human
ccattgtagaaaagttaaaaaaaaaaaaaaaaaagtggcagatcctggctcctatacccaaaattattataacatttttccagctaataatcacctgatccttttacttatatttctttaagatagcaactaacaggctgggtgcggtggctcatgcctgtaatcccagcactttgggaggccgaggtgggcggatcacaaggtcaggagtttgagaccagcctggccaacatggtgaaaccccgtctctattaaaaatacagaaaaaattagccgggtgttgtagcgcgcgcctgtaatmcctgctactcagaaggctgaggcaggagaatagcttgaacctgggagacagaggctgcagtgagccgagaccgcaccactgcactccagcctggaacagatcgagactccgtctcaaaaagatagcaactaagataataagtgtatttcactgtaactttttacttactttagcaggtttttcacctttcacttccacattttccaatatccttgccactcctattcctttaattacttggccaaacaccacatgtttcccatccaaatgaggagttggaactgttgtgataaaaaactg

SEQ ID NO: 31768 - DNA, 601 bp, Human
agataatctagtctaaacccataagtaatttagacaggagaaaacacgtgtggaaaagttaagtaacaaagtcaaggccaagcctctagttaatgctacaatccagacaagattttgggcttattatcctcattccactatgtactactatacataccaactgaacagttttgcaggtataggaagacttaacgtaaactagcaaagatcaccaaatgaaagttgaaataataaaaatctcctttaaaactaccctaattgtctttcccattgtagaaaagttaaaaaaaaaaaaaaaaaagtggcagatcctggctcctatacccaaaattattataacatttttccagctaataatcacctgatccttttacttatatttctttaagatagcaactaacaggctgggtgcggtggctcatgcctgtaatcccagcactttgggaggccgaggtgggcggatcacaaggtcaggagtttgagaccagcctggccaacatggtgaaaccccgtctctattaaaaatacagaaaaaattagccgggtgttgtagcgcgcgcctgtaatccctgctactcagaaggctgaggcaggagaatag

SEQ ID NO: 31769 - DNA, 601 bp, Human
cgcagactaataggaacatgccaaaggaaaggggccttccactgaacaaatttggaaccctttgggcatgaaaaagaatgacaataatagcgtactaacaaacggaattgaaaactacccataagatatcctctagtccctgctacttgggaaggtgaggagggaggattgcttgggcccaaaagttccagaccagcctgggcaatataaaggaggccttgtttctataaaaggaaaaaaaaagaaaagaaaaatatccacaggtctatagtgatacttaaaaaatatgcgggaggctctygcaaacagaagaatgctagttaataactgtacgatgataaacttagaagttcagtataacagattcaggcatggattttcaatgatgctaagatccactgtgtgaaaagttgttggggactagaaattcatacaatttcacgataccacctcagactaacaaatgcttgtggctgacactactttaaccatgtgtgtgaactcaaacaggccaaagcgaaatgtgtcttcaggatgtgatatcataggtaatacaaaacaacacctaagtcttcttgccaaaatatttcacctcaaacta

SEQ ID NO: 31770 - DNA, 601 bp, Human
atcacccgagcccaggaggttgaggctgcagtgagctttgattgcatcactgcactccagcatgggtgacagagaacaaaaaaaaacccagagtgaagacccatcttttcttttgataagttttttcctctgttgtatgatcccttctaaatatattcctatcccttattccatctaccctacaaaattaggatctcattttagttctacttgctctgagcatagctagtctaggtgcctggcttaatatgtaaaattcttaaagtttcatttggaaaacttttcaaactatacaacaggcaagagagtcataattgctctatttgaggaaggtaaaactgccacctttctagctttatcagttagcatacctggatgacctcctaaagataaatgacctgttccaatagaacccattctccatacacaagtcctgatgaacctaaattgaaactgaccccctcctatcctgaatcacttattaagcttcttgagggtatggatcttttaattaaaataactcgtctctgttaggtgcttaaaatgtgccaggcactacactaaatgccttacattgtgttatataactctctataactac

SEQ ID NO: 31771 - DNA, 601 bp, Human
atggcctctaattctttggaccattgtaactgtgaaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaayctacctagcatgcattttacacacattggaggagtcgtatgcactgtttttctgttgctgatggaggcaagcaggccttctaattagtctaacttaaacggatgggattcacttaacaaaagcaagaagaaaagcacacgaacaggtgtcttaatgcatttggatagtttctttgcggggtgtgtggtgtgtgtgtgtgtgtgtgtgtgtgtgtgtgtgtgtgtcttggtgaaggtgaggggctgtattttcaccaagccttttcataatcaagtttgctttgcaaaccttatggccttg

SEQ ID NO: 31772 - DNA, 601 bp, Human
agtttctggggctggagcctgggatgatacgcttcttttttttttttttttttttttttttgagatggagtctcactttgtcgctcaggctcggggtgtagtgcagtggagtgatctcaactcactgcaacctccacctcttggattcaagtgattcttctgcctcagcctcccaagtagctgggattacaggtgtgcgccaccacatccagctaatttttttgtgtgtttttagaagagatggggtttcactatgttggccaggctggtttcgaactcatgacctcaaatgatccactctcctcggcctcccaaagtgctgggattacaggtgtcagccactgggcctgggctgatgcatcattttgttcaaagttttaccttttcaaatactttattgtattaaattgcattaaaaaaacaatttgaatacgttttatctatccacattggtcaaaaaccaagtcaatattaaaacagatatattgccaagtctccctcttaccccctccaagccacctgtaggtaatcaccttttattgtttttctgtgtatccttctagagtttctttgtgctaataaaaacccacatggatacatg

SEQ ID NO: 31773 - DNA, 601 bp, Human
ctgagtagctgggattacagacgcccagctaatttttgtatttttactagagacggggtttcaccatgttggccaggctggtctcaatctcctaacctcaagtgatccaccagcctcagtctcccaaagaagtgctgggattacaggcatgagccgctgcacccggcctggcttagtttacttaacatgatggtctcccattccattcgtggtgctataaatgacaggatttcattccattttatggccggatagtttttcattgtgtgtatggaccacactttctttatcctttcatccrttggtggacacttaggttgattccatatcttggcttttgtgaacactctgaactgcatatgttactgatgggagtggtcaatggtagtgttttcacctttgcacttcagagttaaaagaatggagaatgcttagaaatgcttattcctagtcctcagctcagaccagagtttctggggctggagcctgggatgatacgcttcttttttttttttttttttttttttttgagatggagtctcactttgtcgctcaggctcggggtgtagtgcagtggagtgatctcaactcactgcaacct

SEQ ID NO: 31774 - DNA, 601 bp, Human
cacatctggaaggtatatctttatatttagtaattcccaaaaaatgagactgactcgaccccacatccaggtgaggctgcgtttactgagtggggcttaacctcatgcacacagaggtcagcagtgaagcagagcaaaggggattgattgcaagggtcagcgaaataaacacagccatgcctgtgactccaggtcagcatgtgaccgtcagaggcatcagcatgacagtccagaatccatgttctgcatcagaacctgcacgtctaaataagaccgctaggtggtttgtgtgtgcctgaayatttgagaagcccagctcctctggtccctgttccagaaaccctgagtgacaggcgagcttccttagaataattaacaagtattttcaaaagtctctttaggtctcctttggttaaaaaataagaagaagaaatatgccctcataggaaatttgctaagcttaattgaagatgactggaaaaggattttgagtctattacttctttgagcctttgaaggtctattattagtttttaaataataataatattttttagaatccctcatgaaatttgctaagctttaatttaagatgactgaa

SEQ ID NO: 31775 - DNA, 601 bp, Human
gacagctttagtgttttgcaaatcattttcatttttaggtacagtgacagaaataaagcggtgtgtgcagcatccaagtgtcccgtccctttctaaccatgcctttgtgcttcggccatgtctcacagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaaggtatatctttatatttagtaattmccaaaaaatgagactgactcgaccccacatccaggtgaggctgcgtttactgagtggggcttaacctcatgcacacagaggtcagcagtgaagcagagcaaaggggattgattgcaagggtcagcgaaataaacacagccatgcctgtgactccaggtcagcatgtgaccgtcagaggcatcagcatgacagtccagaatccatgttctgcatcagaacctgcacgtctaaataagaccgctaggtggtttgtgtgtgcctgaatatttgagaagcccagctcctctggtccctgttcca

SEQ ID NO: 31776 - DNA, 601 bp, Human
tcagtcattcaggctggaatgcactggtgcaatcatggctcacttggagtatcgacctcctgggctcaagcagttctcccacctcagcctactgagtagctgagactgcaggcacacagcaccacacccggctagttgtattttttgtagagacaggggactccctgtgttccccaggctggtctcaaacttctgaggctcaagcaaccctcccgcctcaccttcttaaagtgttgggattacaggtgtgagtccccacacgcagcctcattcacaatattttaattcaaagattgccgckttcataaatgaagggaagacagctttagtgttttgcaaatcattttcatttttaggtacagtgacagaaataaagcggtgtgtgcagcatccaagtgtcccgtccctttctaaccatgcctttgtgcttcggccatgtctcacagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaaggtatat

SEQ ID NO: 31777 - DNA, 601 bp, Human
tgtcttttcggtagagacagggtttctccatgggccaggctgttctcgaactcctgacctcagatgatcctcccaccttggcctcccaaagtgctgggattacaggcatgagccactgcgcctagccagcttcctcattttaaaaaatactgcattgtattccatcacatgactgtaccatagcttacttaatactatatatatatattttgagacaggatctcactcagtcattcaggctggaatgcactggtgcaatcatggctcacttggagtatcgacctcctgggctcaagcagtyctcccacctcagcctactgagtagctgagactgcaggcacacagcaccacacccggctagttgtattttttgtagagacaggggactccctgtgttccccaggctggtctcaaacttctgaggctcaagcaaccctcccgcctcaccttcttaaagtgttgggattacaggtgtgagtccccacacgcagcctcattcacaatattttaattcaaagattgccgctttcataaatgaagggaagacagctttagtgttttgcaaatcattttcatttttaggtacagtgacagaaataaa

SEQ ID NO: 31778 - DNA, 601 bp, Human
ctcccaagtagctgggattacaggcacccaccactatgcccggctaatttttgtcttttcggtagagacagggtttctccatgggccaggctgttctcgaactcctgacctcagatgatcctcccaccttggcctcccaaagtgctgggattacaggcatgagccactgcgcctagccagcttcctcattttaaaaaatactgcattgtattccatcacatgactgtaccatagcttacttaatactatatatatatattttgagacaggatctcactcagtcattcaggctggaatgcastggtgcaatcatggctcacttggagtatcgacctcctgggctcaagcagttctcccacctcagcctactgagtagctgagactgcaggcacacagcaccacacccggctagttgtattttttgtagagacaggggactccctgtgttccccaggctggtctcaaacttctgaggctcaagcaaccctcccgcctcaccttcttaaagtgttgggattacaggtgtgagtccccacacgcagcctcattcacaatattttaattcaaagattgccgctttcataaatgaagggaagacagc

SEQ ID NO: 31779 - DNA, 601 bp, Human
catctgcaaagaccctatttccaaataaagtgatattcacaggcactgggggataggatgtgcacatatctttttgagggacattgtttaccctataacagtagtcaagcttctgtcctttacattatttgcggacagcaacggataccttcaggtctccgaggagcctatccagccaggttgcacggtgtggactcatctgtgccacggctcttcataagattggacgagtcctgttttaatgccacagccatttagaaaagagctgggtctcttgctgggactgcagggaatcacagaygacccatatctagaatctgctgggaatggcgtagtgaccatcataggtaccttccaagggggaagaacaagtttcccaatcaaaggaattggggaaaagctcacaaactcccaagctaggtcttaaagtctagttaaagcttcctgatatggagataaactgaaagagactcaagaaaacactgactttatattttttttaaattaacacatgaaaatggtattatttagcatgtacaacatgaagttttgaaatatgtacccattgtggaatgggtccattgagttcattaacatatgc

SEQ ID NO: 31780 - DNA, 601 bp, Human
gcaacctactcgggcagaaggtgggcttcctcctcccgctgctgctccacatcaggtgtgcccagtgatccatagccgaacagtgtccctaagattgcagcctgactcccctcccgcctgggttccctcctttccagtacccaacgcttctctaaaacgcagccacagcccttctcacccagcaactcgaggttcatccctgcggactgtggccgcccggtctcagctccggcaacaacaccttctccccggccggcttcagcaacttgcgtctaagtggtggacgccgcgaagagactgscgcaagctccgaagactttcggccttagaaggccccgcggcttccgctttcttcccccgccttccttgttcgtttcaggtgggctgcccaaatatatgcctgaccaaaatcaagcatacactctctcggaaacaattaattatgatctttgctgaggtacaacaatgttatcgtcactagggactttaaatagcgcgacaatttaagattatttgctccgggaacatgtaggtgaggtagaaattccaggcatacagttaacctactagttcttgccctgttgtgtgttcagcggcgttg

SEQ ID NO: 31781 - DNA, 601 bp, Human
ccagcactttgggaggctgaggtggacagatcacgaggtcaggagttcgagaccaacctggccaacatggggatactctgtctctgctaaaaatacaaaaattagccaggcatggtggcacgcacctgcagtcccagctactcgagaggctgaggcaggagaatcttgaacccaggaggcagaggttgtgtgagccaagatggcgccactgcactccagcctgggtgacagagcaggactctgtctcaaaaaaaagaaagaaagaaagaaagaaatgtattcagtagagccaacctagacrgaaagattattttatgtagaaggtttgaagagatgtgtatttgccttctaaaaccataaactaaaattatcatgagcccagagctaatccatatagaattagaccccaccccaggagagaaatagcttaaacatactgatctcgtggatgatattggacttttaagatgggtgaagggaatcgaaacctctggtcacagtcgcctgaaagaacatcccactgtgacactatgttatcagtggaagcactcacgagtttatgaccatctcggctccagctgaggaaaaaaaaggggtaatt

SEQ ID NO: 31782 - DNA, 601 bp, Human
aagtaagaggccaggtgcagtggctcacgcctgtaatcccagcactttggggaggctgaggcgggcagatcacttgaggtcaggagttcgagaccagcctggccaacatggtgaaaccccatctctactaaaaatacaaaaacttagccggatgtggtgcctgcacctgtaatcccagctacttgggaggccgaggcaagagaatcgcttgaaaacaggaggaggagggtgcagtaagctgagactgtgccattgcactccagctagagcgtcgcagcgagactccatctcaaaaaaattwaaatttaaattaaaaaaaacgcattcagggccaggcgcagtggctcatgcctgtaattccagcactttgggaggctgaggtggacagatcacgaggtcaggagttcgagaccaacctggccaacatggggatactctgtctctgctaaaaatacaaaaattagccaggcatggtggcacgcacctgcagtcccagctactcgagaggctgaggcaggagaatcttgaacccaggaggcagaggttgtgtgagccaagatggcgccactgcactccagcctgggtgacagagcaggactct

SEQ ID NO: 31783 - DNA, 601 bp, Human
aggctgaggcaggagaatcgctggaacccgggagggagaggttgcggtgaactgagatggtgccattgcactccagcctgggcaacaacaagagcgaaactccatctcaaaaaaaaaaaaaaaaattgcctttctaaggccgggtgcagtggctcacacctataatcacggcactttaggaggctgaggtgggcggatcacttgaggtcaggagtaattccagctactcaagaggctgaggcaggagattcgcttgaacccaggagatggaggttgcagtgagccgagatcatgcactgcmctttagcctaggcaacagagtgagactccatctcaaaaaaaaaaaaaaaaaaaggaaaaattgcctttctaaaatagccatgaaattatactaacccatgtgccacagtcaaaaaataaaaataaaaataaatcaagatgcccagtggaactatcctaagcatgaaaagaatctttaaaaggtcacctaacctgacttcttattccacagaagaaacaccttctacaatgtattccagagaaaagggcctacacattccaaaaggcaaagtcagaagtttgaaggaaaaagaagaataag

SEQ ID NO: 31784 - DNA, 601 bp, Human
aagtgttccaataactaacaataattgatttggcttgtttctaatactgcgtaaagactgggtaaaaatgcaaatgtctctattcccatatatttgacctgattaactggtattgctgttttgcttccttaagtaagacaaggtcttaatctagtctttttttttttttttttttgaaacggagtttcgctcttgttgcccaggctggagtgcaatggtgcaatctcggctcactgcaacctctgcctcctgggttcaagcaattctcctgcctcagcctcctgagtagctgggattacaygcatgcgccacgacgcctggctaattttgtatttttagtagagacagggtttcttcatgttggtcaggctggtctcaaactcccaacctcaggtgatccgcccacctcggcctcccaaagtgctgggattacaggcattcaccaccacgcctggccaatctattcttaaaatatgatgtttagcattattcacaataaccaaaatatagaagcaacccaagtatccacagataagccatataaacaaaagtggtataaacataaaatggagtattattgagccttgagaagaaggagaaa

SEQ ID NO: 31785 - DNA, 601 bp, Human
attcaagagaattttgaacattaatatcctctaagtcagctgtccccaacatttttggcaccagggactggttttgtggaagacaatttttccacggcccaggctggtgggaggattatggtttcaggatgatactgttccacctcagatcatcaggcattagattctcataaggagtgtacaacctagatccctcacatgtgcagttcaaaatagggtccgtgctcctatgagaatctaatgctgctgctgatctgacaggaggcagagctcaggtggtaatgctcacctccagctgtgyggcagggttcctaacaggccaatactggtctgtggcctgggggttggggacccctgctctaagtcatgtatgggtgttcctaaacaaaataggaggactattacctcttactgacaacgtatttcctatttctgttgatatattctacgacttctaactaggtaaccaaacctaccagaataacatccaaaattaaaagggtaaataggcagtattcagttacaatgtgaatttgatgacatcagtcctgatgataataagttaatatatacccagtgcttactatatgccaggcatttt

SEQ ID NO: 31786 - DNA, 601 bp, Human
aaggcttcccaagtcagactctaaaaggtggcaggaaggatgaaatgattgtccaagtctaactagtattttacatctaataaaaccactctacggggaaacatttaaaagaagaatggtataataaactctgagccggctgtcagaagaattaaagtgcagcatcttaggcaaagtactgaagggcagaatttctccattttaagagagaagtgaacacagacgcaatcattataaagttgtaaaacactataaaacagactcatgggaaaattcctctaaggtgaaatcgctcaaacakgaaattaccaggttgcgctggggagtgagtagaaagtggcgtctgccaggccagagggagaagatgtagctcttaccatcatttggtactccttgaagttctatattggttgttttgggtttcttcttaggtggctgggacccatctgctgaggactgcctcttcttctctgaactagccccttcatccatcaaggaggtttggactgcatccggtggggggccgtaaggattttcttctgggtcttctacctcaggggcaatgggtaaatacaatagagcctttgaatcttccagctct

SEQ ID NO: 31787 - DNA, 601 bp, Human
tgcaaaatgtgatctgcagttagctaaaagagaagaggaagggccgggcgcagtggttcacgcctgtaatcccagcacttagggaggccgaggcaggcggatcacttgaggtctggagttcgagaccagcctggccaacacggcaaaaccccacctctactaaaaatatgaaaattagccaggcgtggtggtgcatgcctgtagtcccagctactcgggaggctgaggcaggagaattgattgaacccgggaggcggaggttgcagtgaaccaagatcatgccactgcactgcagcctggrcaacagagcgagaccctgtctcaaaaaaataaaataaaataaaataaataaaaataaaagagaagaggaagaaggatgctcaatggtaaacacacacccccatccatccctacttatcccaagacatgataataaaggcttcccaagtcagactctaaaaggtggcaggaaggatgaaatgattgtccaagtctaactagtattttacatctaataaaaccactctacggggaaacatttaaaagaagaatggtataataaactctgagccggctgtcagaagaattaaagtgcagcatc

SEQ ID NO: 31788 - DNA, 601 bp, Human
gccaaaaggcacacatggcttatattaagcttgtccaatctgtggcccacaggctacatgcggcccaggacagctttgaatgtggcccaacacaaattcataaattttcttaaaacattatgagtttttttgcaatttttaaaaatctcatcagctatcattactgttagtgtattttatatgtggcccaagacaattattcttccaatgtggcccagggaagtcaaagattggacacccctggcttatatgttcatgccaagccacagtaactctaaactgaacaagtagctgaaagatrcactaatactatcaaaccaagccagaagaaggaacacacacagatgcacacacacatacacagagaggcatgtgagagcagaaagagaatggactttggaactagagagactagaatgagaatcctgaccccaccacttctgtgagactttaggcaagtttacagaacctcttacacataacctcagcctaaattttctcctttaaaaagcaggtaaaacaacttgcagggttgatgtaaaagtcagcaatggtacatataccaaacagtgtctgaaacagagtagacacagaaatcgat

SEQ ID NO: 31789 - DNA, 601 bp, Human
aaatgaattaaaccagaggttcttacccttctttgggtcatgaattcctacaggaatctgaggaaagctatggacatcttccccagaaaaatattcacataatattttgcatataacatcaggggaatgtagatttattgaaaactatttacagacccaaggttaagagccactgaattaagccaaatctggtttagcctgcccttagcagcagcttaaaattcagaaattatctgctgctgggaaaaacgagggaagagagggggaaaaaatgttgcagttaaatgaagtcaagggctayacaaagcaaggccacgaagcaagccagacaatgctcccaatgtgtccttacctgtcaagggctggctgagttccgcctgcactttacccttcgctgatccttccagaggtaaacctctgtcccctttgtagagtttcggtttaaatggagaatctttctctttaccttttgatcctttaggccggcctgcttgcttcttcttggatttgccatcccccttcacacccagtagtggatggacttctgtaggacagacaggcatggaaaggaatccacatgacaccagtctcatcaccccaa

SEQ ID NO: 31790 - DNA, 601 bp, Human
caaaattttcaaccttcacaaagatccaaaccactctgcagctggtcaataaagccagatgtaatccttctgtggaagtcttggaactatacctcaatgcccctttgaggtttttgggttgttttttaattatttttttcttttgtagagacagggtctcactatgttgcccaggcttgtctcgaattcctgggctcaagcaatctgaccgcctcagcctccccaagtgctgggattacaggtgtgagccattgcacctggctggttttatttttgtttgagacagggtctcactctgttrcccaggctggagtgcaacggcgtgatcatagctcactgcaatatcaaactcctgggctcaagcgatcctcctgcctcagcttcctatgttaccaggtggaccacagatgtgcaccaccacgcctggctaattttttgattattttgtttcccaggctggtctcaaactcctgggctcaagcaatcctcctgtcttggcctctcaaagtgctgggattataggcatgagccactgcacccagctcaaggttttttcttgtttgtttgattggcttttacatagatggggtctcaccatgtt

SEQ ID NO: 31791 - DNA, 601 bp, Human
tgaaaactggcaataaaaatatattcacatgtgcctgagaacagactaaagttacaatgagatacaaactttctactgaatgttatgctgttaaaaatcaaatttaaacttttccatagttcagtcagattaaaagcttacttagcaatggtttttcagatctctctcaacataaatcacaatgaattccttgcattgattttttatttattttatttatttttatttttttagacagagtttcactcttgttgcccaggctggattgcaatggcgtgatctcagctcactgcaacctccrcctcctgggttcaaacgattctcctgcctcaacctcctaagtagctgggattataggcgcccaccaccatgcctggctaattgttttgtatttttaatagagacggggtttcaccatgttggccagactgggcttgaactcctgtcctcgagtgatccacccgcctcggactcccaaagtgctgggattacaagcgtgagccactgtgcccagctgcattgatttttaaaaaacttcctgtgatagaaaaatccactccacaagactcaatatcatgccttaccactttaaggcaatttt

SEQ ID NO: 31792 - DNA, 601 bp, Human
ggagatggataaaactagctatcttcaaaaaccatgattgatgacaatgaaccaatattggagggaaacatgcaatgagaggaaaacaagggaaaaccctgaattgttacagcccagcttcttgagcaaaacgtggtatgagaggaagagagggccttcgttgttccctttctgaaaatttgaaatctttcaagcactttcttttctgcccatcctttgcacacaatatggaaatataggaggtatctggggagaggagaagtttaaaatgagagtatccaacaaaagctttcctaggatwccagtagcaaaatttcagataagaagtcactcaaagacatgcattgaggaccgaaggcaaatgggagataggaaatgacatgtcaaaatgacgctgggtacaatgaagttagatgagcaaaacataagtatcttttctccagcaacataactaagcatcaaagtttaaatgagtcaaaattcctatctgatgtcttcacaaatcttcattcctgagagtctatttggacttatgcttgaaagggaagggaaggtcgtatactcttcttccataattcacttcttcatttaaacataaaat

SEQ ID NO: 31793 - DNA, 601 bp, Human
aatttgtttgtatttctagcagagacggggtttcaccatgttagccaggatggtctcgatctcctgacctcgtgatccacccatctccgcctcccaaagtgctgggagtacaggcatgagccacctcgcccggcggtcttctacctttgtatcttctaaatacaaagatggaacccttagtatcccttagggttatcaaatgatatttaaatataaatactgtaaatactctgctactcatgctacataactaagaaactattagaataaaaagaacaatggtaggatatgtggcaatatktaggtgttaatatgaggtaatatttaaatgaattatttccaagcatattctaagcttagctaatcagttagttttagaaaacttataactcggtcagattaaatgacctaaaacagcaaataaggagaataaaattcagactagctccacagataagacaaaatacaaaaagaagaaatgcaaaaataattcattaccaatctcaaagcttccattaatgaatccaactagagatgttgggatgttgaattgtctctctatttgtgtgagcatggaattcatataagatccagacagtgt

SEQ ID NO: 31794 - DNA, 601 bp, Human
cttcctttgcacccatatagttttttttatgcaattaaaattattactccgggatcatatggtgttagaatgctaaaagggtcctgggcacagaaaggttaataatcccttccaatcctcagtgacactccctcacctagaaaattaaaaagtaaatgccatagcaggcacacaaagctctcattaacccatttctcacccctgcccatttctgcaggctcacattcctaatcctttccaactttatcttggctagccaatattatcaagctgaatgttgcttctcacataggctattgcrctgcatccttcttaggctttttctactggaattttcttcacacttgcttaacctcatttcttctcctagaaaattttagctatcctccgagagtctggcttccctaaatgagtctgtgtttcttctgtccctgtaagaccttgtatatatctatgctaccaaacttacttcattcaattaatactattattatctgcatctctaccttccgttagattatgagctgagtcaattcgtgggctatacatggagttagttctaactctctcactgggatcagcacacaggtgatacaggcta

SEQ ID NO: 31795 - DNA, 601 bp, Human
gtccattgtaattatcaccctatatcctctccctgaataacctcataaattctctctctagttttagcaaacgcctacttacttgctaatcaatagctccagcccagatagttccccagtgcttcagactcacatgactgcaatgtgaacatataactttgtcaccaattgtcaccaatagaagttacagatatgttcagatgacaatatggctgttgcaaacaattcaaaacattgacacaataattactttaaaattagtaactttttaatttaatgggttgattaaaagtacaaataytactatataaaaatttgttttaatattttgataattctacttcaatataattggcttcctttgcacccatatagttttttttatgcaattaaaattattactccgggatcatatggtgttagaatgctaaaagggtcctgggcacagaaaggttaataatcccttccaatcctcagtgacactccctcacctagaaaattaaaaagtaaatgccatagcaggcacacaaagctctcattaacccatttctcacccctgcccatttctgcaggctcacattcctaatcctttccaacttta

SEQ ID NO: 31796 - DNA, 601 bp, Human
ctctagtaattaaaatctctcatatgtattttaagcctctctctctcaactagactttagcctacacatattctctagtttctctccaaacttcccagaacattcatccatattcatagattccgcttttcccccctccctaatcccctatcgtcgctcctaccttcactgcttcctagcgtctaaatttgttagtgccctggcaaagatcatcagttatctccatattatgaaacccagggaatagttcttcatccttgtctaactggatatttctaatgcttttcacactgctgatactttttttttttttcaaatttctactcctttgtttttcataataccattttctcctagttccccctcttgtttctctgaccattccttctcttaacatagactccttttcttctacctgtgccttaaatgtttgtgcagctcaagatctattctttgtccattgtaattatcaccctatatcctctccctgaataacctcataaattctctctctagttttagcaaacgcctacttacttgctaatcaatagctccagcccagatagttccccagtgcttcagactcacatgactgcaatgt

SEQ ID NO: 31797 - DNA, 601 bp, Human
gttttgtaactcattgtttaaaaatatcttcattttggtcaacatgaccaagacagggatctattttttttctacttctttccctagatcagacaatgcagtgaagtaaaaattagtagacccccacttctactcagtcttcagtgagtctggatttgaggaataaaaatggcaatgaaaaatgtatccgcatgtcttaggacgaagctttagaataaagaaactaatgggggaaggcccatctgatggacagatccttgaagagtgtggaataaagatttgaaaaaaacaaatatacgartaagttttttgcaaaccatacatttttaattcagtaaataatatctaccttgcccccactatatataaagaatgcctctgcaatgactcaagattataaaaatttcaaaattttttttcctcaaggagttaataattttctaagtggtgtatattttgaaaagttttctttccacctgtatttttctctagtctgccttgtgtgtagaagatatgtccatttgtccattattttatatggagagcgccccaccgcaataactatatcagccacattgacctctctagttttctaaaatct

SEQ ID NO: 31798 - DNA, 601 bp, Human
aaaccccgtctctactaaaaatgcaaaaaattagccaggcatggtacctgtagtcccagctactcaggaggcttgagacaggagagttgcttgaacctgggaggtggaggttgcagtgacccgagatcacaccactgcactccagcctaggtgacagagcaagactgtctcaaaaaaataataataaataataaaaaaaaaaaaacagaaaaaaaagaaagaaattggtggcaaatacaagaaagagctaaaagttataagcacttgcctctggaaagcagtaataagtgacaagggagamctttttgtcaatgtaagcttttttgtaatagtttttatttttatgactttgtacatagttactttggtaaaaattaaaagaaaaatcagccttcagactgctctgtctcttggtgatctgcaattaagcagaatctcattattaattagaagtatttacatggtcctgagaagggaataatcccaagtttgggctggtcctgagaatcttttcaccagactcaactccacaagaaaaggtcccaaatccccattgtgtaaattgacaaaactgactgcttaagtggaagtgaggcagcca

SEQ ID NO: 31799 - DNA, 601 bp, Human
gcactttgagaggccgaggtgggcggattgcttgaacccaggggttccagaccagcctggccaacttggggaaaccccatctctactaaaaatacaaaaattaactgagtgtagtggcatgcacctataatcccagctactcgggaggctgaggcaggagaatcacttgacccaggaggcagaggtttcagtgaaccgggagatggcgccactgcactccagcctgggcgacagagtgagtgagactgtctcaacaaaaataaaaacagaggccgaggcgggcgggtcacgaggttaggaratcgagaccatcctggctaacacagtgaaaccccgtctctactaaaaatgcaaaaaattagccaggcatggtacctgtagtcccagctactcaggaggcttgagacaggagagttgcttgaacctgggaggtggaggttgcagtgacccgagatcacaccactgcactccagcctaggtgacagagcaagactgtctcaaaaaaataataataaataataaaaaaaaaaaaacagaaaaaaaagaaagaaattggtggcaaatacaagaaagagctaaaagttataagcacttgcctctg

SEQ ID NO: 31800 - DNA, 601 bp, Human
acatcaaaacaattacattagtaatatcaatgatcactaatcacagatcgccataacagatacaaaaataatgcaaaagtttgaaatattgcaataattatcaaatatgacccagacacaaagtgagcacatgctgttggaaaaatgattctaatcttcaacgtagggttgcaataaaccttcaatttgtgagaaatgtaatatctgcaaagtgcaataaagtgaaatgcagtaaagcagggtatgccaggattcaaaactaatagaataacatttagttagaaatacagaggcaaggctkggccaggtggctcatgcctgtaatcccgcactttgagaggccgaggtgggcggattgcttgaacccaggggttccagaccagcctggccaacttggggaaaccccatctctactaaaaatacaaaaattaactgagtgtagtggcatgcacctataatcccagctactcgggaggctgaggcaggagaatcacttgacccaggaggcagaggtttcagtgaaccgggagatggcgccactgcactccagcctgggcgacagagtgagtgagactgtctcaacaaaaataaaaacagaggc

SEQ ID NO: 31801 - DNA, 601 bp, Human
gtgagatcgcaccactacaccccaccttgggcgtcactgtatctctaaaaagaaatacataaataaataaatcaccatcttaaatgggcataagttagtggcacatcaaaacaattacattagtaatatcaatgatcactaatcacagatcgccataacagatacaaaaataatgcaaaagtttgaaatattgcaataattatcaaatatgacccagacacaaagtgagcacatgctgttggaaaaatgattctaatcttcaacgtagggttgcaataaaccttcaatttgtgagaaatgyaatatctgcaaagtgcaataaagtgaaatgcagtaaagcagggtatgccaggattcaaaactaatagaataacatttagttagaaatacagaggcaaggcttggccaggtggctcatgcctgtaatcccgcactttgagaggccgaggtgggcggattgcttgaacccaggggttccagaccagcctggccaacttggggaaaccccatctctactaaaaatacaaaaattaactgagtgtagtggcatgcacctataatcccagctactcgggaggctgaggcaggagaatcacttgac

SEQ ID NO: 31802 - DNA, 601 bp, Human
ggtcaaagctacagtgagtgagatcgcaccactacaccccaccttgggcgtcactgtatctctaaaaagaaatacataaataaataaatcaccatcttaaatgggcataagttagtggcacatcaaaacaattacattagtaatatcaatgatcactaatcacagatcgccataacagatacaaaaataatgcaaaagtttgaaatattgcaataattatcaaatatgacccagacacaaagtgagcacatgctgttggaaaaatgattctaatcttcaacgtagggttgcaataaacctwcaatttgtgagaaatgtaatatctgcaaagtgcaataaagtgaaatgcagtaaagcagggtatgccaggattcaaaactaatagaataacatttagttagaaatacagaggcaaggcttggccaggtggctcatgcctgtaatcccgcactttgagaggccgaggtgggcggattgcttgaacccaggggttccagaccagcctggccaacttggggaaaccccatctctactaaaaatacaaaaattaactgagtgtagtggcatgcacctataatcccagctactcgggaggctgagg

SEQ ID NO: 31803 - DNA, 601 bp, Human
atcacctgagcctgtggaggtcaaagctacagtgagtgagatcgcaccactacaccccaccttgggcgtcactgtatctctaaaaagaaatacataaataaataaatcaccatcttaaatgggcataagttagtggcacatcaaaacaattacattagtaatatcaatgatcactaatcacagatcgccataacagatacaaaaataatgcaaaagtttgaaatattgcaataattatcaaatatgacccagacacaaagtgagcacatgctgttggaaaaatgattctaatcttcaacgyagggttgcaataaaccttcaatttgtgagaaatgtaatatctgcaaagtgcaataaagtgaaatgcagtaaagcagggtatgccaggattcaaaactaatagaataacatttagttagaaatacagaggcaaggcttggccaggtggctcatgcctgtaatcccgcactttgagaggccgaggtgggcggattgcttgaacccaggggttccagaccagcctggccaacttggggaaaccccatctctactaaaaatacaaaaattaactgagtgtagtggcatgcacctataatcccag

SEQ ID NO: 31804 - DNA, 601 bp, Human
gggcaatatggtgaaatcctgtctctaccaaaaaaatatatatatatacaaaaattagccaggcatagtggcacatgcctgtagtttcagccactggagaggctgaagtgagaggatcacctgagcctgtggaggtcaaagctacagtgagtgagatcgcaccactacaccccaccttgggcgtcactgtatctctaaaaagaaatacataaataaataaatcaccatcttaaatgggcataagttagtggcacatcaaaacaattacattagtaatatcaatgatcactaatcacagatygccataacagatacaaaaataatgcaaaagtttgaaatattgcaataattatcaaatatgacccagacacaaagtgagcacatgctgttggaaaaatgattctaatcttcaacgtagggttgcaataaaccttcaatttgtgagaaatgtaatatctgcaaagtgcaataaagtgaaatgcagtaaagcagggtatgccaggattcaaaactaatagaataacatttagttagaaatacagaggcaaggcttggccaggtggctcatgcctgtaatcccgcactttgagaggccgaggtg

SEQ ID NO: 31805 - DNA, 601 bp, Human
cacttcaacacctgaaggccacaatagggttattataataattggcctaatttcaatatttttgtatctaggggaataagggggcccaaggaaagggcaaaaaatggggcaatggctggtcagtggagcagtcagaacacacacaacatttgttgattacattcaccatcttaagaccagcacggtggctcacacctgtaatcccaacattttgagagtctgaggcaggcgcattgcttgaacccaggagttcaggaccagccagggcaatatggtgaaatcctgtctctaccaaaaaaawatatatatatacaaaaattagccaggcatagtggcacatgcctgtagtttcagccactggagaggctgaagtgagaggatcacctgagcctgtggaggtcaaagctacagtgagtgagatcgcaccactacaccccaccttgggcgtcactgtatctctaaaaagaaatacataaataaataaatcaccatcttaaatgggcataagttagtggcacatcaaaacaattacattagtaatatcaatgatcactaatcacagatcgccataacagatacaaaaataatgcaaaagtttgaa

SEQ ID NO: 31806 - DNA, 601 bp, Human
gttataaagacagcttctttccttaaacctcatgaacccacctctcttggcttaaaaatttccttctgcagcttcctaatctctcttaactttcgtagaatagaagagagagtcttgctcttctggctcaagggaatgttgtggctggcttaatcttctgttcagactactcaaactttctccatctcagcaataacactgtttcactttctaatcatttgtgtcttccttgaaatagcactttttccttgtgttcacagcttggctatttggtgcaagtggcttagctttgggcctattytgaatttcaacttgccctcctcgctgagcttaatgatttctagcttttgatttaaagtgagaaatgtgcaactctttctttcacttcaacacctgaaggccacaatagggttattataataattggcctaatttcaatatttttgtatctaggggaataagggggcccaaggaaagggcaaaaaatggggcaatggctggtcagtggagcagtcagaacacacacaacatttgttgattacattcaccatcttaagaccagcacggtggctcacacctgtaatcccaacattttgagagt

SEQ ID NO: 31807 - DNA, 601 bp, Human
tcatctccatgtacatctccatcagagctcctgggcaactagatgcattgtcaattagcagtaatattttgaaaagacttctcctccctatctctgaaagtccgagatggcatcttctttcaaaagaaggctgtttccacttcgggaggccgaggcagacagatcacctgaggtctgaagtttgagaccagcctgaccaacatggtgaaactccgtcactacaaaaaatacaaaaattaactgggcgtggtggtaggtgcctgtgatcccagctacttgggaggctgaggcaggagaattccttcaacccaggagtcaaaggttgcagtgagctgagatcacgccactgcactcgagcctgagcaacagcatgagactccatctcaaaaagaagaaagaagaaggagagggagaatgagaaggagaagaagaaggaggaggaggaggaagaggaggaggaggagaagaagaggaggagggaggaggagaagaagaagaggaagaagaagaggaggagaagaagaagaggaagaagaagaggaggaggaggaaggagaagaagaagaaggctgtttcatccacattgaaaatctgttattta

SEQ ID NO: 31808 - DNA, 601 bp, Human
acaaactgtgtgtcttacataataagacttgaaagtccaagttactcctgatttgtggccacacaatggatgttgtgttagcaggcatgaaaacaacattcatctccatgtacatctccatcagagctcctgggcaactagatgcattgtcaattagcagtaatattttgaaaagacttctcctccctatctctgaaagtccgagatggcatcttctttcaaaagaaggctgtttccacttcgggaggccgaggcagacagatcacctgaggtctgaagtttgagaccagcctgaccaacrtggtgaaactccgtcactacaaaaaatacaaaaattaactgggcgtggtggtaggtgcctgtgatcccagctacttgggaggctgaggcaggagaattgcttcaacccaggagtcaaaggttgcagtgagctgagatcacgccactgcactcgagcctgagcaacagcatgagactccatctcaaaaagaagaaagaagaaggagagggagaatgagaaggagaagaagaaggaggaggaggaggaagaggaggaggaggagaagaagaggaggagggaggaggagaagaagaagaggaa

SEQ ID NO: 31809 - DNA, 601 bp, Human
cattgggggaaatgtcttcaaaatccctagggaaaatatttccaatctagaattttatccaagccaaagtaacaatcaaatatgggagtaaaataggagtattttcagatatacaaagtcttacattttatatttctcttgtatactttcttggaaagctactagattatttccttcacaaaaacaagtgaagaggaaagaggaaagcaggagacatgacatcccagaaaatgaataactgaatgtatgaaacaggtaaaaagcaaattctcaaggataataatgagagaaaattccaagraaatagcaatgcagcaggcctagagaattccaagttcagattgcagatggagaattgaaagtgatatgtgaggaatctccaagacaaaaataatacactgtgatatggataagaatattgaggagacatttgccctaccagtggagaatttggtgatgaattcgtgaacaatacaaagaaagctaaccatatgatataacgaggtaattattaaatctagggaaaataaaaagttatataagtaaagaatgataagcgcatggttcagtggtaaaaaagatttacataattatacaaatg

SEQ ID NO: 31810 - DNA, 601 bp, Human
gttagatagagctagaaaacattgggggaaatgtcttcaaaatccctagggaaaatatttccaatctagaattttatccaagccaaagtaacaatcaaatatgggagtaaaataggagtattttcagatatacaaagtcttacattttatatttctcttgtatactttcttggaaagctactagattatttccttcacaaaaacaagtgaagaggaaagaggaaagcaggagacatgacatcccagaaaatgaataactgaatgtatgaaacaggtaaaaagcaaattctcaaggataatratgagagaaaattccaaggaaatagcaatgcagcaggcctagagaattccaagttcagattgcagatggagaattgaaagtgatatgtgaggaatctccaagacaaaaataatacactgtgatatggataagaatattgaggagacatttgccctaccagtggagaatttggtgatgaattcgtgaacaatacaaagaaagctaaccatatgatataacgaggtaattattaaatctagggaaaataaaaagttatataagtaaagaatgataagcgcatggttcagtggtaaaaaagat

SEQ ID NO: 31811 - DNA, 601 bp, Human
aatccagtaactcaaagtctattcattcccaaagcatcagcaaaatgacggtaaatagattttcaaacagaatggggaaaggcatgattccacaaggataaaaaaaatagggaattttacaataaaagagagctcaacaagattttcaaaatggaaaagcaggtaactgagtggtcactgaaataaaagatatgagaagtgcaactctaagtgcctgcaaggaagcaatgctgcaaagcccaggaacattcaggcaagatacttaaatgcaaaagtgagtatgatccaaaacaataagagygcaaacattttggtttaaagtttgtttaagaaacattcaactcccagagacatcccctgccactccagctgaaaatgttcattgactccagagtctggagaggcacactgagcatagaaaggcaatacaaaaaaattgggggtattaagttaaaaaaatctacatatctacatattaaacagtgagattccaacttccatttggctggtagctaagcttctacctcccaaggaacagattgaagaattcctgtctaggataacaggttatctgcaattctgagccatgtgcgaaacagcc

SEQ ID NO: 31812 - DNA, 601 bp, Human
ctcaaaataccttccccttagaacaattgctcattgatgcccaaagagtttggctgtgaactatagacaaaggcttctgtctccatactcacaatcctatgagacatgacaacctcaaggaaataacacctttggcaggtggtagaaagaaatgtatacagtggctgaatattacttgacattgttttggataggctaggaaataaaagaaaaggaaagactctgcttagaaactctgatcccttcaaaaatactttaaaagagaaaatatgttttgttaatttatccactaaaaatccartaactcaaagtctattcattcccaaagcatcagcaaaatgacggtaaatagattttcaaacagaatggggaaaggcatgattccacaaggataaaaaaaatagggaattttacaataaaagagagctcaacaagattttcaaaatggaaaagcaggtaactgagtggtcactgaaataaaagatatgagaagtgcaactctaagtgcctgcaaggaagcaatgctgcaaagcccaggaacattcaggcaagatacttaaatgcaaaagtgagtatgatccaaaacaataagagtgcaaac

SEQ ID NO: 31813 - DNA, 601 bp, Human
ttcatccttggcatccaagttatcataagttaatatcatcaaaaaacttgccactttctgtaaatgaacaatctttttatacttagctttcaataatctgcctgtggatgatctacctttagattatcaaatatcaactttctttgatttttaggttatcatttcctggatataattattatgagataaggaacacaaactttaaaaaatgtgacattcaataatgcataattaagaagataaatgctttggaaggaataacaacaaaacaagccttcaacttggcattctctaaagtttrctcaaaagaagcgaaacctccagtttctgagaaaccgtacaataactcctccatgcgtttcataaacccctaaaaaaaccaaaatatttgtccatcataatgagaggccttaagagaatctcaatcaccatgacacataatgtaatgactttttctcttctcataagaacaaatggattaataaactatgaccatttaatttaagcaaattaccacaagatccacatgcttttcctcagaaagtaaattacatgccgtaagatgggaaaaaaagtatgttcaaagtatgttcagtgaagt

SEQ ID NO: 31814 - DNA, 601 bp, Human
atagaaagggaatagagtaattcagaactatagcgtacttgcctgttttccccgctattaaagatcagtgatagaacacaaatctcttgaactttgtttctgtctctagttcctatttacataatcatatacaccaaatcatcagcataaatccatccttataagatgttttcctctgtgggatgaacttaacagtggtccttggatagatgtctttgactctttttttttttgagacagagtctcactctgttgcccaggctggagtgcaatggcgcaatcttggatcactgcaacctcygccacctgggtttaagcgatcctccagcctcggcctcctgagtagctgggattacaggtgcccgctaccatgcttggctaatttttgtattttttaatagaggtggggtttcaccatgttggccaggctggtctcgaactcctgacctcaggtgatccatccgtctcagcctcccaaagtgctgggattacaggcgtgagccactgcacccggccctttgactcatttttagataacatgttaataaataaacaaggaactctcaataaatacattcaaatataagaaaaataacattct

SEQ ID NO: 31815 - DNA, 601 bp, Human
cagctgggtccaggaatttcttgtgagtgctatctctccattatttccagtcggaaaataatagtctctatttctaggtattcagatttgtttgtgtgatgcacaaagtgatttgtgtctagagatcacaggcaaactctaggcctattctagggcaaaattgaaagcatcaatccaccttcctggagatgtgccagaatgggaaggttttgctatatccacaatgaagccgactagcacctgggtcagtctttggcaatagcccgctcaggaagagaacacaggccactattaatgtcaytgttttcctttgtttcccccatgggggttctttggcttcttctgagacagacatttttcaaatttttgaaactgttttggtttcctgactcaatgatggtcatgaaattcccacccttgtggactactgcaatttccacgaacatgaatccagaataaaaatgtccccataaaaatgttgagtcatcagagtcatctccagaccaagtataaccagaagattatacaagtctcttagcagaagggacagaaggggcagaagccagtacattggtgcctagggctaccagaagctgaaaga

SEQ ID NO: 31816 - DNA, 601 bp, Human
ataaatttgccaggtgagactgtgaggtcctgaccacagctgggtccaggaatttcttgtgagtgctatctctccattatttccagtcggaaaataatagtctctatttctaggtattcagatttgtttgtgtgatgcacaaagtgatttgtgtctagagatcacaggcaaactctaggcctattctagggcaaaattgaaagcatcaatccaccttcctggagatgtgccagaatgggaaggttttgctatatccacaatgaagccgactagcacctgggtcagtctttggcaatagccmgctcaggaagagaacacaggccactattaatgtcattgttttcctttgtttcccccatgggggttctttggcttcttctgagacagacatttttcaaatttttgaaactgttttggtttcctgactcaatgatggtcatgaaattcccacccttgtggactactgcaatttccacgaacatgaatccagaataaaaatgtccccataaaaatgttgagtcatcagagtcatctccagaccaagtataaccagaagattatacaagtctcttagcagaagggacagaaggggcagaagcca

SEQ ID NO: 31817 - DNA, 601 bp, Human
tcaacaaacttttatggaaggccaactgtgccaagatactctactcatcattgtggaaatcactaagactacaaaaatataactaatttctaacctcaaggaacatattgccctgaaaagaagctaaggtagatttccatacttaccaatatataaaggagaattttcaaatttggcaaaatcttctatataggaaatacccaaaggcaggatgggagtttcacccattccacgtacaatattgcctactaggacgtacacccacattaatgatttaacttcctttgtacactctgcattaaaaaaaaaagacatgacattagtgctttgacgataaagtgtcagtaatattaattctatgttttctgtaggcatttcacagttatatgaccatggccccttgtcaatgatttatattactattccagcagtgacttctcagggcacccctagtgcattttctgacagtggacttgagtatggacaagtgtaagtgatatgctggagccagtccctactgagttgggagagatgagtatacacacctcctcccaactcagtgttcagtgacacctcattggtagtttcatagcagtgttac

SEQ ID NO: 31818 - DNA, 601 bp, Human
ttagagaaaacatttgcaaatctcttaacagattggatgtagtgtagtgccaagcagatgaaagggtcacctccaggggcactagacttgtggtatttccaatagtagaaagtagatttattaaccaagtagctcattgtcatttagcatatctcatctccattcaacaaacttttatggaaggccaactgtgccaagatactctactcatcattgtggaaatcactaagactacaaaaatataactaatttctaacctcaaggaacatattgccctgaaaagaagctaaggtagatttcyatacttaccaatatataaaggagaattttcaaatttggcaaaatcttctatataggaaatacccaaaggcaggatgggagtttcacccattccacgtacaatattgcctactaggacgtacacccacattaatgatttaacttcctttgtacactctgcattaaaaaaaaaagacatgacattagtgctttgacgataaagtgtcagtaatattaattctatgttttctgtaggcatttcacagttatatgaccatggccccttgtcaatgatttatattactattccagcagtgacttc

SEQ ID NO: 31819 - DNA, 601 bp, Human
agagaaaataataaagagaaactacagacaaagtaatgagaacctcaacaaaaacagaggtagtgaaaatagcgagaaaggttttgaatgcacagaacattttagagaaaacatttgcaaatctcttaacagattggatgtagtgtagtgccaagcagatgaaagggtcacctccaggggcactagacttgtggtatttccaatagtagaaagtagatttattaaccaagtagctcattgtcatttagcatatctcatctccattcaacaaacttttatggaaggccaactgtgccaagayactctactcatcattgtggaaatcactaagactacaaaaatataactaatttctaacctcaaggaacatattgccctgaaaagaagctaaggtagatttccatacttaccaatatataaaggagaattttcaaatttggcaaaatcttctatataggaaatacccaaaggcaggatgggagtttcacccattccacgtacaatattgcctactaggacgtacacccacattaatgatttaacttcctttgtacactctgcattaaaaaaaaaagacatgacattagtgctttgacgataa

SEQ ID NO: 31820 - DNA, 601 bp, Human
tgttccaggtgacctacatggattttaaaatggtaatttcaagaaacataaacaaaaagatgaagacgtatttgtgaaaaatatgaagaagcctgactatatggagagatcattaagaagagaaactgtatagaaactaagtaagtgaatgtcatgcagagccatgagtaataagtggacagatcagatttaataaatgaggagcttatatgtgtcataaatatagtagagaagacatgattaaaacaatgcttgagaaaaattatattgcaagaatgtttcttaaaaactgagaaaataraattctgaagagaaaataataaagagaaactacagacaaagtaatgagaacctcaacaaaaacagaggtagtgaaaatagcgagaaaggttttgaatgcacagaacattttagagaaaacatttgcaaatctcttaacagattggatgtagtgtagtgccaagcagatgaaagggtcacctccaggggcactagacttgtggtatttccaatagtagaaagtagatttattaaccaagtagctcattgtcatttagcatatctcatctccattcaacaaacttttatggaaggccaactg

SEQ ID NO: 31821 - DNA, 601 bp, Human
cctgactgcagatgatttgtccgcctcagcctcccaaagtgctgggattacaggcatgagccaccacacctggtcaattttccaacttttaacctagcttttatattctcttctaaactccagagccatatggaactgttttcttggtgtagagctatttgatttatagttatttggttatggatacacacatgaacacacactatatatgtatatacatatatatacacactacatatatatagtactaataattatgtagttctttatttactaaccttgtatggaccacatcatcctyattttaatatgtatagagattatcacagctacatttacatataatacaccatagtatttgttgaataaagaaacagatgtcatagcaaggtgtttgttaatttattgtaggagagtgtttgcattcttttaatataagtttgtgaaggaagttaaaaggactgaatagaaaatcactgaaaaagattattgcaaaattaatgagttgccaaaatgtgtgaaaagtcacttgggttaatgatccctcaatattttcatccatctggattatgtgtaatcatttccatcttctctcaccctc

SEQ ID NO: 31822 - DNA, 601 bp, Human
agtgatctctttgtcactaatttagtgtctttttttggtcttcatcttcctagctttctaggttatttgacattgctggccaactcctctttttacatttcttcctgagagtttcattaaactatacatgtattgtttcattgtgttcttatgactattccttctttgattttcctttctcctattctatttactaagtaaaagtctttcccagtattttatcctaatatctctcagtatatatatgttcttccacagcaaccttatttctccctcttgatttcatttattacctctccatttttttttttttgagatggagtttcactcttattgctcaggctggagtgctcactgcaacctccacctcccgggttcaagtgatccacctcccgggttcaagtgattctcctgtctcagcctactgagtagctgggattataggcacatgccaccacacctggccaatttttgtacttttagtagagatggggttttatcatattggacaggctggtctcgaactcctgaactcagatgatctgcctgcctcagcctcctgagtagctgggattacaggcgcataccaccacactcggct

SEQ ID NO: 31823 - DNA, 601 bp, Human
cctatctgtcttcacttgaattcttatccattaaaatttcatcatcagctgtctcatcacttgtctacaattcagaacctatgctgaaccctccctgatctctgaaaatccagacacgagcttcttcaactttcttcctgttcacttcaaaatttggctttgcctattatctctgccttctccatggttcttggagaacccgccctatacacacctaacttcttggttccaaccccttctatcttctctaaggttttgctctaccaaatactccctctcttgtgcgcgttcaatttccccrtagccaatgattctacaaaatctcaaatccaccctgctttctctcctttcactatactctctgcctctacttcctcacctctcactcactttactcaaatccttttacattctcctccaaatactctcaggtagccccagtgatctctttgtcactaatttagtgtctttttttggtcttcatcttcctagctttctaggttatttgacattgctggccaactcctctttttacatttcttcctgagagtttcattaaactatacatgtattgtttcattgtgttcttatgactattcct

SEQ ID NO: 31824 - DNA, 601 bp, Human
aaaagcctgaagattgaatatttttgccttggatacttttgactagatacacaatttatatgaagttaagcttgatgtacatataaatgatggttgtttctgtaaatgttgaaaaagaagcctcataatttaaagccactttccctggcctccaaattccctttcatgctgggtcacaggtagagatttgctgtaacagcacaggcagtcccagctgggatcatgccattgactaggtcgtgatataaccaaggtcctgttaattcatcccacaggcatgttttgggaggaattctaaagyaataccatcttatagtggatttctcatggcacattcctcaaaaaagtttcactctcagatctgcaacttgaaacttccttctggctatgtcctcattattattatatgatacaagtctttgattttatcatgttctccttcctttacttccacagttttattttccatgtccatcagtcctatctgtcttcacttgaattcttatccattaaaatttcatcatcagctgtctcatcacttgtctacaattcagaacctatgctgaaccctccctgatctctgaaaatccagacacgagct

SEQ ID NO: 31825 - DNA, 601 bp, Human
ataatagctcctgtttctacaagccctaaaaataaataaaagtataaggttatagtacagttatatgcccacataaagagttctaggtctatgaaaagcctgaagattgaatatttttgccttggatacttttgactagatacacaatttatatgaagttaagcttgatgtacatataaatgatggttgtttctgtaaatgttgaaaaagaagcctcataatttaaagccactttccctggcctccaaattccctttcatgctgggtcacaggtagagatttgctgtaacagcacaggcartcccagctgggatcatgccattgactaggtcgtgatataaccaaggtcctgttaattcatcccacaggcatgttttgggaggaattctaaagcaataccatcttatagtggatttctcatggcacattcctcaaaaaagtttcactctcagatctgcaacttgaaacttccttctggctatgtcctcattattattatatgatacaagtctttgattttatcatgttctccttcctttacttccacagttttattttccatgtccatcagtcctatctgtcttcacttgaattcttatcc

SEQ ID NO: 31826 - DNA, 601 bp, Human
gatgcttgttctgttctgtaaagtctggaggaaaatcgagttgataaagaagatttcacacaaatatttattttatcactccctgaacatttgaaataaagatgtgtgggaattaatgagatatgaatgttctcaagtatccggaatttttttttgcttcttcagaacaacagtttcagtggttctgccattggttctcagcaagatctacctggagatattttttaaaataccaacatccaggtcccaccctcagagatgctgattcatttggtacattctaaggactatgtaaatgatktaatcaaaaatgattcctgttagaaaaagcacagagccaaatgtgtggcctgcctctagtaatgtttggcctgcttctagtaatgtgtggcctgcctctagtaatgtgtggcctgcttctagtaaatgttcttggtcacactgctaccattcaggctcaagttctcacttttaatttcctttcacttttcctgtccacatgttctctgtcttgactttcttatgcacaatcttggtttgcttaataaactgctcacaattcattctggaacaaaatttcaataaataaacaatttagaag

SEQ ID NO: 31827 - DNA, 601 bp, Human
gttttgccctcaataagtcactgttgagtcttaaagatcagtaagcaaaactacaaagtgaccaaaatattgtctacgtccacagcattttattactaaccttttgttcttctattaatatattcttttttctacagctcattagaatgaaagatgcttgttctgttctgtaaagtctggaggaaaatcgagttgataaagaagatttcacacaaatatttattttatcactccctgaacatttgaaataaagatgtgtgggaattaatgagatatgaatgttctcaagtatccggaattyttttttgcttcttcagaacaacagtttcagtggttctgccattggttctcagcaagatctacctggagatattttttaaaataccaacatccaggtcccaccctcagagatgctgattcatttggtacattctaaggactatgtaaatgatttaatcaaaaatgattcctgttagaaaaagcacagagccaaatgtgtggcctgcctctagtaatgtttggcctgcttctagtaatgtgtggcctgcctctagtaatgtgtggcctgcttctagtaaatgttcttggtcacactgctacc

SEQ ID NO: 31828 - DNA, 601 bp, Human
tgtattgtttgctaattcttttttccccttgaaagctgaagtcatagcaatgttttggtggcttctggaagtcagtgatgtagctgactgggtagggatcagaacacaacagttttgccctcaataagtcactgttgagtcttaaagatcagtaagcaaaactacaaagtgaccaaaatattgtctacgtccacagcattttattactaaccttttgttcttctattaatatattcttttttctacagctcattagaatgaaagatgcttgttctgttctgtaaagtctggaggaaaatcragttgataaagaagatttcacacaaatatttattttatcactccctgaacatttgaaataaagatgtgtgggaattaatgagatatgaatgttctcaagtatccggaatttttttttgcttcttcagaacaacagtttcagtggttctgccattggttctcagcaagatctacctggagatattttttaaaataccaacatccaggtcccaccctcagagatgctgattcatttggtacattctaaggactatgtaaatgatttaatcaaaaatgattcctgttagaaaaagcacagagc

SEQ ID NO: 31829 - DNA, 601 bp, Human
catgaaggagatcatgttaacgaatgcattgaactgtatcacacttacaagtatgaaaagcatataaattggattgcaggaaagacttttcatgaaaggtagaaaatctgaaatgaaagaatgacaactgtgtcaaacgaacttggctttgcattttgtgactggcttttcctgaaacatccacctcctcaacaaattatgttttttactattttgtaatatgtattgtttgctaattcttttttccccttgaaagctgaagtcatagcaatgttttggtggcttctggaagtcagtgatrtagctgactgggtagggatcagaacacaacagttttgccctcaataagtcactgttgagtcttaaagatcagtaagcaaaactacaaagtgaccaaaatattgtctacgtccacagcattttattactaaccttttgttcttctattaatatattcttttttctacagctcattagaatgaaagatgcttgttctgttctgtaaagtctggaggaaaatcgagttgataaagaagatttcacacaaatatttattttatcactccctgaacatttgaaataaagatgtgtgggaattaat

SEQ ID NO: 31830 - DNA, 601 bp, Human
aacatagaatccttgaactggaaccaaaaagagtaaaatttggtagtaaaatgcacaatcctatctgaaaatatgtaatttttgcactcccaaatatttgcattcatattatgaattcacattctgacttcagagagaagaaaatcaaggtatttctgacctcttcccttccctaccctttctttctttccttctttccttccttctttccttccttctttctttctttctttctctttctttctttctttcttgagattagaaggaagaaatccaccagagtcaaaaaatatcctaaaasacttcaacttaggagtttgctacacccgccatcacactgttcgtgggggggaaagtgtgctagtaaggcagagaaaaacaaacatacccattagaaagattgcatctgaagatgatattccatattgctgttctaggtatttaggcatgaaggagatcatgttaacgaatgcattgaactgtatcacacttacaagtatgaaaagcatataaattggattgcaggaaagacttttcatgaaaggtagaaaatctgaaatgaaagaatgacaactgtgtcaaacgaacttggctttgcatt

SEQ ID NO: 31831 - DNA, 601 bp, Human
taggatccaggtagaagtggcaagtcaaaattggccagtaatttattcatttattaccctctattctgtgtagtgagaatatatatatacaatttttcagttacctatcctcactttggttgtgaagaattagactcctctcaaagtgctttttcttttctttttttagagacagaatcttgctttattgcccaggctggagtgcagtgatatgatcatagctgactggagcctcagcttcctgggcttaagagatgctcccacctcagccctctaagtagctgggactacaggtgcacamcaccacacctggctaatttaaaaacaaaaattgcagagacaaagtcttgctatgttgtccaggctggtcttgaactcctggcctcaagtgatcctcactcctcagcatcccaaagtgctggaattaaaggcatgagccaccacacccagttcaaggtactttagagagtcactttgctgagcctgttgctgtcaagtgtatttacatttcatgtcttgctgctactggctcttcctctctgaacccttcccaataagtgaaaaaaaagaatagaaaaaggagaagatagccctaggttcc

SEQ ID NO: 31832 - DNA, 601 bp, Human
ttgcttcaaaggaatagtttatttcagcagggcgcagtggcttacgcctgtaatcccagcactttggggggccaaggcaggcggatcacaaggtcaggagttcgagaccagcctgaccaacatggtgaaatcccgtctctactaaaaatacaaaaattacccgggcatggtggcatgtgcctgtcatcctagctactcaggaggctgaggcaggagaatcgtttatacctgggaggtggaggttgcagtgagccgagatcatgccactgcactccagcttaggcgacagagtgagactccrtctcaaaaaaaagaaaagaaaagaaatagtttctttcaaaaaaagaattgtcaaccttttttgaattgttacatgtttccaggtcttaataagaatcaaaatttatagtttactttgatcaccaaccaacgttatattaatattacaattgatgttatattatattgtgatatcttagaggcaagagaacattcctaattctaaattctcaaagaactgtcagaatgtgaaaaacacagaaagcacatccatacatatacacagaaatatatatatgtgtgtatatatatatgtatatat

SEQ ID NO: 31833 - DNA, 601 bp, Human
aaaataattttgtacctcaagagaaccatatatccaggtatggcagccaaagaataaatgaaactgctcatcgctgacaagattaggaagtactggagcatcaaggaacagtcaggtcctttgtcgcacagcccaagaactgcagatgaatttcctgatgtttgaatacagctgcaattttggaacacctgccaaaaaataacatattatactaagaagtaaaaatcttgaacacaaattttaaacattttctacacagccagttggatcaagatggagactgcttgttccctttactccrtctccattatgatgtctctcaagattacaccatataacaaaactggaagggtgatttcagaaaaacggtatatttttctaaatatgaatagtaaatttgtaataactaataagttaccctaaagacacacttttttattattttatttatttatttatttttttgaaacagagactcaccctgtcgcccaggctggagtgcagtggtgcgatctcggctcactacaacctctgcctcccaggttcaagtgattctcctgccctagcctctggggtagctgggactacaggcgcctgccac

SEQ ID NO: 31834 - DNA, 601 bp, Human
tttagaaatgatgagttacttttactgtaaagtttctaaattattaaaagataagtaatcttatggtcaaatgcaacataattattagtagagtaaaacattgaattaaagattctgaactttatatattttcttaaatgttttgggccagttatatgtacattttatttgggcagagcattttctttcattttattttcaaatcttcaaacaaagaatagtgtaattaaggtcagacagggccttttcaagtaaaagagattctctatctctttgtgtgctgcattctcatatttataaygtgctttttacatacagaagggacatttgctagactgcttttctgaaataatattaccttgtttatctagtatttaatattgttctgcacatggacacaggaaggggaacatcacacaccacggcctgttgtggggtgggggaaggggggagggatagcattaggagattcacctaatgttaaatgatgagttaatgggtgcagcacaccaacatggcacatgtatacatatgtaacaaacctgcacgttgtgcacatgtaccctaaaacttaaagtgtaataaaaaataataataataa

SEQ ID NO: 31835 - DNA, 601 bp, Human
ttttcacttgacaaagaaaaagttacgtgtgaatggtgctgcgttatgcacagtctatgcttataaaacaattttaaacaaattattatctttacctgaaggtggtggaatcatatatcctgcatgcccctgactcaccacatttcaaagttccccagtgtaaacatgtggaatccattaaagcgccaaaatatataggtgcaggaatgccagctacaattgacagggaaagaaaaatctatcaacaagaattaagatacttgatttatttggaaatatttcaattttctttatttgtackgcaaagtttatcaaaacataaatctaatggtctaaattttatttttagaaatgatgagttacttttactgtaaagtttctaaattattaaaagataagtaatcttatggtcaaatgcaacataattattagtagagtaaaacattgaattaaagattctgaactttatatattttcttaaatgttttgggccagttatatgtacattttatttgggcagagcattttctttcattttattttcaaatcttcaaacaaagaatagtgtaattaaggtcagacagggccttttcaagtaaaa

SEQ ID NO: 31836 - DNA, 601 bp, Human
ggcataggtgctcgtattttggttaacaattatccatgtattcatgtagaaatagatatagatgtattatagattcatacagattatatatgtttatacagaatatacatttatctgtatattcaattactcttgtacaatttgaagttgaaatattctatattatcactcatttttgtctgtatttaatattcatttgtgggacaagtatattgaaattttccattctgtagatttattcttataattttataaatttttgttttgtatatttgaggttatgttgatagatttacatagsttcataatttttctatatttttatagtgttttccttttattattaagtaatatctctggttaaccctattaattttttccctttaacttacttatattttgttgaaatcattaatataactacagaagttgatttagtatgtgtctggtagatcttttcaaaaccttatcttcaatcattttatatttttgatctatctatctcttacaaacaacatttagttcaaattttgaaaagtccaatataaaaattactatcttttaaccagcaagtttaaccaatttgcaaaaccacttaggc

SEQ ID NO: 31837 - DNA, 601 bp, Human
taaaaatatattgtttcaattattcttatttgagataggaaatatatcaatatgtaaatttttgagtcatttatcaggtcgttctatgtcatttgtacatatttcattgttctttttctaaattctgagttcattaattttcagccttttatgtgtaaatgtatatatgtatatatttttatacatattatgttttaaatgtataaatatatacatctttatatacatatgtgtatataaacatatatacctatgtgtatataaacatatatacctatgtgtatatacatgtgaatatatrttgcatatgtatatttacatatgtaatatagctatacatatgtaaatatacatttatatacatatgtaaataaatatgtatatatgtacttatatgtatatattatatacatatttatatacatatatttgtacatatgcaaatatatacatatgtgtatatatatttatacatttaaagctctaaaaatccctttgattactggttggcttagcttcatcccacaagttttcttattcagtgctttcattgacatacagttctaattatttatgtttactataatttattcttttaacc

SEQ ID NO: 31838 - DNA, 601 bp, Human
tacaaaaacatagctctttactttcttattccctctatggtatatagtctatttattaatttcttcatctatttttatctttctacttctaaaattttcttttattatgaaacagtactaggattcagaaaaaaatggacaccagtgattggatttaagcctatggtaatccagtataaccacatttaacttaactactctacttgtaaatgctctatttgcaaataaggtcacattgtgaagttctgagtgaatatcacattttgaggaacactaaatcctgtaaaaggtgttttacctyattaattggattaaagcattgaatctgaatttagtcgcttgacttagaagtaccttattcttccttggaagctgatatcagaaaccactgctcattttgagacatagagcctgtgaattcagctttgtttactcctttatgtttctgtttaatttctgaaaaaccagatgtttaggatgatatttatattgtcttttaatcaagaaaagtcccttttgaattttaaaaatatattgtttcaattattcttatttgagataggaaatatatcaatatgtaaatttttgagtcatttatcag

SEQ ID NO: 31839 - DNA, 601 bp, Human
atctaaaatccctatgtaagtgttataatatctgtacttatattagctttttcatccttaatgatgttttatttgtgcctcctctctttatttgcctttccacagtattgttattagtaatatctttgcacctttacaaaaacatagctctttactttcttattccctctatggtatatagtctatttattaatttcttcatctatttttatctttctacttctaaaattttcttttattatgaaacagtactaggattcagaaaaaaatggacaccagtgattggatttaagcctatggyaatccagtataaccacatttaacttaactactctacttgtaaatgctctatttgcaaataaggtcacattgtgaagttctgagtgaatatcacattttgaggaacactaaatcctgtaaaaggtgttttacctcattaattggattaaagcattgaatctgaatttagtcgcttgacttagaagtaccttattcttccttggaagctgatatcagaaaccactgctcattttgagacatagagcctgtgaattcagctttgtttactcctttatgtttctgtttaatttctgaaaaacca

SEQ ID NO: 31840 - DNA, 601 bp, Human
tataattaattgtctagaaaaatatctatttaatatgtttctaaattgttatatctaaaatccctatgtaagtgttataatatctgtacttatattagctttttcatccttaatgatgttttatttgtgcctcctctctttatttgcctttccacagtattgttattagtaatatctttgcacctttacaaaaacatagctctttactttcttattccctctatggtatatagtctatttattaatttcttcatctatttttatctttctacttctaaaattttcttttattatgaaacaktactaggattcagaaaaaaatggacaccagtgattggatttaagcctatggtaatccagtataaccacatttaacttaactactctacttgtaaatgctctatttgcaaataaggtcacattgtgaagttctgagtgaatatcacattttgaggaacactaaatcctgtaaaaggtgttttacctcattaattggattaaagcattgaatctgaatttagtcgcttgacttagaagtaccttattcttccttggaagctgatatcagaaaccactgctcattttgagacatagagcctgt

SEQ ID NO: 31841 - DNA, 601 bp, Human
aggagtcatgcctagaatgaataagaagagttaaagaacgattcctaaatagaataagaagatgtaggcttctctcacatggaagcgataaacttgaataaaatatttaaatcttcacataacagaatgagaatttaggcatctgaataattccaatatcaaagaacaaatttagtggaattaaataggttttcataacagaaaatttttagaagtattagtagaaggagatgtaggaagtacacccttacttcgatgaattaagggaaattgctgtttcaacataaaaataaagctggckctaagaatcttctttagggggctgttattgatgtccctcctaggaaaactcaagtgtcactgataccttagaaatatcattagtgaacattttattattttgagttaagaggttttttaggttcttaaagacaagaaaaagttatctattatatctctactgatttttaaaacaattaagttgtacagcatgttctctaattctgaaaaaagtaatataataggacaattacaatttagttttcaattcatcatctttcaaaaccgtggacttttggtatatatctttgcactcattttc

SEQ ID NO: 31842 - DNA, 601 bp, Human
agccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtkgtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggt

SEQ ID NO: 31843 - DNA, 601 bp, Human
atctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttkttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtc

SEQ ID NO: 31844 - DNA, 601 bp, Human
ctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctc

SEQ ID NO: 31845 - DNA, 601 bp, Human
ccatagcggatgtcaagcggcaggccgcagaggatgctttcctcgtcatcaatgagcaagaggagtccacggaggtcagagctctgcgccctgggggctggggtgagcagctggagtgaccacgcccgctgccttcctctcatacgctgggcaggaagacacaggcagtccactcttgagctcaatgaggataatttttatccagtgccaggagagttttggttctcatgctaagactcttttacatgccaagatagtgaattattacattgtatttttacatacatacatatatatatakagagagagagagaggctcagtgtattggtgtaaattttgagaattcaccctaaagacagagtttgtgtgattgcacgatgatgatgatgaccagcattgacggagtgggcttactgtgtgccagacacccagcaaagttgtatattttctttttgagtctcacaatggccctaatttgcagatgaggagactgtggctcagggaatgcaactaatatacccctttggtgctgaagtcaggatacaggagtaagaaagtgcagggtcctatagcacctaggctttttttttttgagacgga

SEQ ID NO: 31846 - DNA, 601 bp, Human
aaccatagcggatgtcaagcggcaggccgcagaggatgctttcctcgtcatcaatgagcaagaggagtccacggaggtcagagctctgcgccctgggggctggggtgagcagctggagtgaccacgcccgctgccttcctctcatacgctgggcaggaagacacaggcagtccactcttgagctcaatgaggataatttttatccagtgccaggagagttttggttctcatgctaagactcttttacatgccaagatagtgaattattacattgtatttttacatacatacatatatatakagagagagagagagaggctcagtgtattggtgtaaattttgagaattcaccctaaagacagagtttgtgtgattgcacgatgatgatgatgaccagcattgacggagtgggcttactgtgtgccagacacccagcaaagttgtatattttctttttgagtctcacaatggccctaatttgcagatgaggagactgtggctcagggaatgcaactaatatacccctttggtgctgaagtcaggatacaggagtaagaaagtgcagggtcctatagcacctaggctttttttttttgagacg

SEQ ID NO: 31847 - DNA, 601 bp, Human
tcttgacttcaggtgatccacccgccttggcctcccaaagtgctaggattaggattacaggcatgagcctgtaatgtgcccagccacaagatctcttttaaactagtgagtttgattatttgggagatacctttggttaactatggttaagagcccaactttggtgttgggccagctaggtttgagtccttgctctgctacagtgccatctgtgaccttagacgacctccagtaagatagctagccaaaccgagatgattattaattcatgcttaagctgaggggataaaatgtacctaasagcattgttacactggctcaataagaggcatctgataagagacttatgaaaagttcttggcctctggggtgaagattttcttaaggccagagccataagatggaaagttgtttcatggtagcctagaactctgtgtttgaacctcccttgagcctgtgccatgtgcaagaggtaaaccgtgagggagtgtccttaggcttctggattgtctagtcctgtggacttacgtagggagctacgtattttgggacttcacattcacattctcattgggctgaggctcaaacatatggaatgtgt

SEQ ID NO: 31848 - DNA, 601 bp, Human
caataatgtagcattgttaatatctctggtgagaaaaagagaacaacattagaaatctacccaacttatatatccaaatcatgaatttcaaaaagaatgagcagaacaagtagagaggatagaatagttattgaaataattccaaaaaattaccaagacctgcaagacagttccaggttgaatcagtctaccaagtagacaacacaggaaaataaatagacttagtcgtttagcatcattgaaagttagaagacaattctgaaggaaaattattttaatttagaattctatacttaaccaraacaattaagtgttagattagtaacctacaatttttcaaaaaatgcacctcctgcctaccctttctccacagtatctactgtaggatatgcctcaatatgtgaaagtaaaccagaaaatgggagacactgaattcctgaaagaggatccaacacaagaaaggaaggaaaggaatccctaggctggtgaaggagagccccaagcattagtggcaaagcaggcctagaaagcgcccagtccacgctggaacagcccagaaccttgctagagatttccttaagtaaatgaaatttataaaaga

SEQ ID NO: 31849 - DNA, 601 bp, Human
ctgtggtggctgacgccagtaatcccagcactttgagaggcagaggctggcaaatcgcttaaactcaggagttcaagaccagcctgggcaacatggtgaaaccctgtctctacaaaaaatatgaaaattagctgattgtggtggtatgtgcctatagtccggctacttgggaagctgaggtaggaggatggcttgagcccaggaggcagaacttgcagtgagctgagttcgtgccaatgcactccacctgggcaacagagcaagaccctatgtccaaaaaaaaaaaaaaaaaaaaaaaaargaatctgaatatatgtgtttaatgagttcaataagcaggcaagtttgggaaaactgcctctagttaagtccatagcagatggacctcattcagtgtcacagggcttccaggcaactttttagtgacatgtgtgcacaattaagggtgaccactctctagaggtaagcctctaatattggagactgaaataaacagaaatgggaattaatagtagctcttcagggaaaagaaaactaccaataatgtagcattgttaatatctctggtgagaaaaagagaacaacattagaaatctaccca

SEQ ID NO: 31850 - DNA, 601 bp, Human
ttgggttagctgggtgcagtgtctcacgcctgtaatccccgcactttgggaggctgaacgaggtggatcacgtgaagccaggagttcgagaccagcctggccaacatgtcaaaacactgtctctactaaaaacaaaaaaagttagccaggcatggtagcacatgcctgtactcccacctacttgggaggctgaggcacgagaatcactcaaacctgggaggcggaggttgtggtaagccgagatcacacactgcactccagcctgagcaacacagtgagactctgtcgcaaaaaaaaaaataaataaataaataaataaaagtcttgggttatgcagaaatccatggtgtggatagttattgaagtaaagtggtttggtgatttggagagaaattgactagaggctttagatggcattattacttttcccatttaaattaatgcaatgtaggtttccttacctgaaaatttatgattcacaatgttttcacaaatagattttgttcagacagcaagcagtgtatttaggtgtcattaaaggatgcataaataagtgcaaaaaccataaggaaaagaagaaaatgcttatcacagagatcag

SEQ ID NO: 31851 - DNA, 601 bp, Human
tacatgaggtgcctggcccttgaagacaattcagctcatgcctcatgtcacacctttccttagaggcttcctgtttatgccagcatgtagcaaaatacctaatacatagtaggttctcaggaaatgtctgcatgaacacttgttgacaggatcagatacgcacttctgcttcttctacaggagagaagagaatagttttgatagagacacaattgctcctgagcctcctgccaagagagtatgtaccatcagccctgctcctcggcacagtcctgctctcactgtgcccctcatgaatccygggggccaattccatcctacccctccacctcttcagcattacaccttagaggatattgcaacttctcacctgtatcgggaacccaacaagatgctagagcatcgagaagttcgtgatagacaccacagtcttggtaagcaaccgaagcagcatggtaaattcagactggattcttggatttctttccaactcaatgataaagtcaaataatatgattgctttttcccactgattggataaaacaatattatacatagactattagaatcatagttgatcttatttgatatcaatctcatt

SEQ ID NO: 31852 - DNA, 601 bp, Human
agagttttatatagtcaaattccttattcttaactctgttattttggaaaacagcatgaggtaggttgttatggcagctttttggctagcatttggggttttgtcaatttatttctgctttaaaacagtcactaattatggtgcctgctaaattaaccctcagtgaagggatggctacttgcatgtattaaaactctcctttcacttgctcatctgtcccttgggattaagcctttgcttatgagcccagcctgcattgcttttaaatttggtgagaaaaatataatttctactttatgtkttttttaataaaaatgggaaaagtaaattctgtatatgaaagagatcgagttctgagcttttaaagatgtatagggttttaaaatgtgatttgttcctattgcaggttttctaagtatgagagacagaaaaatacctacttaatgaattatctttttacattttacatcactcccagtgctccttttcaaactcccatgtttcagaataatcacagtttccagaattctgttgcagcttttatacagagctggaaggaaggttgagtagtgctatcagagatgagttggggtccagaaga

SEQ ID NO: 31853 - DNA, 601 bp, Human
agtgttcaaacattttcctttaatatgtttaaattggacataccccttttccctgaaggaaaatgtcttaatgtttaccgaataataaatatgatatatttggaaaatccaacataattgcacactcagaaataactgttattgtgattattctcccaggcattaaatatatgatataatatgcatgtgtgttatttttgtaagtggattcttagaaaatataatgttctgtttctggtttttcacttaacagtattgtaggtaccttttctgccttaatgcgtacaaatctgctctaccscctccctgcataagcattctgatacatgactcttgtaattttaatgtagctttctgttggtagatctatatattttcctttttttttttttttgttaggaaaatatattgtgatagcgtgggggtaagttgcatgttacatactatgtttttgaacacttacaaagtttctaaaagtaaattcctagaaatgttatagctctttctggggagcaagcagggattcagaataatccccatatttcattttgttcgtttgttttaatttgttatcatacagtgttatcggcaattgaaatac

SEQ ID NO: 31854 - DNA, 601 bp, Human
gtacatgtgtacctccatcatactgtaatgaatagcttagttgcctcttttcccactagactatgagatctttgaggggaagaaacaaacaattatgctcttaatataaaataaggttttataaactagctgaaggaggaaggtgtttatccctctcatacaggactgccctatatccactatgtatgtaaacctgagtccatttctctggcctaactcactatttccctgtgtcacacaatccatcctttccccttgtctacccacaagtatacttaaaatcattcatgtagcccttccrtacatttaatctatttgtgtttgcttttcaagacctgattgcttcccttgcagtagatataaaagagtgtcattctcttacacttagtttttattcctgattaccagaattacaggtttcttttgctgtattgtgcaaatgtcatatacttaaaacagatataacgttaactttaaaagaatttttttggtatgaaatgtgggaaagtgttcaaacattttcctttaatatgtttaaattggacataccccttttccctgaaggaaaatgtcttaatgtttaccgaataataaatatgat

SEQ ID NO: 31855 - DNA, 601 bp, Human
tgaacataattggaaacaaagcagacatcaaaatgttatgttgattccagcagcaaattaagtattatctattcttaaaaataatttcaagactaaaagtaaaaatgtcaaaaattcatttgcggcgggcggatcatgaggtcaggagatcgagatcatcctggctcacacagtgaaaccccatctctactaaaaatacaaaaaattagccgggcgtggagcttgcagtgagccaagatcgtgccactgcactccagcctgggcaacagagcaagactccgtctcaaaaaaaaaaaaaaaattcatttgtaaaaaatttgaatctttttttagttatgaaaagtatatgtaggtgtgtccaattatttcttttaaatggccacatttgggttaccttttttttccatagtaaaatatacattatagaatataccattttaacctcttttaagtagacagttcagtggtcttaagtacattcatattgtttgtgctgttcaccatgtgtccctgtttgccattgtgtatttagagcctatgagcaccacagggttaaggaatttatacaattgctttttttgaattgtgatgaaatttacta

SEQ ID NO: 31856 - DNA, 601 bp, Human
cggcttcccaaagtgctgggattataagcatgatgtttaattgtagattttatgtcagtgcttatcaaagaaacaatcgataatgtttacttgttatttaaggtggtgatttaattccaataagcaactttggattttttttaaaactgctctcaacaggcccactggtgtccaaccaagttaatgcaaggttttgtaatttaatatattcagtgcttagtgcattgtttccaaaccaaggagagtagagaggtagcaagtttaattttcaaaacaatgatttctaaaattacaagttacrtggcctaaataaatactatcaaaataaacagtatcaaagggattgcattgttcagctcctcgtgcatataaacttgcttaagaatttgcaaggtacacataatttttctttctttctatactgcacgtggtgaacctgtggcataaaggagtgattttctgacttcgacacctgggtggggttttattctcagtgtttataagggaagtactgccagttcccaatgtttctaattgaatttacctccaataaaagcattctgtgctcctttgtgtatgttaacccctttatatgggataa

SEQ ID NO: 31857 - DNA, 601 bp, Human
gggcttggacaggatttttcccaagccgggagagctggcagatcagagagggactttccagataaatcccatctggggaaacgttactatcttccacaagcaatttttctaaaaatgcaaatgctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaacgatgcaaacagacacggagggttgattcttcttcagggaaatggctggccactcccttgatttgggagaaactaaactggccttctcgttcccagtcccagaacctccacccctttcgaattcttcccaacgggctgaccctgcccggcgcccaggagcgccctgggtatctcctggctgctctcccgaatccttgcgcgccgcgcccctaccaggttcactgggtgcacgtagccgttctcatagcggtcctcctgcaacagctgccgcaggtgagcgat

SEQ ID NO: 31858 - DNA, 601 bp, Human
taaatcaaaaagaacgtgagatattagagagaaacgattgtctcaaaccgaaaccgctctcctacgcgaaccccagatattcctgacttggagtagctaagattttatcagcattctgggaatttgcatgtcctctctctgaactaagattttcattttactggaggttgataatccgagacttgccatatccgttcacgcttcttcctggactttgcccgcaggataatttggtgaaactcatctgactttgaggttctgtcgtttagttcccttccccaaacacacacacacacacacrcacacacacacacacacacacacacacacacacacagtcatccactccaagctccaagtaggaactgggcttggacaggatttttcccaagccgggagagctggcagatcagagagggactttccagataaatcccatctggggaaacgttactatcttccacaagcaatttttctaaaaatgcaaatgctcttttatagagctcggccttccctcctttaagaaagggcttgccgattcaaacctgcccgactcagctggattaagttgggcaagggagatttgccgtcagtctgcaac

SEQ ID NO: 31859 - DNA, 601 bp, Human
cccgccacctgtcacgatcacagttccagggaaaggggaagggtcaaggagaatccagcggaaacttcttcccatctcacgagctctcccttctctccgtggcccccaaacactcgcatttaacgaataatcccatcaagtgagttccagtccgatttaagcggtggttccacatagtctgttggctgcggaaacttctttggtgtcagagtccggtcttcccgagaccacgaatggccatgtctgtaaatcaaaaagaacgtgagatattagagagaaacgattgtctcaaaccgaaacmgctctcctacgcgaaccccagatattcctgacttggagtagctaagattttatcagcattctgggaatttgcatgtcctctctctgaactaagattttcattttactggaggttgataatccgagacttgccatatccgttcacgcttcttcctggactttgcccgcaggataatttggtgaaactcatctgactttgaggttctgtcgtttagttcccttccccaaacacacacacacacacacacacacacacacacacacacacacacacacacacacagtcatccactccaagctc

SEQ ID NO: 31860 - DNA, 601 bp, Human
ggatgtagagcgcgttctaaccgttccctaaccattgtgtcaccgcgaaaggccggggctgtgtggaaccgtcccgcacgtgtgcgatgaatctggctccgctgagaacggatccgtgggctgtctggcgcgggctggggcagcagccgagagttagtctacagagctagggcccgagggtggacctgcgtccgcgtctcgtcacgaaaggaagctctttttggagaggcaaaacgtggtcgcccagatccggcgcagctgtagccgtgggcgctgtgcagtgacagccacacccgccacytgtcacgatcacagttccagggaaaggggaagggtcaaggagaatccagcggaaacttcttcccatctcacgagctctcccttctctccgtggcccccaaacactcgcatttaacgaataatcccatcaagtgagttccagtccgatttaagcggtggttccacatagtctgttggctgcggaaacttctttggtgtcagagtccggtcttcccgagaccacgaatggccatgtctgtaaatcaaaaagaacgtgagatattagagagaaacgattgtctcaaaccgaaaccgctctcct

SEQ ID NO: 31861 - DNA, 601 bp, Human
ggcgctgtgctggagtacgaacccggcccagagaagccactcgcccttctttgtcacttaaaaccctgtcccgacgcggatctcacgtctagacctctgtctttaaagcggatgtagagcgcgttctaaccgttccctaaccattgtgtcaccgcgaaaggccggggctgtgtggaaccgtcccgcacgtgtgcgatgaatctggctccgctgagaacggatccgtgggctgtctggcgcgggctggggcagcagccgagagttagtctacagagctagggcccgagggtggacctgcgtscgcgtctcgtcacgaaaggaagctctttttggagaggcaaaacgtggtcgcccagatccggcgcagctgtagccgtgggcgctgtgcagtgacagccacacccgccacctgtcacgatcacagttccagggaaaggggaagggtcaaggagaatccagcggaaacttcttcccatctcacgagctctcccttctctccgtggcccccaaacactcgcatttaacgaataatcccatcaagtgagttccagtccgatttaagcggtggttccacatagtctgttggctgcggaaacttctt

SEQ ID NO: 31862 - DNA, 601 bp, Human
ctgggggtgctgcaggtaggagcaggagcggggcggagagggaggcccgaagaagaccccacacaggttggcgcagcggggcttggggaggcttcagcccagaagtggagagggttgacagacgcctgcctgattagaaaaagccgggagcttgggaaggagacgggattgaagaagccacccggcagggaggccgaacggcccagagctctccgggtaaaacccgcctgcggtgatctgggaagtgtgtctccacctagccctgcgagcagcggccttcctcccgcccgttagaagggckctgtgctggagtacgaacccggcccagagaagccactcgcccttctttgtcacttaaaaccctgtcccgacgcggatctcacgtctagacctctgtctttaaagcggatgtagagcgcgttctaaccgttccctaaccattgtgtcaccgcgaaaggccggggctgtgtggaaccgtcccgcacgtgtgcgatgaatctggctccgctgagaacggatccgtgggctgtctggcgcgggctggggcagcagccgagagttagtctacagagctagggcccgagggtggacctgcgtccgc

SEQ ID NO: 31863 - DNA, 601 bp, Human
cagctttcataccaatgctagcacaacacaaaagcaaacaaagatgtcaggtattaaaaaaaaaatttttcagaattttatagggagaaaaagtcctccatcagaaaaaaagcttattttttaaaatgatgtcaactcagtctgttctactccagtgtcaacccactagtgtctagctcatgcttcttactctcaccgcatcaagactcttacaagtgaaatgtgtgattcactttgagcaccctgtgtatactactgaggttcccctttcatgacactatggtttaagaaaagaccatcwgaggtttctaatgtctcagaaatcttcatcttccttgtgctcagctaactttaatggagaagagagagaacccagagaagaagactgttactagaagaggattgctctcaaaatttgatcaaacactacaaagatgcattttgtgatgctttcaaaatctggtccctgaatacctgctactttaaaaaaatatttcatcgtaaagtattaattttgcctctaattaagttcttccgtcccttctttatcatccaaactttgctcttttctcggcaaagcaactcaacctctcactcttct

SEQ ID NO: 31864 - DNA, 601 bp, Human
aggttttcagagtaaagaattaaaaatcatttttccccagaggactctgttctttgggtcataacatccttccatgcagttaaatgctaaaatagctagagaatgcttcagaagctcattctatctctggccctcatagaggcctaggaacccgatataattaaaatttaagacatgttctttatgttcgtctcattcctgtttcacatctagaagaacgaacctcagaacaatccagctttcataccaatgctagcacaacacaaaagcaaacaaagatgtcaggtattaaaaaaaaaawttttcagaattttatagggagaaaaagtcctccatcagaaaaaaagcttattttttaaaatgatgtcaactcagtctgttctactccagtgtcaacccactagtgtctagctcatgcttcttactctcaccgcatcaagactcttacaagtgaaatgtgtgattcactttgagcaccctgtgtatactactgaggttcccctttcatgacactatggtttaagaaaagaccatcagaggtttctaatgtctcagaaatcttcatcttccttgtgctcagctaactttaatggagaagaga

SEQ ID NO: 31865 - DNA, 601 bp, Human
aatcagccttgggtactactgtcaaggcagcagtggcggcaggctgcagtggggtcattaggcaggtgcgagaaagagaagctcaattagcccatacagtgcccaccctactcccttttctcaggccaaatgagaccacttttctaccttctttcacttctgacatttgcattaaaactaagtggtgtatttaggcagccaagccacactctcatctgtgttaaaacaacaacaaaccacccaaaaaaggggaaggagtattctccccttgagcaatatccccctcccgggcaaagtgtcrtattattggtccccaaggaagaggaacagttaaccagctgtgaactttcaggatgggtggaaaagagcattttcaatgacccgacttccccaccttcccacacacatttgggtaaatacatctccacattgcactcccgtcttcattttctctgactacagtctccactgtagtctaaatccttgctgcttttccacccagtcctcacaatacaaagccaagacaaaaccacaacacatgcacacagacagctcatcagaagcaggtacagtatagatagaactgggcttacagacagga

SEQ ID NO: 31866 - DNA, 601 bp, Human
gcaagtttctgcacacatttttattcctaactagcagcacggcagcagccacgcgtacattacttcagaatcagccttgggtactactgtcaaggcagcagtggcggcaggctgcagtggggtcattaggcaggtgcgagaaagagaagctcaattagcccatacagtgcccaccctactcccttttctcaggccaaatgagaccacttttctaccttctttcacttctgacatttgcattaaaactaagtggtgtatttaggcagccaagccacactctcatctgtgttaaaacaacaamaaaccacccaaaaaaggggaaggagtattctccccttgagcaatatccccctcccgggcaaagtgtcgtattattggtccccaaggaagaggaacagttaaccagctgtgaactttcaggatgggtggaaaagagcattttcaatgacccgacttccccaccttcccacacacatttgggtaaatacatctccacattgcactcccgtcttcattttctctgactacagtctccactgtagtctaaatccttgctgcttttccacccagtcctcacaatacaaagccaagacaaaaccac

SEQ ID NO: 31867 - DNA, 601 bp, Human
atacccaacaaggatgagttctctcaacacacattagaatttcccagaaatgagataccaaaaggccatgtctcttagggtgccacttggagatagaagcccctaacattcgccctataccatgaggcttgtgacacaacaaacaggatccctagggaagtcaaagaagggtgcaagtttctgcacacatttttattcctaactagcagcacggcagcagccacgcgtacattacttcagaatcagccttgggtactactgtcaaggcagcagtggcggcaggctgcagtggggtcattargcaggtgcgagaaagagaagctcaattagcccatacagtgcccaccctactcccttttctcaggccaaatgagaccacttttctaccttctttcacttctgacatttgcattaaaactaagtggtgtatttaggcagccaagccacactctcatctgtgttaaaacaacaacaaaccacccaaaaaaggggaaggagtattctccccttgagcaatatccccctcccgggcaaagtgtcgtattattggtccccaaggaagaggaacagttaaccagctgtgaactttcaggatgggtgg

SEQ ID NO: 31868 - DNA, 601 bp, Human
agcaaaagtgctcatgatattgatgaatccataagtagctgtatctagaattcatacttaagaaaaacacacaggcatgaataaaataggacacagtaatgagaatgggcagttctgcagtgtacactttctcaagcacctcagaggacacacacttaaagtacaattcttcacagacacatgaagcagaacatttgaaaatcaaaacttaaatacaagattctaaaagtgaatggcaatttaatggttaaaatttgaccagtggtgaaacaagcagcaagctacaaaatccatcaccacyaacagtttcaatgttagcactaagtattaaaccaaagtaatgcatattctggttttgcttcttcaagaacagcccgtttattctgtttcaatctctctgaacaatactggtaggtaatagttacactgacaattctcacaaaaaaacagtgttggttcttgccatcactgaatttatagtataaatctcccaaggctttaatctagttcatcagtgcagtttagataagaaagccataaaaacaaatgggcatactgtcagttaatgagaaatacaactgcacatgcacaattaatatta

SEQ ID NO: 31869 - DNA, 601 bp, Human
atacaacacaaaactcccaaatataaggctctcaaacatgtatttttacttcttaaaaaatttattaaatgccattgatttgactggaaccagcaaaagtgctcatgatattgatgaatccataagtagctgtatctagaattcatacttaagaaaaacacacaggcatgaataaaataggacacagtaatgagaatgggcagttctgcagtgtacactttctcaagcacctcagaggacacacacttaaagtacaattcttcacagacacatgaagcagaacatttgaaaatcaaaactcaaatacaagattctaaaagtgaatggcaatttaatggttaaaatttgaccagtggtgaaacaagcagcaagctacaaaatccatcaccaccaacagtttcaatgttagcactaagtattaaaccaaagtaatgcatattctggttttgcttcttcaagaacagcccgtttattctgtttcaatctctctgaacaatactggtaggtaatagttacactgacaattctcacaaaaaaacagtgttggttcttgccatcactgaatttatagtataaatctcccaaggctttaatctagttc

SEQ ID NO: 31870 - DNA, 601 bp, Human
tgggttctgtgtggaattaagggaaagaatctagcactgtaaggaaaaaaaaaatacaacacaaaactcccaaatataaggctctcaaacatgtatttttacttcttaaaaaatttattaaatgccattgatttgactggaaccagcaaaagtgctcatgatattgatgaatccataagtagctgtatctagaattcatacttaagaaaaacacacaggcatgaataaaataggacacagtaatgagaatgggcagttctgcagtgtacactttctcaagcacctcagaggacacacacttaaagtacaattcttcacagacacatgaagcagaacatttgaaaatcaaaacttaaatacaagattctaaaagtgaatggcaatttaatggttaaaatttgaccagtggtgaaacaagcagcaagctacaaaatccatcaccaccaacagtttcaatgttagcactaagtattaaaccaaagtaatgcatattctggttttgcttcttcaagaacagcccgtttattctgtttcaatctctctgaacaatactggtaggtaatagttacactgacaattctcacaaaaaaacagtgttggt

SEQ ID NO: 31871 - DNA, 601 bp, Human
ctcggtcgcgcggagggaattgagcgacggttttggaacggtggtggcggctcggctactgctcgtggaggggaatacaggttgtcaatttatacgctattaatgccgccgtggcccagtcttaaccgagtcaggcagagctagtttgacggtggagtggagtgaggttgaacagcaggtttggcgtttggtgggtctggtatctagcggcggtctgttagccttttaggggggattcacggacacctctagcgccctgtagggttgccatggtgacggagcgcttaagggactggcaacsgggattcccagagaagggtaaagggatcactctcccgtgtgtgcaggttcctaatgcccagggcatgtcattaaatcttttgctttctttgggtgggtgggttgtgtgtggtgtttgttggtgcagggattgttttttcctaacattaaaagtttgattcagggcaggagggtagagctaaggttcctagttcagctctgcgatgtaaacaatgagattcccatatgatgttttaattcttaggtggtaggaaagactgatcggaggagcaccagagggactgtaaatgaaccactgtta

SEQ ID NO: 31872 - DNA, 601 bp, Human
gtggaggggaatacaggttgtcaatttatacgctattaatgccgccgtggcccagtcttaaccgagtcaggcagagctagtttgacggtggagtggagtgaggttgaacagcaggtttggcgtttggtgggtctggtatctagcggcggtctgttagccttttaggggggattcacggacacctctagcgccctgtagggttgccatggtgacggagcgcttaagggactggcaacggggattcccagagaagggtaaagggatcactctcccgtgtgtgcaggttcctaatgcccagggyatgtcattaaatcttttgctttctttgggtgggtgggttgtgtgtggtgtttgttggtgcagggattgttttttcctaacattaaaagtttgattcagggcaggagggtagagctaaggttcctagttcagctctgcgatgtaaacaatgagattcccatatgatgttttaattcttaggtggtaggaaagactgatcggaggagcaccagagggactgtaaatgaaccactgttagcgtttggtgtccggagttggtgctacagggggaactggtagtggaatcgtgttgtgtagtggg

SEQ ID NO: 31873 - DNA, 601 bp, Human
tttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggtgagtagagacattggagccggggaggtgtgggatgagcaagaatgcgtgtgaatgggggtggtctgcctagtgtagatgctgcggcccctarggagttcccatttctcccctgtagggcagttagctaccagatttctgggtatcttggtcctttgtgattgatccgaccgcttgctgtaactatcttggcatctttccttgtgccctccatgtgtccttccttaacttttgtgccctggctccattttacagattcccacctcgggttgggagaggaccacggtggccaaaattcttagcttcttcctttccctcatgcagcccatggatagccagccccagaggtaatgtcacaggatgggaagtttccagagtgggtgggaggtgggtg

SEQ ID NO: 31874 - DNA, 601 bp, Human
cttccttaacttttgtgccctggctccattttacagattcccacctcgggttgggagaggaccacggtggccaaaattcttagcttcttcctttccctcatgcagcccatggatagccagccccagaggtaatgtcacaggatgggaagtttccagagtgggtgggaggtgggtggttagagaaaggcagcaggggcctccctgtggatgtcaagaatcttttttatttatttatttattttgtcccacagtttaattggggccgcagtttaagtaactgttcctttgatgcatagggggkgtgtgtgtgtgtgtgtgtgtgtgtgagagtcggggatcggtagtctccctataagcatttatttttctgtggttctgacctaacatttctttatttaggattatcacaaaattataaaacagcctatggacatgggtactattaagaggagacttgaaaacaattattattgggctgcttcagagtgtatgcaagattttaataccatgttcaccaactgttacatttacaacaaggtgagtttttctgtgtgttcatttagtaggtggggagaaacagtaacttctattattgctggat

SEQ ID NO: 31875 - DNA, 601 bp, Human
cctttccctcatgcagcccatggatagccagccccagaggtaatgtcacaggatgggaagtttccagagtgggtgggaggtgggtggttagagaaaggcagcaggggcctccctgtggatgtcaagaatcttttttatttatttatttattttgtcccacagtttaattggggccgcagtttaagtaactgttcctttgatgcatagggggtgtgtgtgtgtgtgtgtgtgtgtgtgagagtcggggatcggtagtctccctataagcatttatttttctgtggttctgacctaacatttytttatttaggattatcacaaaattataaaacagcctatggacatgggtactattaagaggagacttgaaaacaattattattgggctgcttcagagtgtatgcaagattttaataccatgttcaccaactgttacatttacaacaaggtgagtttttctgtgtgttcatttagtaggtggggagaaacagtaacttctattattgctggatatgttgtctacataaagtttaaatcctttgctactgaaggtgttatccaggtagggtagtcggagtcttaaaaacctgactctagatgg

SEQ ID NO: 31876 - DNA, 601 bp, Human
caccccatggacctcagcactgtcaaggtacccactgcatggggcagatgggatgctcaggcagtgatgggagcctaggtgcaaaacaataagtctccttatgtgggcacacagcagtctttggttcttggcattttacttttataaaataatagtggaacagaaggtctggtgttttgagaatttgtatttcttggagtttgaaacagtagggtggggtttctttgtcttgagaaaaatactgtctataattaagtactaatgtggcagtgttgggttaaggaagttatagggtggaaaracaggcataggccacctctctgtcacttagaaatgatttctttttctagacataaatatttcttcaacccacccaaattcctttgacttcaaacttgaaccccagggcacagatccttaaggtcatccccactgtgctctcaagagagggctcttcttgtggtgtctggggttggcagggaaaggtgagtcttcctgcctgtgcagcttctgatgctgcctccttctgcagcggaagatggagaaccgtgattaccgggatgcacaggagtttgctgctgatgtacggcttatgttctcc

SEQ ID NO: 31877 - DNA, 601 bp, Human
gaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacaggtattttgtcactcttgaaagtttttattgggtaagaggttcatgccctttgtcctcattttttcttcttgttattttatctttatttactttttcyacttcatgttttttttcctttagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagtgagttagagtag

SEQ ID NO: 31878 - DNA, 601 bp, Human
agactcagaggaagaaagggctcatcgcttagcagaactacaggaacaggtattttgtcactcttgaaagtttttattgggtaagaggttcatgccctttgtcctcattttttcttcttgttattttatctttatttactttttccacttcatgttttttttcctttagcttcgggcagtacatgaacaactggctgctctgtcccagggtccaatatccaagcccaagaggaaaagagagaaaaaagagaaaaagaagaaacggaaggcagagaagcatcgaggccgagctggggccgaygaagatgacaaggggcctagggcaccccgcccacctcaacctaagaagtccaagaaagcaagtggcagtgggggtggcagtgctgctttaggcccttctggctttggaccttctggaggaagtggcaccaagtgagttagagtaggaagcagagactagtttggctatttctgtctctctgggggatgccatctctctttgcaaagataattctaaatggccagttaacagatacaataggctttgagcagtggtccccaacctttttggcaccagggaccagtttcgtggaagacagat

SEQ ID NO: 31879 - DNA, 601 bp, Human
gccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccayagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaa

SEQ ID NO: 31880 - DNA, 601 bp, Human
ttttaaacaggtatataataatctgaaaaatacattatttgacttccaaatccttggtaatagtgatccactatgttctaaaatgtcttaccctataacagtttgcacagttgaatcataatttaaaaaaaaaaacattttggaggtacctagtgtctgagcggcacagacgagatctcgatcgaaggcgagatggcggacgtgctagatcttcacgaggctgggggcgaagatttcgccatggatgaggatggggacgagagcattcacaaactgaaagaaaaagcgaagaaacagaagkgtcgcggctttggctccgaagaggggtcccgagcgcggatgcgtgaggattatgacagcgtggagcaggatggcgatgaacccggaccacaacgctctgttgaaggctggattctctttgtagctggagtccatgaggaagccacctaagaagacatacacgacaaattcgcagaatatggggaaattaaaaacattcacctcaacctcaacaggcgaacaggatatctgaaggggtatactctagttgaatatgaaacatacaaggaagcccaggctgctatggagggactcaatggcc

SEQ ID NO: 31881 - DNA, 601 bp, Human
gcgtgtttttaccgtgcagagggagggatttagagttagcctttgattggtcagcttgactggcgacctttcccctctgcgacagtttcccgaggtacctagtgtctgagcggcacagacgagatctcgatcgaaggcgagatggcggacgtgctagatcttcacgaggctgggggcgaagatttcgccatggatgaggatggggacggtgaggacagtggagacggctggtgggaagcggggaaggtgcgagagaaggctataataggaaaatttactcttttttcctcggtcgtaaggwtgggaatcgaggaaccgggtcttgggtggattagagattccgcccccttcaggagaagggagggcgtgaccgggaaggcactaagactggaggcggtgtgggtcggcttgctggtagtgtattgggaaagagacgattgttacaaatgactgtcatagttacttattcttttatcttctggggttccagagagcattcacaaactgaaagaaaaagcgaagaaacggaagggtcgcggctttggctccggtgagtgtggggaaaatggggtagagtggcctagtagggcaggagctacgg

SEQ ID NO: 31882 - DNA, 601 bp, Human
tttgaagactctaaactgccatacaaatgtgaactaatattgttactttattaagtaatttctttaagagcatatacagctagtgctagaaaggtcgggtattagaactggaatgacctgcccatccagaagtttttttcactgtcccaaattgtattttatttctggtggtgtctgtactgagtattagggaataattggaattaaagaaaaagaggtaatggaattatatattgcataatatataattatatatgagatggacgagacaaatgtatttctttaggaattggtaatgtaygagcaggagctgaaggagtgggctgctggaatgatcttgagccatctttggtgagagaatgcatacttcgaaggaaatgctgatcgaaatcttattttaagatcttggattgatacatacaataatactttagagcaccatttggacacttgaactgcagtgatgataaaagaagtcgataaactgcgaactaattctgttaaagaaaaacaaaaatgttaacctacatattaagactagaatttgggaagtccaatatgaagacctataatttgccagttagttaatccataaggatag

SEQ ID NO: 31883 - DNA, 601 bp, Human
agatactgaaaatatagtatttgctgaagatgctaatctatgagccaagacagttttcacacattgcatttgattcattttgttgtcatgctgcttaaatctctcttaattctttttagagactgtctggctctgtcacccaggctggagtgcagtggtgcaatcatagctcactgcagcctcaaaactcctgggttcaagtgatcctcccatctcagcctcccaagtagctgagactacaggcatgtaccaccatgctcagttacttttatcatttaatttaatataattttttttttttggagatggggtctcactatgttgcccaggttcatgtcttaactcctgtcttcaagcgatccttcctacttggcctcccaaagtgctgggattacaggtgtgagccattgtgcctggtctaaatctctcttaatttaggatgcttccttcttgcttcctcccttccatgatgtaaacttactgaagagtctagtccagttatcttgtagaatatgccatattctggatttatctaagtatttcttcttggtggtatttaacttgatctgtagtcctctatttcttgtatattgaaaattag

SEQ ID NO: 31884 - DNA, 601 bp, Human
ttaaagagatgtgaaagctggaaacattcttcttggagaagatggctcagtacagattgcaggtaatgattagtatttctttttatttgatttaatggtcagtagaaccacattacttatcttttatgtttccttaatcagcattctctcctgttccctggaccatctctattcaagcatcctctgttggcatgtcataggatgccaccgactctcaagatatcttctcatactcatccttcatttctgctcttagacatttttttctgaccattacttgtttccttccagctatccactycttacttccattagggtcttctgctatgggttctcatagcattctgtactttcctttaaaggaaaagtagttgaggatcttcattgtgtttaagaataagtacgttatatagaggctatacagagcttcttctgtcctgggggaaatggagtatttgtcaattaggaaaaagtgcctgagaagtagaagtgcacttttggcagtttcagagctgaagggataagagttgcagtccagggcctaccaaaagtggctatcctgatgaaacaccccctcctccaggctgagactccagaacga

SEQ ID NO: 31885 - DNA, 601 bp, Human
ctgaagatacaaaaattctggatcattattaagttctgggtttaaaattctgaatattttaaagctacttgaaggtttttagtaggttttaaaaagtaaaaactcttcataattcaacctaaaaaatatgttgtatatacataagttgtttgagtctttatcatatttaagtattttaaggcacgactttgtctctctggttagtgataagaatacctagtacttattgagtgtttagtattaaaatatattacagggactgttctaagtatattattaagtcatttaatccttaacaacraccttgttaagtaagtactgttactgcctcctttttacagatgaagaaattgtagcacaaagattgaaaatacctgcccaagttcagctgactagtggcagagctgaatgcactaaatgtactttttccccttcatatgcacttcaaattgtttactttgttattgttgttacaaatggaacattttaaagtttttagatatttcccggtttaggagtattgaaaactgttaagatgatgatgatgatgatgatgatgatgatgatgatgatgatgattttagagaaagcgtcttgctct

SEQ ID NO: 31886 - DNA, 601 bp, Human
taaaatatattacagggactgttctaagtatattattaagtcatttaatccttaacaacgaccttgttaagtaagtactgttactgcctcctttttacagatgaagaaattgtagcacaaagattgaaaatacctgcccaagttcagctgactagtggcagagctgaatgcactaaatgtactttttccccttcatatgcacttcaaattgtttactttgttattgttgttacaaatggaacattttaaagtttttagatatttcccggtttaggagtattgaaaactgttaagatgatgrtgatgatgatgatgatgatgatgatgatgatgatgattttagagaaagcgtcttgctctgtcacccaggccagagtgcagtggtgcaaatgtagttcactgcagcctcaaactcgtaggctcaagcagtcctcctacctcagcctcccaagtagctagggctacaggtgcctgccacaatgcccagctaattttctattttttgtacagatggggtctcactgtgttgcccaggctggtcttgatctcttggcctcaagtggtccttctgcctcagcttcccaaagtgttgggattacag

SEQ ID NO: 31887 - DNA, 601 bp, Human
gagtgagactgtgtctcaaaacgaaaagaaaaaagagaataaaaagaaaaggcataaacctctagtggacaaaaaatgagagaagtgaaagctgcaaccaaattttcaaaactttgatgcccataaattagtggtaaaggacttggcaaatcagcagactataattgctaagccagtattaagaaaagcttgaaagctaccatatacaacagaaccctgaaaggtaagggaattaatagtgccaggtacctccagaaatgagagtgaaagtagggctaaaaacaggaagattggttgacartcttaagatagagttagactctggtccctcccccactccatgctgcactccaggagatgtctggaggtttattctgcagaagggtaaaagaaatggtctctgaactgaaggacaccaggcacagttaaacatgggaataacttactgaaaagggcatttaagtaattgtttacacattgaatgttaagaatctatccatatcacttcattcaactcctggaacataaacattaaggcttattaccccatagacaagacgttgaaaaatccttatttgatcaatctgactagcctaagagg

SEQ ID NO: 31888 - DNA, 601 bp, Human
atagaagaagatatacgcaggtacggaacagggcaaagtgagaaagaatcctgtggcaatgggtttgaattggaggcattggtgtgaattcaagctttgtaaagtatgtgtgtgaatgtgtgtgtgcgtgtatgtatatacgtgtgtctgtacttgcatatatttctcagctttgtccactgaatggcctgaaagcaaagaaaccccaataatgacatgccttgtatccagataatggtctctaataccattccccactaaagggaagcagagctcctttgagaaatggttgattccaggkcttgggcagggaaaatataaggggaatcttgaatattatgttcctttgccagaaggaaaagatacttaaaaaaaaaaaaaacaactcataaggacacaagcgccagctcgaagttactcctactggcaaaatctgggacaatttaaccaccaaaataaagtgcaataattaattttaaacaatttagaaaatagctatctatgagtctataccaataacaaatacatatataaacaaatgggggaaaaggaatggttcttcattgcggtaggctaccaagtgctgaccagtaaatatgga

SEQ ID NO: 31889 - DNA, 601 bp, Human
tggttcttcattgcggtaggctaccaagtgctgaccagtaaatatggacgagtgttggagatggaaaatcatcattttacaatcatcgtcgcaaggataggattaggcaggaatcatcaatgaagctaaatatagggggaagttttgataagcaggatattttcaaggtcttaaagtgtgcccccacatattacctattcaccacaagggaaaaaaataaggtttttttatactggagaagtaggaaaattccttgactaggtgattaaaattaacatcaccaatgaggggcagatgaacrtgggatacagtaagaaggacacgtcagtatgtagaattccaagtgggaattcatgtaaatataataataaggaaacattagataaaccccatgtatgtggtgggagtggagggactgtattctccaaaaatgttgatgttccagattttaaaaatctaagaaacgtgaaaactacctgcaatacatgatcctagactgcattttatactggaggaaaaacaaaaggctacaaaggacattagtgttgacatttacgctataaattagataaaagtattatatcatgttaaatttaatgag

SEQ ID NO: 31890 - DNA, 601 bp, Human
actggagaagtaggaaaattccttgactaggtgattaaaattaacatcaccaatgaggggcagatgaacatgggatacagtaagaaggacacgtcagtatgtagaattccaagtgggaattcatgtaaatataataataaggaaacattagataaaccccatgtatgtggtgggagtggagggactgtattctccaaaaatgttgatgttccagattttaaaaatctaagaaacgtgaaaactacctgcaatacatgatcctagactgcattttatactggaggaaaaacaaaaggctacraaggacattagtgttgacatttacgctataaattagataaaagtattatatcatgttaaatttaatgagaactatagtgtgaagttatataagaaaatatctcattcttaggaaatgtacactctgattattaagtggtaaacagccatgatatatgcaacttattctcaaatggtgtaggaaaaatatatttagaaagagaaagtgagcacccaaatgataaagcagatgaggggaaaaaaggttaataataaatgaattggggtaaagagtatacttacgttcttgtattgttattct

SEQ ID NO: 31891 - DNA, 601 bp, Human
ctttgctggcttgtgcagtgatactgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccagctgataatatttaataatctrgaggagagaataatgatgtaccaataagtggagattcctccttatgatgtatgctaggttatggaagatgtaaaatattcaactttttcctcctttttttggactttgtattttactgcatgttttcttcatttttaatcaataaagagtaaattgtccttagtggtgtatggacgctttattttagtggccgttggcggagagctgtgggttgtgggtcaaggaatcaccaccaactttaattgttcatgcgaatagaagccaaagtacatataaactgtaaagtgtgtctgttgatct

SEQ ID NO: 31892 - DNA, 601 bp, Human
aaaaatatgaaaatctacccttttggcaaatttttatgtgcaaaatacagtgttgctcaagtcaggcaccgcacggcagagcagctgtccaggacttactcatgctgcatgactgtggctttgtaccctttctgcttcctgatggggggacttctgatgaagggggttttctggggttttttacccttgcttcttctatttttccatagttttcgaatttctttaacggacaagtgttatttttatattgaaaagagacgttaaaaagtagcagaaaaaatgccctggttgtaaacccccctgcagtggagatgggtgagaccacagcagcggagcccggtccccagccacgaggcgggcggccgcacacccacctgccgagtcgtagcctctgtactccagccgctgcaggcccttgatgagggtttcgaagatctccttcctcgtccgggggactctgtagttcatgtaggcaaagattcctgttcaaagagaaaaaaatggtgcattcataaaatactcagctcgtgtttggaagaaaacgcttctgggggatgcaccgaggtggcatcacaaaggtctcccaggggcttgcagaggt

SEQ ID NO: 31893 - DNA, 601 bp, Human
ggcggagcttgcagtgagctgagatcgcgccactgcacttcagcctgggtgacagagcgagactccatctcgaaaaaaaaaaaaaaagaatgaatgagtttaggatcctagaaatgccaagtgaaaagagaagaatataaaattacaaaattgcataattataattaggtaaaaacaaaaaatatcaacgtacaacacctccaccacagaccacccccacagacaacagcgaccggagaagggtcccaaagactgatgggggctccttttttaatgaaggagctgacaaacacaacgctgsgcatacttaatgtctacaactcgatgagcttggaggcacgtgtgcccccatgaaaccaccactgccgtctatgccatcaacctatcacctccgagagtctgctcctgccctctttatgtattgttctgtgtgtgataagaggacttagcataagctctaccctcttggctgggctcactggctcacacctacaatctcagtgctttgggaggcaaaggcaggaggatcgcttggggctacgccgggcagcacagtgagacctcatctctacaaaaaataaaaaattagccgggtgtggtg

SEQ ID NO: 31894 - DNA, 601 bp, Human
aatggcgtgaacccaggaggcggagcttgcagtgagctgagatcgcgccactgcacttcagcctgggtgacagagcgagactccatctcgaaaaaaaaaaaaaaagaatgaatgagtttaggatcctagaaatgccaagtgaaaagagaagaatataaaattacaaaattgcataattataattaggtaaaaacaaaaaatatcaacgtacaacacctccaccacagaccacccccacagacaacagcgaccggagaagggtcccaaagactgatgggggctccttttttaatgaaggaggtgacaaacacaacgctgcgcatacttaatgtctacaactcgatgagcttggaggcacgtgtgcccccatgaaaccaccactgccgtctatgccatcaacctatcacctccgagagtctgctcctgccctctttatgtattgttctgtgtgtgataagaggacttagcataagctctaccctcttggctgggctcactggctcacacctacaatctcagtgctttgggaggcaaaggcaggaggatcgcttggggctacgccgggcagcacagtgagacctcatctctacaaaaaataaaa

SEQ ID NO: 31895 - DNA, 601 bp, Human
gaatggcgtgaacccaggaggcggagcttgcagtgagctgagatcgcgccactgcacttcagcctgggtgacagagcgagactccatctcgaaaaaaaaaaaaaaagaatgaatgagtttaggatcctagaaatgccaagtgaaaagagaagaatataaaattacaaaattgcataattataattaggtaaaaacaaaaaatatcaacgtacaacacctccaccacagaccacccccacagacaacagcgaccggagaagggtcccaaagactgatgggggctccttttttaatgaaggagctgacaaacacaacgctgcgcatacttaatgtctacaactcgatgagcttggaggcacgtgtgcccccatgaaaccaccactgccgtctatgccatcaacctatcacctccgagagtctgctcctgccctctttatgtattgttctgtgtgtgataagaggacttagcataagctctaccctcttggctgggctcactggctcacacctacaatctcagtgctttgggaggcaaaggcaggaggatcgcttggggctacgccgggcagcacagtgagacctcatctctacaaaaaataaa

SEQ ID NO: 31896 - DNA, 601 bp, Human
ggcccacaaaccacccgtgctgaaggttatttactacttgtctgtagcttagctcacttcttcacagaaataaacttgctttaaaaagaaaatgatatatccctaccataaacagagaagcagtatcatttgctggaataattaaaataactactgtatgtaacccttcacacttaaaaaaattatccatgcgccgccaccacctaaaataaaccatcccataccctgcgaagcccggttttacagcacgggcttagccctccctctgtttatctgagctgggacaaaggagaatctccaktctccggcgctgttggaatacggtcctagaaagcggccggcgctgcagcggctcctcccactcagaggtcctccacttactgtaaagttcttcatcgagagccttgactttcccccttttcttgaccagctgaatgtgtctttctttgacttcgtgattattcccatcgatcgccacacctgtgatgtagacagcatttgttatattgcaaccaaagctttttctcacacacttggcacaggtgctccgcagggtcagggctgcatgccccgggctgtccgtttatggcaggttggagag

SEQ ID NO: 31897 - DNA, 601 bp, Human
aggctgagaagtcagttagaggtgggcgcggaacctgctttggcgggcactggccctgacacagctcagggtgaggtggaaccatggggacggggaagcatgccacataccgttgcctttgtctgagcgctgagggtggctgttgacagcactggggaccccgtgggtggcccagcgcgtgtgggcaatgccgaagtgtgtctcaaactccacttttaagtccatgctgtcttgttctaaatgaaaggaaaatcagtttgccgcacttgaacaacaagcctcgacccaggactgtgagtgyaacctggtgtcgttacccaagtcacgtcacccacaccgatggcacctccccaccagctcccaccctgggagtccgcgcaggcccacaaaccacccgtgctgaaggttatttactacttgtctgtagcttagctcacttcttcacagaaataaacttgctttaaaaagaaaatgatatatccctaccataaacagagaagcagtatcatttgctggaataattaaaataactactgtatgtaacccttcacacttaaaaaaattatccatgcgccgccaccacctaaaataaaccatccca

SEQ ID NO: 31898 - DNA, 601 bp, Human
atgagaatcatcatctacactgaagtgggggattttccaatgaggttcattttatcactgggaagggcaggaggctgtggctaaagtggcaacatctcagggcacatggtctgggcgcagtgttttctcggccagcacgactgccccagggaccagcttctgcacttgacctgggctctggccagatgtacattctaggtcctcagcaccatggggtctgctgtcctcctcctggacatagggtgtgtgcctcagtcacgaaatgccctatggttcagggcatgagccagacccaaggaasaggccctcgcaaaaacctcactccctcaagaccctgatcactaggatgcatgagtagccctggctcctgtgctaccaccaagctgctctgctgagcagggtggatggggctctccttccgttttctgggggacgccttcccttccaaattgggcggggtgagctggtgaggccctgcagagtgctctggggagaagcagcaccactgcactttctgtgggtggtgggggtgcctgcccatcccgcccagttacactgcctcggagaaccactgatcagcagtgggtgggggacaccaagc

SEQ ID NO: 31899 - DNA, 601 bp, Human
ggcgcgagctcggctcactgcaagctccgcctcccaggttcacgccattctcctgcctccgcctcccgagtagctgggaccacaggcacccgccaccatgcctggctaattttttgtatttttagtagagatggggtttcaccgtgttagccaggatggtctcgatctcccgacctcatggtccgcccgcctcggcctcccaaagtgctgggattacaggcgtgagccaccatgcctggccggtgatattgtttctttacattattctcttaattctgctacactttctttcatctcagtytatgatcctatcattaatttgttttctggaatccatgttgtctctgcagaatctttgtgtaatttccttgtgtggtatagttgctgggcgttcagacttccttaaaagcatgctcttcagctatcactgctgagtgtcaaagaaattttataaatctttgcttattgtcctgttgttttcttttcaattactcatcctgagtcagggctggagtgtccaagtttgggtgtgggtgggcctcctgggagcctccctgctttggggacacaatgagaatcatcatctacactgaagtggggg

SEQ ID NO: 31900 - DNA, 601 bp, Human
tttttttagtagagacagggtttcaccatgttagccaggctggtctcgaactcctgacctcaggcgatccacccaccttggcctcccaaagtgctgggattataggcttgagccactgtgcctggtctattgactatttttgatcccttctttggatatccaactcaagttttccttcagttcgggaaagatttctcccacagcatcttttgaaaccttttccattattctttttctttattctcaccatgatttcctctatttaaaaaaattgtagtgtttgtttttgtgaggtcacacycaaaaatgggagggcttaaataagaaaagcccagtttcaacagatgtgctgaccacagctcagctttattttttatgtatttatttatttattttttactgctctgtgctctgatcgcttcttgtgcacaccagttacccatatgttggatccatattaactggctccacgtccatccccttctccatttttttatatctatggtgatattgtttctttttctttctttttttttttctgagatggagtctcactctgtcgcccaggctggagtgcagtggcgcgagctcggctcactgc

SEQ ID NO: 31901 - DNA, 601 bp, Human
cccgggttcaagcgattctcctgcctcagcctcccaagtagctggaattgcaggtgctcgccaccacacccggctaatttttgtatttttttagtagagacagggtttcaccatgttagccaggctggtctcgaactcctgacctcaggcgatccacccaccttggcctcccaaagtgctgggattataggcttgagccactgtgcctggtctattgactatttttgatcccttctttggatatccaactcaagttttccttcagttcgggaaagatttctcccacagcatcttttgaaaycttttccattattctttttctttattctcaccatgatttcctctatttaaaaaaattgtagtgtttgtttttgtgaggtcacactcaaaaatgggagggcttaaataagaaaagcccagtttcaacagatgtgctgaccacagctcagctttattttttatgtatttatttatttattttttactgctctgtgctctgatcgcttcttgtgcacaccagttacccatatgttggatccatattaactggctccacgtccatccccttctccatttttttatatctatggtgatattgttt

SEQ ID NO: 31902 - DNA, 601 bp, Human
gtaccttatccagcacattaaatgtgggataggctgttttttataaacacgtcctctaaatgatggacctccaaaaacgggagttagaggacaaaaaggcttcaacagtagacttactttttaaatcagactctgaaaacacctgctcaagaatgatgtattttacactacaggatggtgcctgccagatgttctggactctgggccagtgtccaggctgccacagccctgggggagctactgggtggcactgctgtctgacaggatgggctctgagaggcccggacccctctcgtcctcycgcaccctgcatgggcctgtgtctgctccacctcctcctcagtgtaggggcctccccttggacaatacgcccagtgtgtgctcccttctcagggacttcttctccctgggccctgtcctctgggatgtccccaatctctctccctctctccctcttttgggccattccgttccacatacagacatgctgtgatatcacctatcacaaaaacaggccaggcacagtggctcacgcctgtaaatcccagcattttgggaggccaaggcaggtggatcacttaaagtcaggagttcgagacca

SEQ ID NO: 31903 - DNA, 601 bp, Human
gctcactgtaccttatccagcacattaaatgtgggataggctgttttttataaacacgtcctctaaatgatggacctccaaaaacgggagttagaggacaaaaaggcttcaacagtagacttactttttaaatcagactctgaaaacacctgctcaagaatgatgtattttacactacaggatggtgcctgccagatgttctggactctgggccagtgtccaggctgccacagccctgggggagctactgggtggcactgctgtctgacaggatgggctctgagaggcccggacccctctygtcctcccgcaccctgcatgggcctgtgtctgctccacctcctcctcagtgtaggggcctccccttggacaatacgcccagtgtgtgctcccttctcagggacttcttctccctgggccctgtcctctgggatgtccccaatctctctccctctctccctcttttgggccattccgttccacatacagacatgctgtgatatcacctatcacaaaaacaggccaggcacagtggctcacgcctgtaaatcccagcattttgggaggccaaggcaggtggatcacttaaagtcaggagttc

SEQ ID NO: 31904 - DNA, 601 bp, Human
cagtgtgttttgcctcaccgtgtggcaacggcttctcctgggtagtggacactcttgaaaaccagcgcgaatgcaccttcctgaaaacacacaaacagtgagggtcaacgcgttccagcagccgctgctgcagcctggccacagcccaggtgcgtctccctgggcccctcctgatggcgggaggtcctggggtccctcggggagctgagtgcagaacagcgcatccggggtgacatcacgagggaaagcaaaacagacggtgccacgggaagtaccacaaaccagaacatgtgaattccayggtgagcgatgtgcggcttgcccaggcccacagggagcccggcaggggtgccagctgggtagacggggcagtgagagtcacaggaaatgatagctgggaccaggcttccctgccctgctcagggacagcacctactcagcaagcccctgtgaagtgcactttagctcaacacacggtagggcctgggttcaaatcctggctccacccctgcactgggctctccctttagccttcttggcgcctcgttctcctcatcggtgaaggaagtgagaacagcgccacctggcggggcttccgtga

SEQ ID NO: 31905 - DNA, 601 bp, Human
catggtggggggtgcctgtaatcccagctactctggaggctgagacaagagaatcacttgaacccgggaggcggaggttgcaatgagccgagatcgtgccactgcactccagcttgggcgacaaagcgagactccatctctaaataaataaataaataaataaataaaaggatctcatgatttaaatgatatcctgattccaaaatctaatcctttgctcattcttataaattacagcatgcaaataaaatctaccataggtgtgcacagaaataagaggctcactctggtaacacatgckctctaaacctgcggttcttcaaaaccaggcaggtaaaagtgcagtagttacgaaaggatgtgtgcctttcccctctacacattaatttattaataagaagaaaacaccgacgaacactgtaataagacaatttaagagagctgtttcaaacacatgaattggaatacaatccagtaacattttaccttaggtgatttcttgctaacttagatcaatgaactaatgaagtgcttgctcatcggcttgaatccagtccacatatatccataatctgttagcctgactcaatgcagttcctaa

SEQ ID NO: 31906 - DNA, 601 bp, Human
ctttgattatgtaatcccaggaagcgaagagaagaaggctcagttaccttgcatcagaagcaaagaagaattccacggccttgtcgcccacagcatgcaggcaggcggagctgtccagcctcttcatccgtgtcttacagatattcttcacattctccagagtgcctagcaaatggaggaatgggttgcaaatcccactgggatgttttgtttgcataatatgcagcaaggaaccaatttcccctctgaatatgtgtgggagaaatttgcaatttttagctttggctgtgtcagccaaatygtgtaaaagatcccccaatagcacagtaccactgcaaaagcatttaaatggctacagtgtgagaggaatgcaaacaaaaacaaaccaaagaagcactcacatcaaagcccagttgccgttatacaatggcacttttgtgtatgtttgacaatatacaaaatcatgataaattcatgtccatgataaaaagcttaaaaaaaatggagccaagtctcagttgcacaaaaaccttttagacctggagctgtgcgcctgttgggtctggctcagagtggggtttccttgcctcagaggggagct

SEQ ID NO: 31907 - DNA, 601 bp, Human
atttccacacctttactcccagctgctagtactatcagttctaacagccttttggctggatttaaaaatgtgtaatagtattgcctacaaataattatttcctctcctttcaggcattcatgcctttttttttaaaaaaaagaaacatctggatgggcgcggtggctcacacctgtaatcccagcactttgggaggctgaggagggcggatcatgaggtcaggagatggagacaatcctggctaacacagtgaaaccccatctctactaaaaatacaaaaaattagccgggcgtggtggcrggcacctgtagtcccagctactcagaggctgaggcaggagaatcacttgaacccaggaggcggagcttgcagtgagccgagatcacaccactgcactccagtctgggcgacagagtgagacaaaataaataaataaataaaaataaaaaaagaaacatctatcatatttcattgaatataagttactattgatcgttaagatcacaattatttgacaaacttctaagaaataaaagcttcaacaaattctaatggtactatgccaaaatctacaattctccgtgttttagaatcactgaa

SEQ ID NO: 31908 - DNA, 601 bp, Human
ctctaaagcatttttttttccagctgtggtgaatagtattgcttttttggttcacctaacgtttgctgactgcatcgtgcctggtcacgtgaggtgacacctgagaataaggtggacaaggtcccacttgaaccagatacagcttagtggctaaggccaggatataggatttccacacctttactcccagctgctagtactatcagttctaacagccttttggctggatttaaaaatgtgtaatagtattgcctacaaataattatttcctctcctttcaggcattcatgccttttttttwaaaaaaaagaaacatctggatgggcgcggtggctcacacctgtaatcccagcactttgggaggctgaggagggcggatcatgaggtcaggagatggagacaatcctggctaacacagtgaaaccccatctctactaaaaatacaaaaaattagccgggcgtggtggcgggcacctgtagtcccagctactcagaggctgaggcaggagaatcacttgaacccaggaggcggagcttgcagtgagccgagatcacaccactgcactccagtctgggcgacagagtgagacaaaataaataa

SEQ ID NO: 31909 - DNA, 601 bp, Human
catgtttgtttaaatataattattttatttccaaaatgggtagtcatgtaatctagtcattaaaaccaatggcccaccagttaggcttgaggtggactcggggcctctgtcacttgccagacctgtgcccgtgggcaacatacataaccccctggagttcctgtctcaggttccgcctctgtaaacagaaaagagctgtgccttccccagaggtctgtcatgattatcgcatgggatcctggtgaggctctcataccgtgccccgcacacactggccaccgttgcccaaaagctggacagygtgctcacatctgggagggccacctgccattcctttctcagcatgtgttgtctttcttatctctacactacacgcgacagaatcacttcctgaagttccaaaggcataaacaaataaaataatatggagggttttgttttgttttgttttgttttgttttgttttgttttgagacggagtctcgctctgttgcccaggctggagtgcagtggcgcgatctcggctcactgcaagctccgcctcccgggttcacgccattctcctgcctcagcctcccgagtagctgggactacaggcctc

SEQ ID NO: 31910 - DNA, 601 bp, Human
gctttatacaaaattttgtatagaaatatatttttttgtataaaaagtagaaatatggagtgacaagaagtaaaaacggccctatcctgtctccgagagatcaacactgcttccattgtagcattaaccaaccaacaatgcatgacgcatgtgtgtttatatttatgtgtgcatgtacatgtttgtttaaatataattattttatttccaaaatgggtagtcatgtaatctagtcattaaaaccaatggcccaccagttaggcttgaggtggactcggggcctctgtcacttgccagaccygtgcccgtgggcaacatacataaccccctggagttcctgtctcaggttccgcctctgtaaacagaaaagagctgtgccttccccagaggtctgtcatgattatcgcatgggatcctggtgaggctctcataccgtgccccgcacacactggccaccgttgcccaaaagctggacagcgtgctcacatctgggagggccacctgccattcctttctcagcatgtgttgtctttcttatctctacactacacgcgacagaatcacttcctgaagttccaaaggcataaacaaataaaataat

SEQ ID NO: 31911 - DNA, 601 bp, Human
agaaagatggcaagccactgtactggaaaaaatattttaaacaaaactttatataaaaatactttgtataaaagtatacaaataacttcgtatgctttgtataaaagtgtacaaataacttcgtatgctttgtataaaagtgtacaaataacttcgtatgctttgtataaaagtgtacaaataacttcgtatgctttgtataaaagtgtacaaataactttgtatgctttgtataaaagtatacagagctttatacaaaattttgtatagaaatatatttttttgtataaaaagtagaaayatggagtgacaagaagtaaaaacggccctatcctgtctccgagagatcaacactgcttccattgtagcattaaccaaccaacaatgcatgacgcatgtgtgtttatatttatgtgtgcatgtacatgtttgtttaaatataattattttatttccaaaatgggtagtcatgtaatctagtcattaaaaccaatggcccaccagttaggcttgaggtggactcggggcctctgtcacttgccagacctgtgcccgtgggcaacatacataaccccctggagttcctgtctcaggttccgcc

SEQ ID NO: 31912 - DNA, 601 bp, Human
gcggaggctgcagtgggctgagattgtgccactgcactctaacctgggtgacagagcaagactccgtctcaaaaaaaacactctcattctatcaagagccacacccacacgtgactgcctgaaaatgaacacttaaactcctggtgcaaaggtaaagagagaaaccatcaaggtctaaggctctaaaagacgtatatccagccagatcctagggaagaaagagaaagaaagatggcaagccactgtactggaaaaaatattttaaacaaaactttatataaaaatactttgtataaaagtrtacaaataacttcgtatgctttgtataaaagtgtacaaataacttcgtatgctttgtataaaagtgtacaaataacttcgtatgctttgtataaaagtgtacaaataacttcgtatgctttgtataaaagtgtacaaataactttgtatgctttgtataaaagtatacagagctttatacaaaattttgtatagaaatatatttttttgtataaaaagtagaaatatggagtgacaagaagtaaaaacggccctatcctgtctccgagagatcaacactgcttccattgtagcattaacc

SEQ ID NO: 31913 - DNA, 601 bp, Human
ggcaggagaatcacttgaacccaggaggcggaggctgcagtgggctgagattgtgccactgcactctaacctgggtgacagagcaagactccgtctcaaaaaaaacactctcattctatcaagagccacacccacacgtgactgcctgaaaatgaacacttaaactcctggtgcaaaggtaaagagagaaaccatcaaggtctaaggctctaaaagacgtatatccagccagatcctagggaagaaagagaaagaaagatggcaagccactgtactggaaaaaatattttaaacaaaactttatataaaaatactttgtataaaagtatacaaataacttcgtatgctttgtataaaagtgtacaaataacttcgtatgctttgtataaaagtgtacaaataacttcgtatgctttgtataaaagtgtacaaataacttcgtatgctttgtataaaagtgtacaaataactttgtatgctttgtataaaagtatacagagctttatacaaaattttgtatagaaatatatttttttgtataaaaagtagaaatatggagtgacaagaagtaaaaacggccctatcctgtctccgagagatc

SEQ ID NO: 31914 - DNA, 601 bp, Human
ttgatttgcaggtgaatcttccttttcttctccactcttccctcctgtccccacggaattattttgaagccagtcccagacattatatcatttcttctgtaaacactttaccatagagctctaaaactattttaacctactataataccataatcatatctaaaatgaatagttgttcctttatatcatcaaatattcagcatgtttacatatctccaataatctcacggctgtctttttataaccggtttcttcaaatcaggatccaaacaatgtcacctctggaagatactcgagaacsaacacattattctgaatcgtgaagggaaagaataaagcatttatctcgcctttctaaacaatctgtctttcagaacaaccacatactttatgaaggcaagtttctctaagaagtgatacagctagtaatgaagaaataatagaagaatcaatttatgaactcctaattattaatagctctaatcaaggaccattcatggctgttgaaaccagaaggtaaaaagctggacgaagctttatcatggatggataaggctggcaacactcaaacccctgatggctcttagcacaaaaagagaga

SEQ ID NO: 31915 - DNA, 601 bp, Human
gaggagaaatgatgcctgagggtgggcatgtgtcccgcggagtcggtgaaggaaggcagctgacacactgggctcagttccagtaggaaagacctggcggctggctgcacacaggagcccccgcttggaggtgccaggccagcctccccacatcccctcacctgtgcaagccacaggctacctgcagccccgccctggtggccacagagggcaggagggctgtggcctctactaggaccaggcagagtgtcaggagctccaccaggcgcgctggctcccgaggctgccgcacgtggactcyggaggacacctgcctttcatgatttgctgcagttccatctgcaaggtctggatggctcgagatgggtcatcactggccgagcgcttgacccggtgaatggagagtttcccatcagccactgcggcgatgtcatcgtcctccaggaagatgacccggttggtgtgctctatgatagcgctggggcaagggaaacaggcatcatcagtgccctgccctgagcagttacgaggcagcagccccttgctggttcccaagcgtggaggccacatcgttggcattttaggagggacagagagacca

SEQ ID NO: 31916 - DNA, 601 bp, Human
ctggggagggaccatggcagacacaggagcagagaaggagtctctgagggggtgacatttcaagggagctggaggcaatgaaaaggaaccagtcctatgagaagaacagcgaatgcaggggctgtggcggggcacagtgggacagagggttgagtgtggtggggccaggctttggccccactggggtgtggggtttgtgggctgtggcagggagtttggattttattctaagaacagtaggaaaccattggagggccttgagcagcgggatgatcacaggggctgattcatgttcttagamgtttgctcaggctgccctgtggggtagaggttgtaaggggacagaaatgggtgcagacagagaggctctccttgtagggagaaagtgtacccccaccccccatttactgcagacctgcagacttccacccagaggagaaatgatgcctgagggtgggcatgtgtcccgcggagtcggtgaaggaaggcagctgacacactgggctcagttccagtaggaaagacctggcggctggctgcacacaggagcccccgcttggaggtgccaggccagcctccccacatcccctcacctgtgcaa

SEQ ID NO: 31917 - DNA, 601 bp, Human
aggccgggcgcagtggctcacgcctgtaatcccagcactttgggaggccgaggcgggcggatcacgaagtcaggagatcgagaccatcccggctaaaacagtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccacagcactccagcctgggcgacagagcaagactccgtctcaaaaaaaaaaaaaaaaaaacctttccagccacacaggcatttccagggctctgatttgagtgggattggatggtgctgatgggacaatggggctgcagggtgttcaagcccctgcacctgatgctctggaggtacccacaggcagggcaggccgtgttctctaggatacgcacactcatgacaccaacatcgcccatgctcccggcctgtctcccatgacctggcacttgtgcgacgagcaaatgaagcaagtgaggggaatgaggggtggccaccataggggaggggctggggagggaccatggcagacacaggagca

SEQ ID NO: 31918 - DNA, 601 bp, Human
ccctcctggtttccgtaataaaaacctttccaggccgggcgcagtggctcacgcctgtaatcccagcactttgggaggccgaggcgggcggatcacgaagtcaggagatcgagaccatcccggctaaaacagtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccacagcactccagcctgggcgacagagcragactccgtctcaaaaaaaaaaaaaaaaaaacctttccagccacacaggcatttccagggctctgatttgagtgggattggatggtgctgatgggacaatggggctgcagggtgttcaagcccctgcacctgatgctctggaggtacccacaggcagggcaggccgtgttctctaggatacgcacactcatgacaccaacatcgcccatgctcccggcctgtctcccatgacctggcacttgtgcgacgagcaaatgaagcaagtgaggggaatgaggggtggccaccataggggagggg

SEQ ID NO: 31919 - DNA, 601 bp, Human
caggcaattttccttctaataaataccctcctggtttccgtaataaaaacctttccaggccgggcgcagtggctcacgcctgtaatcccagcactttgggaggccgaggcgggcggatcacgaagtcaggagatcgagaccatcccggctaaaacagtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccacwgcactccagcctgggcgacagagcaagactccgtctcaaaaaaaaaaaaaaaaaaacctttccagccacacaggcatttccagggctctgatttgagtgggattggatggtgctgatgggacaatggggctgcagggtgttcaagcccctgcacctgatgctctggaggtacccacaggcagggcaggccgtgttctctaggatacgcacactcatgacaccaacatcgcccatgctcccggcctgtctcccatgacctggcacttgtgcgacgagcaaatgaagcaagtgaggggaatg

SEQ ID NO: 31920 - DNA, 601 bp, Human
aaagaaacaggcaattttccttctaataaataccctcctggtttccgtaataaaaacctttccaggccgggcgcagtggctcacgcctgtaatcccagcactttgggaggccgaggcgggcggatcacgaagtcaggagatcgagaccatcccggctaaaacagtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcscgccacagcactccagcctgggcgacagagcaagactccgtctcaaaaaaaaaaaaaaaaaaacctttccagccacacaggcatttccagggctctgatttgagtgggattggatggtgctgatgggacaatggggctgcagggtgttcaagcccctgcacctgatgctctggaggtacccacaggcagggcaggccgtgttctctaggatacgcacactcatgacaccaacatcgcccatgctcccggcctgtctcccatgacctggcacttgtgcgacgagcaaatgaagcaagtgag

SEQ ID NO: 31921 - DNA, 601 bp, Human
gctcagtcagttcctccaaaacttgccgcgtctgaagccaacaagcaagcatggagactaaagtcagtcacaggcacgacagggacatggggcagctgggcttctagggacagtttgtgacacggaacctcactgtccaggtggcgaggggacttcggtcacccacaggccacctcgaagataaaagggctccgtgtcatttctcacgctagctcatgggaatgggtacaagggcttagccaaattcagaaggccacatgagtgataaaactgaaggccagtgtctggtcctagactgccrtcgacttccccacgcacatgtgtcacacttacagccacggcagcgtggtagctggttccacagccaatcacgatgagccgtcggcatcgtcgaatctccttcaagtggtccttcaagccacccaggagcactgcagggcacacgacaaggcgttaatgctgagtctacacagtcaccgcattccctgagactaggctcgggcggaggctccccaccgagtgtaggaattacctgtgttggtttcaaaattcacccgacctctcatagtattgaaaactgattctggctgttcgaagatct

SEQ ID NO: 31922 - DNA, 601 bp, Human
agctcagtcagttcctccaaaacttgccgcgtctgaagccaacaagcaagcatggagactaaagtcagtcacaggcacgacagggacatggggcagctgggcttctagggacagtttgtgacacggaacctcactgtccaggtggcgaggggacttcggtcacccacaggccacctcgaagataaaagggctccgtgtcatttctcacgctagctcatgggaatgggtacaagggcttagccaaattcagaaggccacatgagtgataaaactgaaggccagtgtctggtcctagactgcygtcgacttccccacgcacatgtgtcacacttacagccacggcagcgtggtagctggttccacagccaatcacgatgagccgtcggcatcgtcgaatctccttcaagtggtccttcaagccacccaggagcactgcagggcacacgacaaggcgttaatgctgagtctacacagtcaccgcattccctgagactaggctcgggcggaggctccccaccgagtgtaggaattacctgtgttggtttcaaaattcacccgacctctcatagtattgaaaactgattctggctgttcgaagatc

SEQ ID NO: 31923 - DNA, 601 bp, Human
tgcagaggacttaactgaatgaaggagaagaggagagagcccagagctgacctgatgcaaggctggccacaatgcctgtgtcccttacctgactggctgatgaaaaagcaaacgtcatccctgaacacaggtgtgttcctgtccagaaaatcactagcaagttcaaccatcacaggaagctcagtcagttcctccaaaacttgccgcgtctgaagccaacaagcaagcatggagactaaagtcagtcacaggcacgacagggacatggggcagctgggcttctagggacagtttgtgacayggaacctcactgtccaggtggcgaggggacttcggtcacccacaggccacctcgaagataaaagggctccgtgtcatttctcacgctagctcatgggaatgggtacaagggcttagccaaattcagaaggccacatgagtgataaaactgaaggccagtgtctggtcctagactgccgtcgacttccccacgcacatgtgtcacacttacagccacggcagcgtggtagctggttccacagccaatcacgatgagccgtcggcatcgtcgaatctccttcaagtggtccttcaagccacc

SEQ ID NO: 31924 - DNA, 601 bp, Human
ccgggactacaggcgcccgccaccacgcccggctaattgttttatatttttagtagagacggggtttcactgtgtgagccaggatggcctcaatctcctgacctcgtgatccgcccacctcagcctcccaaagtgctgggattacaggcgtgagccaccgcgcccggccggttatatgtttttcttttgtcattttaatcatgcagcctgaagtatttatatggatgaatatcatgatgcccgggattggcttcaaagtaaccccatggagacgaggggttaatatgagtgtgtccgaccrgcacaagatgggctggataaggctaggatattcattatatgaaaattctacttttataaaggcttggaattatccgtaattaaaacatttcaaaaatcttccacgagctcaaggagactccaagcctatggccctggatcacctccctgagacagctggagcaaatgtcaagcccagtgttgggatggcaccagatggggtgcatgtagcttgggagaccttccttggccctaaaagggagcactgtctcccccacacctccccctgctgggcagcatgggcactgcatgccacaggcag

SEQ ID NO: 31925 - DNA, 601 bp, Human
tggtgggatcagaaacccaaaggtgaacacggcagcagctcctgcgtcataaggtggtgggccggatggtcggtgtatctgtactggtttttcttcacttgtcaacaaaatggaaatggtatttaaaatggaaaatggcaggagtactaaaagtcctaatagatgatagggcattacaatcagtattttagttgtggtagtaacaccgtggtcatacgtttttctttttcttttttttttttttgagacggagtctcgctctgtcgcccaggctggagtgcagtggcgcgatctcagctcrctgcaagctccgcctcccgggttcacaccattctcctgcctcagcctcctgagtagccgggactacaggcgcccgccaccacgcccggctaattgttttatatttttagtagagacggggtttcactgtgtgagccaggatggcctcaatctcctgacctcgtgatccgcccacctcagcctcccaaagtgctgggattacaggcgtgagccaccgcgcccggccggttatatgtttttcttttgtcattttaatcatgcagcctgaagtatttatatggatgaatatcatgatgcccgg

SEQ ID NO: 31926 - DNA, 601 bp, Human
agtctgaggctctggtgggatcagaaacccaaaggtgaacacggcagcagctcctgcgtcataaggtggtgggccggatggtcggtgtatctgtactggtttttcttcacttgtcaacaaaatggaaatggtatttaaaatggaaaatggcaggagtactaaaagtcctaatagatgatagggcattacaatcagtattttagttgtggtagtaacaccgtggtcatacgtttttctttttcttttttttttttttgagacggagtctcgctctgtcgcccaggctggagtgcagtggcgygatctcagctcactgcaagctccgcctcccgggttcacaccattctcctgcctcagcctcctgagtagccgggactacaggcgcccgccaccacgcccggctaattgttttatatttttagtagagacggggtttcactgtgtgagccaggatggcctcaatctcctgacctcgtgatccgcccacctcagcctcccaaagtgctgggattacaggcgtgagccaccgcgcccggccggttatatgtttttcttttgtcattttaatcatgcagcctgaagtatttatatggatgaatat

SEQ ID NO: 31927 - DNA, 601 bp, Human
ggctcactgcagcctcaacctcctcaagtgattctcccacctcagcctcccgagtaactgggactacaggtgccaccaccctgcccagttaatttttaggttttatttatctatttatttatttctattttgtttttgagacaaagtcttgctgtgtcacccaggctggagtgcagtggctcgatctcggctcactgcaacctccacctaccaggttcaagcgattctcctgcctcagcctcccgagtagctgggattacaggcacccgccaccacacccgactaatttttgtgtttttartagagacggggtttcaccgtgttagccaggatggtctcaaacccctgacctcaggtgatccccctgcctcggcctcccaaagtgctgggattacaggcctgagtctccgcacctggcctaagttttatttttgaagggacggggttgcccggggcggtctggaactcctgggttcaagggatgctcccgcctcagcctcccacagtgctgggattccaggggggagccccgtgccagccctaaaggactttaaaataagcatctccaaggtgctcaaagagccacaggacaacatggacg

SEQ ID NO: 31928 - DNA, 601 bp, Human
agatcacggctcactgcagcctcaacctcctcaagtgattctcccacctcagcctcccgagtaactgggactacaggtgccaccaccctgcccagttaatttttaggttttatttatctatttatttatttctattttgtttttgagacaaagtcttgctgtgtcacccaggctggagtgcagtggctcgatctcggctcactgcaacctccacctaccaggttcaagcgattctcctgcctcagcctcccgagtagctgggattacaggcacccgccaccacacccgactaatttttgtrtttttagtagagacggggtttcaccgtgttagccaggatggtctcaaacccctgacctcaggtgatccccctgcctcggcctcccaaagtgctgggattacaggcctgagtctccgcacctggcctaagttttatttttgaagggacggggttgcccggggcggtctggaactcctgggttcaagggatgctcccgcctcagcctcccacagtgctgggattccaggggggagccccgtgccagccctaaaggactttaaaataagcatctccaaggtgctcaaagagccacaggacaac

SEQ ID NO: 31929 - DNA, 601 bp, Human
gttgctcacgcctgagtgcagtggcgagatcacggctcactgcagcctcaacctcctcaagtgattctcccacctcagcctcccgagtaactgggactacaggtgccaccaccctgcccagttaatttttaggttttatttatctatttatttatttctattttgtttttgagacaaagtcttgctgtgtcacccaggctggagtgcagtggctcgatctcggctcactgcaacctccacctaccaggttcaagcgattctcctgcctcagcctcccgagtagctgggattacaggcaccygccaccacacccgactaatttttgtgtttttagtagagacggggtttcaccgtgttagccaggatggtctcaaacccctgacctcaggtgatccccctgcctcggcctcccaaagtgctgggattacaggcctgagtctccgcacctggcctaagttttatttttgaagggacggggttgcccggggcggtctggaactcctgggttcaagggatgctcccgcctcagcctcccacagtgctgggattccaggggggagccccgtgccagccctaaaggactttaaaataagcatctcca

SEQ ID NO: 31930 - DNA, 601 bp, Human
cagggaccttattttcactttttaaatcaacttttatttttgagacagggtctactctgttgctcacgcctgagtgcagtggcgagatcacggctcactgcagcctcaacctcctcaagtgattctcccacctcagcctcccgagtaactgggactacaggtgccaccaccctgcccagttaatttttaggttttatttatctatttatttatttctattttgtttttgagacaaagtcttgctgtgtcacccaggctggagtgcagtggctcgatctcggctcactgcaacctccacctmccaggttcaagcgattctcctgcctcagcctcccgagtagctgggattacaggcacccgccaccacacccgactaatttttgtgtttttagtagagacggggtttcaccgtgttagccaggatggtctcaaacccctgacctcaggtgatccccctgcctcggcctcccaaagtgctgggattacaggcctgagtctccgcacctggcctaagttttatttttgaagggacggggttgcccggggcggtctggaactcctgggttcaagggatgctcccgcctcagcctcccacagtgct

SEQ ID NO: 31931 - DNA, 601 bp, Human
agcaaacggggaaagtgtggtggggctgccaaggagcgcctggcataggaaggacctggggccatttgctctttctcgagtacttactgagcacctactgtatgcctgccctgtgctggacaccagctgtccagtggcagctctggcagacagagctgtgtgttcacggagccgacatgttagttgggggagacaggccagtcaacaggtgaacagggaatttcaggtcatgaggtgtgttatgaaaaaaataaacaggctaatgtttcacagagtgctggcatcggggcctctgtgagcrtggccagggagggtctcaggaggtgacatttgagctgaggtttgggagatgagaagctgtcggctgtatgcagagcaggaagaagatggttcagcagagtaaagagccagtgcgaaggccctgcggtgagaaagcactgagcactgctgaggaccagggaggcagggaggctgaggaccagggaggcagggaggtggggaggctgaggggcagggaggcagggaggcggggaggtggggaggctgaggggcagggaggcagggaggcggggaggctgaggaccagggaggcagggaggct

SEQ ID NO: 31932 - DNA, 601 bp, Human
tttagtgcaacagatattgtatctcaccagctacgacagctgcgactgctgctgcccagcaaacggggaaagtgtggtggggctgccaaggagcgcctggcataggaaggacctggggccatttgctctttctcgagtacttactgagcacctactgtatgcctgccctgtgctggacaccagctgtccagtggcagctctggcagacagagctgtgtgttcacggagccgacatgttagttgggggagacaggccagtcaacaggtgaacagggaatttcaggtcatgaggtgtgttatraaaaaaataaacaggctaatgtttcacagagtgctggcatcggggcctctgtgagcatggccagggagggtctcaggaggtgacatttgagctgaggtttgggagatgagaagctgtcggctgtatgcagagcaggaagaagatggttcagcagagtaaagagccagtgcgaaggccctgcggtgagaaagcactgagcactgctgaggaccagggaggcagggaggctgaggaccagggaggcagggaggtggggaggctgaggggcagggaggcagggaggcggggaggtggggaggc

SEQ ID NO: 31933 - DNA, 601 bp, Human
ccacggtccccaaggaggtcatgatttagtgcaacagatattgtatctcaccagctacgacagctgcgactgctgctgcccagcaaacggggaaagtgtggtggggctgccaaggagcgcctggcataggaaggacctggggccatttgctctttctcgagtacttactgagcacctactgtatgcctgccctgtgctggacaccagctgtccagtggcagctctggcagacagagctgtgtgttcacggagccgacatgttagttgggggagacaggccagtcaacaggtgaacagggaatttcaggtcatgaggtgtgttatgaaaaaaataaacaggctaatgtttcacagagtgctggcatcggggcctctgtgagcatggccagggagggtctcaggaggtgacatttgagctgaggtttgggagatgagaagctgtcggctgtatgcagagcaggaagaagatggttcagcagagtaaagagccagtgcgaaggccctgcggtgagaaagcactgagcactgctgaggaccagggaggcagggaggctgaggaccagggaggcagggaggtggggaggctgaggggcagggaggc

SEQ ID NO: 31934 - DNA, 601 bp, Human
gggaggccacggtccccaaggaggtcatgatttagtgcaacagatattgtatctcaccagctacgacagctgcgactgctgctgcccagcaaacggggaaagtgtggtggggctgccaaggagcgcctggcataggaaggacctggggccatttgctctttctcgagtacttactgagcacctactgtatgcctgccctgtgctggacaccagctgtccagtggcagctctggcagacagagctgtgtgttcacggagccgacatgttagttgggggagacaggccagtcaacaggtgaamagggaatttcaggtcatgaggtgtgttatgaaaaaaataaacaggctaatgtttcacagagtgctggcatcggggcctctgtgagcatggccagggagggtctcaggaggtgacatttgagctgaggtttgggagatgagaagctgtcggctgtatgcagagcaggaagaagatggttcagcagagtaaagagccagtgcgaaggccctgcggtgagaaagcactgagcactgctgaggaccagggaggcagggaggctgaggaccagggaggcagggaggtggggaggctgaggggcag

SEQ ID NO: 31935 - DNA, 601 bp, Human
tggcaggccagggatagcacatgggacagggcacggcactggttcttaatatatgtggtggatgaatgaagaaaggggaggccacggtccccaaggaggtcatgatttagtgcaacagatattgtatctcaccagctacgacagctgcgactgctgctgcccagcaaacggggaaagtgtggtggggctgccaaggagcgcctggcataggaaggacctggggccatttgctctttctcgagtacttactgagcacctactgtatgcctgccctgtgctggacaccagctgtccagtggcrgctctggcagacagagctgtgtgttcacggagccgacatgttagttgggggagacaggccagtcaacaggtgaacagggaatttcaggtcatgaggtgtgttatgaaaaaaataaacaggctaatgtttcacagagtgctggcatcggggcctctgtgagcatggccagggagggtctcaggaggtgacatttgagctgaggtttgggagatgagaagctgtcggctgtatgcagagcaggaagaagatggttcagcagagtaaagagccagtgcgaaggccctgcggtgagaaagcact

SEQ ID NO: 31936 - DNA, 601 bp, Human
gtgagcgttccatgccagcctggggcgaggctcgattcatctccgcctctcaggcctgcacagaagtctctctcctactctggcatgtgagtgactgaaggaggtgagctgctgcttatcttggcaggccagggatagcacatgggacagggcacggcactggttcttaatatatgtggtggatgaatgaagaaaggggaggccacggtccccaaggaggtcatgatttagtgcaacagatattgtatctcaccagctacgacagctgcgactgctgctgcccagcaaacggggaaagtgyggtggggctgccaaggagcgcctggcataggaaggacctggggccatttgctctttctcgagtacttactgagcacctactgtatgcctgccctgtgctggacaccagctgtccagtggcagctctggcagacagagctgtgtgttcacggagccgacatgttagttgggggagacaggccagtcaacaggtgaacagggaatttcaggtcatgaggtgtgttatgaaaaaaataaacaggctaatgtttcacagagtgctggcatcggggcctctgtgagcatggccagggagggtctc

SEQ ID NO: 31937 - DNA, 601 bp, Human
cctggctcccagggaagctccagcgtccactctgtctctgggagggcactccccagaagccccatgatgtcctgtccgcagtgagcgttccatgccagcctggggcgaggctcgattcatctccgcctctcaggcctgcacagaagtctctctcctactctggcatgtgagtgactgaaggaggtgagctgctgcttatcttggcaggccagggatagcacatgggacagggcacggcactggttcttaatatatgtggtggatgaatgaagaaaggggaggccacggtccccaaggaggkcatgatttagtgcaacagatattgtatctcaccagctacgacagctgcgactgctgctgcccagcaaacggggaaagtgtggtggggctgccaaggagcgcctggcataggaaggacctggggccatttgctctttctcgagtacttactgagcacctactgtatgcctgccctgtgctggacaccagctgtccagtggcagctctggcagacagagctgtgtgttcacggagccgacatgttagttgggggagacaggccagtcaacaggtgaacagggaatttcaggtcatgaggtgt

SEQ ID NO: 31938 - DNA, 601 bp, Human
gctttgcagacacccaggacctgtggaccacatctggagaaccactgacttagacgtcagaattgggtcctgttttgcatggttatgacctggcttaaaggaagaatgcttttctcagaaataaactttcagcaagctgtctcggccagtgtcaggccccgagggcctggaattgaccattctctatgatggcccttccccaactgcctgctctggggtttggccctggctcccagggaagctccagcgtccactctgtctctgggagggcactccccagaagccccatgatgtcctgtcygcagtgagcgttccatgccagcctggggcgaggctcgattcatctccgcctctcaggcctgcacagaagtctctctcctactctggcatgtgagtgactgaaggaggtgagctgctgcttatcttggcaggccagggatagcacatgggacagggcacggcactggttcttaatatatgtggtggatgaatgaagaaaggggaggccacggtccccaaggaggtcatgatttagtgcaacagatattgtatctcaccagctacgacagctgcgactgctgctgcccagcaaacggggaaa

SEQ ID NO: 31939 - DNA, 601 bp, Human
aaatttttagtataaagaatgtattactatgtgaacaattttgttcaaagggctttgcagacacccaggacctgtggaccacatctggagaaccactgacttagacgtcagaattgggtcctgttttgcatggttatgacctggcttaaaggaagaatgcttttctcagaaataaactttcagcaagctgtctcggccagtgtcaggccccgagggcctggaattgaccattctctatgatggcccttccccaactgcctgctctggggtttggccctggctcccagggaagctccagcgyccactctgtctctgggagggcactccccagaagccccatgatgtcctgtccgcagtgagcgttccatgccagcctggggcgaggctcgattcatctccgcctctcaggcctgcacagaagtctctctcctactctggcatgtgagtgactgaaggaggtgagctgctgcttatcttggcaggccagggatagcacatgggacagggcacggcactggttcttaatatatgtggtggatgaatgaagaaaggggaggccacggtccccaaggaggtcatgatttagtgcaacagatattgt

SEQ ID NO: 31940 - DNA, 601 bp, Human
tctgaaatcctatcaataaactttttctactttgttaggttaaaatttatttttctgtcttgtgcttttaaatggatcatttacaagtgcataactctgtgacatcgtgaactggccacaaaggtatgtaaatcttcttaaaatggacacttttattataaaatgttctttaaaaatcaccttgttgaagtcaccttgatctcatcagagaagacttttttttttttttgagacagagtctcactctgtcacccaacctggggtgcagtggcacgatctcggctcactgtaacctcggccrcccgggttcaagtgattctcctgcctcagcctcctgagtagctgggattacaggtgcctgccactgcacccagctaaattttttaaatatttttagtagagatggggtttcaccatcttggataggctggtcttgaactcctgacctcatgatccacccacctcggcctcccaaagtgctgggattacaggcatcagccaccgtgcccggccctagagaagtctttaaatgttaggaactggtcaagctcatggtaacagaggtgttttctaacactcaaaagttttgcctgggagctta

SEQ ID NO: 31941 - DNA, 601 bp, Human
tagaatctgaaatcctatcaataaactttttctactttgttaggttaaaatttatttttctgtcttgtgcttttaaatggatcatttacaagtgcataactctgtgacatcgtgaactggccacaaaggtatgtaaatcttcttaaaatggacacttttattataaaatgttctttaaaaatcaccttgttgaagtcaccttgatctcatcagagaagacttttttttttttttgagacagagtctcactctgtcacccaacctggggtgcagtggcacgatctcggctcactgtaacctyggccacccgggttcaagtgattctcctgcctcagcctcctgagtagctgggattacaggtgcctgccactgcacccagctaaattttttaaatatttttagtagagatggggtttcaccatcttggataggctggtcttgaactcctgacctcatgatccacccacctcggcctcccaaagtgctgggattacaggcatcagccaccgtgcccggccctagagaagtctttaaatgttaggaactggtcaagctcatggtaacagaggtgttttctaacactcaaaagttttgcctggga

SEQ ID NO: 31942 - DNA, 601 bp, Human
caaacttgagaaacagtaggttcttgaaagggtaggtgccaatatagaatctgaaatcctatcaataaactttttctactttgttaggttaaaatttatttttctgtcttgtgcttttaaatggatcatttacaagtgcataactctgtgacatcgtgaactggccacaaaggtatgtaaatcttcttaaaatggacacttttattataaaatgttctttaaaaatcaccttgttgaagtcaccttgatctcatcagagaagacttttttttttttttgagacagagtctcactctgtcayccaacctggggtgcagtggcacgatctcggctcactgtaacctcggccacccgggttcaagtgattctcctgcctcagcctcctgagtagctgggattacaggtgcctgccactgcacccagctaaattttttaaatatttttagtagagatggggtttcaccatcttggataggctggtcttgaactcctgacctcatgatccacccacctcggcctcccaaagtgctgggattacaggcatcagccaccgtgcccggccctagagaagtctttaaatgttaggaactggtcaagctca

SEQ ID NO: 31943 - DNA, 601 bp, Human
cattcaatctgtggtgataagctcttttggttgaagtataaaaataaaattcagcctacaaatacagatttgtagttggaaaagcgaggagtatttaaattattttacaaataattgtgaatattgttctttgacaccacagtacatcaaacttgagaaacagtaggttcttgaaagggtaggtgccaatatagaatctgaaatcctatcaataaactttttctactttgttaggttaaaatttatttttctgtcttgtgcttttaaatggatcatttacaagtgcataactctgtgacaycgtgaactggccacaaaggtatgtaaatcttcttaaaatggacacttttattataaaatgttctttaaaaatcaccttgttgaagtcaccttgatctcatcagagaagacttttttttttttttgagacagagtctcactctgtcacccaacctggggtgcagtggcacgatctcggctcactgtaacctcggccacccgggttcaagtgattctcctgcctcagcctcctgagtagctgggattacaggtgcctgccactgcacccagctaaattttttaaatatttttagtagagatg

SEQ ID NO: 31944 - DNA, 601 bp, Human
tccatctcgaaaaaaaaaaaagaagaaaaagaaagaaagaaactaacaatgagaaatttaaaaatattcactttaaaataacaacactaaatctattacattacttcatttccaacaagaattagtgagaagaatggcactgctttttgttcttgcaaatctttttagtgtctgcctttttaataaaagactgttgactctaatatctgctttcacattcaatctgtggtgataagctcttttggttgaagtataaaaataaaattcagcctacaaatacagatttgtagttggaaaagcraggagtatttaaattattttacaaataattgtgaatattgttctttgacaccacagtacatcaaacttgagaaacagtaggttcttgaaagggtaggtgccaatatagaatctgaaatcctatcaataaactttttctactttgttaggttaaaatttatttttctgtcttgtgcttttaaatggatcatttacaagtgcataactctgtgacatcgtgaactggccacaaaggtatgtaaatcttcttaaaatggacacttttattataaaatgttctttaaaaatcaccttgttgaag

SEQ ID NO: 31945 - DNA, 601 bp, Human
ctccatctcgaaaaaaaaaaaagaagaaaaagaaagaaagaaactaacaatgagaaatttaaaaatattcactttaaaataacaacactaaatctattacattacttcatttccaacaagaattagtgagaagaatggcactgctttttgttcttgcaaatctttttagtgtctgcctttttaataaaagactgttgactctaatatctgctttcacattcaatctgtggtgataagctcttttggttgaagtataaaaataaaattcagcctacaaatacagatttgtagttggaaaagygaggagtatttaaattattttacaaataattgtgaatattgttctttgacaccacagtacatcaaacttgagaaacagtaggttcttgaaagggtaggtgccaatatagaatctgaaatcctatcaataaactttttctactttgttaggttaaaatttatttttctgtcttgtgcttttaaatggatcatttacaagtgcataactctgtgacatcgtgaactggccacaaaggtatgtaaatcttcttaaaatggacacttttattataaaatgttctttaaaaatcaccttgttgaa

SEQ ID NO: 31946 - DNA, 601 bp, Human
ctaacatggtgagacctggtatctactaaaaatacaaaaaattagccgggcatggtggcgggcgcctgtagtcccagctactcgggaggctgaggcaggagagtggcgtgaacctgggaggcggagcttgcagtgagctgagatggcaccacggcactccagcctgggcaacagagcgagactccatctcgaaaaaaaaaaaagaagaaaaagaaagaaagaaactaacaatgagaaatttaaaaatattcactttaaaataacaacactaaatctattacattacttcatttccaacaaraattagtgagaagaatggcactgctttttgttcttgcaaatctttttagtgtctgcctttttaataaaagactgttgactctaatatctgctttcacattcaatctgtggtgataagctcttttggttgaagtataaaaataaaattcagcctacaaatacagatttgtagttggaaaagcgaggagtatttaaattattttacaaataattgtgaatattgttctttgacaccacagtacatcaaacttgagaaacagtaggttcttgaaagggtaggtgccaatatagaatctgaaat

SEQ ID NO: 31947 - DNA, 601 bp, Human
atcctggctaacatggtgagacctggtatctactaaaaatacaaaaaattagccgggcatggtggcgggcgcctgtagtcccagctactcgggaggctgaggcaggagagtggcgtgaacctgggaggcggagcttgcagtgagctgagatggcaccacggcactccagcctgggcaacagagcgagactccatctcgaaaaaaaaaaaagaagaaaaagaaagaaagaaactaacaatgagaaatttaaaaatattcactttaaaataacaacactaaatctattacattacttcatttycaacaagaattagtgagaagaatggcactgctttttgttcttgcaaatctttttagtgtctgcctttttaataaaagactgttgactctaatatctgctttcacattcaatctgtggtgataagctcttttggttgaagtataaaaataaaattcagcctacaaatacagatttgtagttggaaaagcgaggagtatttaaattattttacaaataattgtgaatattgttctttgacaccacagtacatcaaacttgagaaacagtaggttcttgaaagggtaggtgccaatatagaat

SEQ ID NO: 31948 - DNA, 601 bp, Human
ttgtttttgagttaaatctgtcaacatttaccagattagaaaataacactgaggaccaggcgtggtggctcacgcctgtaatcgccgcactttgggaggccgaggcgggtggatcatgaggtcaggagatcgagaccatcctggctaacatggtaaaaccccgtctctactaaaaatacaaaaaattagccgggcgtggttgggtgcggtggctcacgcctgtaatcccagcactttggaaggctggggcaggcggatcacgaggtcaggagatcgagaccatcctggctaacatggtgaracctggtatctactaaaaatacaaaaaattagccgggcatggtggcgggcgcctgtagtcccagctactcgggaggctgaggcaggagagtggcgtgaacctgggaggcggagcttgcagtgagctgagatggcaccacggcactccagcctgggcaacagagcgagactccatctcgaaaaaaaaaaaagaagaaaaagaaagaaagaaactaacaatgagaaatttaaaaatattcactttaaaataacaacactaaatctattacattacttcatttccaacaagaattagtgagaa

SEQ ID NO: 31949 - DNA, 601 bp, Human
aacctggtggagagctggtgctcagcgcaggctcacaggactggccaaggggtccttaggcccggccctccccaagcccaacgccctgccctccttcccgctggctcctcagggtctcctgtgcctgtcctccgtgggggtgggggctgggggtgggggctcaccagggctccttccaggcaggtggcatagttgtagccccgccccatcaccagcagcgatctctgcgtgtagagctccagggccaagtcgtggatcttctcctccagagacagcacttccttgatcagctctgggccaygcacggagcagagggagaaaaccagtcaggccgactttaaagcaatattcatgaagacaaatgctggggtttaagaggagcttttgaaaccgcatcacttagcacactttgcttcctcgcattcgtttcaaacgtagattacaggaaataacttgggctcctggccaggattctgttaggatggggattcgtgttgtgtgaacactttcttgagcaccaacaaggtaggaagtaccatttctcactccgttttgcaggtaagacaactgaggctcagagaggcaaaaatcacccactgga

SEQ ID NO: 31950 - DNA, 601 bp, Human
acctctcagaagcagctcatgaggtctgagtgagctgttccaagtggaccctggcagtgcctggacagccggaggggcacaccccaggcgccctgtccctttctcctcagtagattgggagatccctgggggcaggcacctgcctcacccatctctgtgtgcccagggctagaaacctggtggagagctggtgctcagcgcaggctcacaggactggccaaggggtccttaggcccggccctccccaagcccaacgccctgccctccttcccgctggctcctcagggtctcctgtgcctgycctccgtgggggtgggggctgggggtgggggctcaccagggctccttccaggcaggtggcatagttgtagccccgccccatcaccagcagcgatctctgcgtgtagagctccagggccaagtcgtggatcttctcctccagagacagcacttccttgatcagctctgggccatgcacggagcagagggagaaaaccagtcaggccgactttaaagcaatattcatgaagacaaatgctggggtttaagaggagcttttgaaaccgcatcacttagcacactttgcttcctcgcattcgtt

SEQ ID NO: 31951 - DNA, 601 bp, Human
attcctgcaggatctcaaactccccttggaagtttgaggggtaacaaggaaactctgcggagaacccacccctcaattttggtggaaaaaagcgaaggccccatggactcaggtctgattcgggtcccctacgtcatcttgagtgagatacttaagctttcagaggctttgtttcctcctgaatgagggtgaatagcaaccgccaacctctcagaagcagctcatgaggtctgagtgagctgttccaagtggaccctggcagtgcctggacagccggaggggcacaccccaggcgccctgyccctttctcctcagtagattgggagatccctgggggcaggcacctgcctcacccatctctgtgtgcccagggctagaaacctggtggagagctggtgctcagcgcaggctcacaggactggccaaggggtccttaggcccggccctccccaagcccaacgccctgccctccttcccgctggctcctcagggtctcctgtgcctgtcctccgtgggggtgggggctgggggtgggggctcaccagggctccttccaggcaggtggcatagttgtagccccgccccatcaccagcagcgatc

SEQ ID NO: 31952 - DNA, 601 bp, Human
tcttccttcagcagactcatgcggaggcatagctgcaatgtgcatctcccgccagcacgttcagccaccgcagctcagcccccacccatgacgcagagtcatctggggactgacagtgcaccccaggccttgcctctactgcactccaagaagcagcacctgcctgttctttaacaggagtcagaatctccagggggcaggtgcaggagatggagctcagtgaggacagccctgcactccccaccaagaccaaggaaatcaactctgaatgtttccggtaaccacttgtaactggcattgkctttcttttttttttctttctttcttttttttttttttcgttgagatgggagtctcgttctgtctcccaggctggagtgcagtggcatgatcttggctcactgcaacctcctcctcttggattcaagcgattctcctgcctcagcctcccatgtagctgggattacaggcgtgcaccaccacgcccagctagtttttgaatttttggtagagatgggcttttaccatgttgtccaggctggtctcgaactcctgacctcaaatgatctgactgccttggcctcccaaagtgctgggatta

SEQ ID NO: 31953 - DNA, 601 bp, Human
gagtggttccaagcaaaatcacacaaactggggtgttatttgaattaatttttttcctgtgttcaggtagatccatctctattcagttaccacaaatccacgtcattgaaatggtgagacagtcaaataaatcatctctcgactccccgctagcactgctgatttaggtcagggccacactgtaaggagtgcggctccagtctggaggcgcagacagctgcagtgccggcctcccagtgaccagaggaccatgggctcgtgccagcagccacctaaacgcttcttccttcagcagactcakgcggaggcatagctgcaatgtgcatctcccgccagcacgttcagccaccgcagctcagcccccacccatgacgcagagtcatctggggactgacagtgcaccccaggccttgcctctactgcactccaagaagcagcacctgcctgttctttaacaggagtcagaatctccagggggcaggtgcaggagatggagctcagtgaggacagccctgcactccccaccaagaccaaggaaatcaactctgaatgtttccggtaaccacttgtaactggcattgtctttcttttttttttcttt

SEQ ID NO: 31954 - DNA, 601 bp, Human
ccaagggttgcaaggcagacagatgcctggagtgcttgacagcactgaggacacccagcaagggcctggggagaggcctggctaccatccagagcatgcaccagcccgggacacaacctctgtgtccccacaccagccccgggcactgctgttgtctctctccagtcccacgcacagccaccccttaggacaaacaagtcggagtcagcctagctcaccccctgctcctccctagccagccacgtgtataacgacagcatcgtattcagcttagctacaccttcagttaattatctgattragcatttgcccattaataacttctaaagagtggttccaagcaaaatcacacaaactggggtgttatttgaattaatttttttcctgtgttcaggtagatccatctctattcagttaccacaaatccacgtcattgaaatggtgagacagtcaaataaatcatctctcgactccccgctagcactgctgatttaggtcagggccacactgtaaggagtgcggctccagtctggaggcgcagacagctgcagtgccggcctcccagtgaccagaggaccatgggctcgtgccagcagccacc

SEQ ID NO: 31955 - DNA, 601 bp, Human
ctggaaacaggaggtgagatcagagtcacactgggcagatggggctggagcagatcagccagaggggaagaaggggaaccaggggaaggatgactctggaaggcagagagccaagggttgcaaggcagacagatgcctggagtgcttgacagcactgaggacacccagcaagggcctggggagaggcctggctaccatccagagcatgcaccagcccgggacacaacctctgtgtccccacaccagccccgggcactgctgttgtctctctccagtcccacgcacagccaccccttaggamaaacaagtcggagtcagcctagctcaccccctgctcctccctagccagccacgtgtataacgacagcatcgtattcagcttagctacaccttcagttaattatctgattaagcatttgcccattaataacttctaaagagtggttccaagcaaaatcacacaaactggggtgttatttgaattaatttttttcctgtgttcaggtagatccatctctattcagttaccacaaatccacgtcattgaaatggtgagacagtcaaataaatcatctctcgactccccgctagcactgctgat

SEQ ID NO: 31956 - DNA, 601 bp, Human
gatgtgtgggtggacccctggcttgcaacaggtgcctgaatcgagggcagtcttatggaaagctgtgcccctgccctatgagacctgacctaactccaggtagttcccatcggagctgcttggccgcagaacctggggaaaccctgccccagggatgtccaccaggagtacctcccctgagctccaggctaggatctggtgctgctcacagcagtgtgggtccctgggccccaccaaagagctgtgtgggacagctgcgggctgaccagctcctttccaagtgtgtgcactccccacaggsggcccgggggagggtgtgtggtcacagccactcactggccagaccatccatcactggtactggcagacagtggtgaggtgggcatgcatggggaaaagcaggagagagctggcccagtccagtggagagccctcacctggcgggccgtgacttgctgcagggcgttctggcatttggcgaagcaaggatccttcataatgaccatgatgacgggcatctgcttgtcaatcagtgccaggggcccgtgcttcagctccccagccaggatgccttctgagtgcatgtaggttatctctttaa

SEQ ID NO: 31957 - DNA, 601 bp, Human
gacactggagctagcagctcaggggagctcccgggcgacacacagtgacgtgctgggagggtgacacatcctgaggacacaagcttcacatctggggccctcaaactaggggtctcttcttttgggttggctgtgatttatatcttttataataaaactgtaatcatatagtcatctcctgagttctatgggtcgttctagaaaattactgaacttcaggggagagtgggaatccttggattcatagtcagttgctcagatgtgtgggtggacccctggcttgcaacaggtgcctgaatcragggcagtcttatggaaagctgtgcccctgccctatgagacctgacctaactccaggtagttcccatcggagctgcttggccgcagaacctggggaaaccctgccccagggatgtccaccaggagtacctcccctgagctccaggctaggatctggtgctgctcacagcagtgtgggtccctgggccccaccaaagagctgtgtgggacagctgcgggctgaccagctcctttccaagtgtgtgcactccccacaggcggcccgggggagggtgtgtggtcacagccactcactggccag

SEQ ID NO: 31958 - DNA, 601 bp, Human
tatttatgggaggtcccttggactatacctaactttatgctaaggtgacgactcgtggtgggcctgtagatagttccaggatggcgtctggccctgctagaaaggccagccacatgattagaaggttggggctttgagacatgagcctgtcagtctgacctcccaacctccaaggacaaaagtggggctggcgactgagtttgatcacatggccaatggttcactccatcctgcctacttaataaaaccacaatacaaactctggacactggagctagcagctcaggggagctcccgggcracacacagtgacgtgctgggagggtgacacatcctgaggacacaagcttcacatctggggccctcaaactaggggtctcttcttttgggttggctgtgatttatatcttttataataaaactgtaatcatatagtcatctcctgagttctatgggtcgttctagaaaattactgaacttcaggggagagtgggaatccttggattcatagtcagttgctcagatgtgtgggtggacccctggcttgcaacaggtgcctgaatcgagggcagtcttatggaaagctgtgcccctgccctat

SEQ ID NO: 31959 - DNA, 601 bp, Human
cagctgctgtgtacaaagcatttggttggtctttgtggccggttccaggaagggagctcctggcttctggactttcccatgtgacaaaagcatctttgttatttatgggaggtcccttggactatacctaactttatgctaaggtgacgactcgtggtgggcctgtagatagttccaggatggcgtctggccctgctagaaaggccagccacatgattagaaggttggggctttgagacatgagcctgtcagtctgacctcccaacctccaaggacaaaagtggggctggcgactgagttygatcacatggccaatggttcactccatcctgcctacttaataaaaccacaatacaaactctggacactggagctagcagctcaggggagctcccgggcgacacacagtgacgtgctgggagggtgacacatcctgaggacacaagcttcacatctggggccctcaaactaggggtctcttcttttgggttggctgtgatttatatcttttataataaaactgtaatcatatagtcatctcctgagttctatgggtcgttctagaaaattactgaacttcaggggagagtgggaatccttg

SEQ ID NO: 31960 - DNA, 601 bp, Human
ggcaacatctggatggggcacctcattggatttcacctccccgaaacttcatgaactctgccctcctacctcagggcagctgctgtgtacaaagcatttggttggtctttgtggccggttccaggaagggagctcctggcttctggactttcccatgtgacaaaagcatctttgttatttatgggaggtcccttggactatacctaactttatgctaaggtgacgactcgtggtgggcctgtagatagttccaggatggcgtctggccctgctagaaaggccagccacatgattagaaggytggggctttgagacatgagcctgtcagtctgacctcccaacctccaaggacaaaagtggggctggcgactgagtttgatcacatggccaatggttcactccatcctgcctacttaataaaaccacaatacaaactctggacactggagctagcagctcaggggagctcccgggcgacacacagtgacgtgctgggagggtgacacatcctgaggacacaagcttcacatctggggccctcaaactaggggtctcttcttttgggttggctgtgatttatatcttttataataaaactgta

SEQ ID NO: 31961 - DNA, 601 bp, Human
ctgtggcttgacaggcaggtatgggagggttttaagtggggaaatgatgccattgtgttttataccctcactctgacctctgtgctgagccaggtggcaacatctggatggggcacctcattggatttcacctccccgaaacttcatgaactctgccctcctacctcagggcagctgctgtgtacaaagcatttggttggtctttgtggccggttccaggaagggagctcctggcttctggactttcccatgtgacaaaagcatctttgttatttatgggaggtcccttggactatacctractttatgctaaggtgacgactcgtggtgggcctgtagatagttccaggatggcgtctggccctgctagaaaggccagccacatgattagaaggttggggctttgagacatgagcctgtcagtctgacctcccaacctccaaggacaaaagtggggctggcgactgagtttgatcacatggccaatggttcactccatcctgcctacttaataaaaccacaatacaaactctggacactggagctagcagctcaggggagctcccgggcgacacacagtgacgtgctgggagggtgacac

SEQ ID NO: 31962 - DNA, 601 bp, Human
gcggagcttgcagtgagccgagatggcgccactgcactccagcctgggcgacagagccagactccgtcacaaaaaaaaaaaaaaaatgaattccaaagaaatgccaccaaggctagaaaacaggataatgtcattgggagactggtgaggtctccaaagctctctcaaaaacaggagacatctggactgaaccctaaatgatgaggggacaaccctcggcggagcattctgtgggaagggcattccagacagcaggagcggccagcgcaaaggcccggaggcgggcgcgggcgcaatgagmgtgggacgcagaaggaaagctggagtgcctggaactcactgaaacaggaggaaagggccagataacgcaggactgtgggtctctgtggcttgacaggcaggtatgggagggttttaagtggggaaatgatgccattgtgttttataccctcactctgacctctgtgctgagccaggtggcaacatctggatggggcacctcattggatttcacctccccgaaacttcatgaactctgccctcctacctcagggcagctgctgtgtacaaagcatttggttggtctttgtggccggttcca

SEQ ID NO: 31963 - DNA, 601 bp, Human
ccaggccgggcgtggtggctcacgcctgtaatcccaacactttgggaggctgaggcgggtggatcacgaggtcaggagatcgagaccatcctggctaacatggtgaaaccctgtctctactaaaaaatacaaaaaattagccgggtgtggtggcgggggcctgtagtcccagctactggggaggctgaggcaggagaatggcgtgaacctgggaggcggagcttgcagtgagccgagatggcgccactgcactccagcctgggcgacagagccagactccgtcacaaaaaaaaaaaaaaaatgaattccaaagaaatgccaccaaggctagaaaacaggataatgtcattgggagactggtgaggtctccaaagctctctcaaaaacaggagacatctggactgaaccctaaatgatgaggggacaaccctcggcggagcattctgtgggaagggcattccagacagcaggagcggccagcgcaaaggcccggaggcgggcgcgggcgcaatgagagtgggacgcagaaggaaagctggagtgcctggaactcactgaaacaggaggaaagggccagataacgcaggactgtgggtctctg

SEQ ID NO: 31964 - DNA, 601 bp, Human
agaaataaagatgaattccaggccgggcgtggtggctcacgcctgtaatcccaacactttgggaggctgaggcgggtggatcacgaggtcaggagatcgagaccatcctggctaacatggtgaaaccctgtctctactaaaaaatacaaaaaattagccgggtgtggtggcgggggcctgtagtcccagctactggggaggctgaggcaggagaatggcgtgaacctgggaggcggagcttgcagtgagccgagatggcgccactgcactccagcctgggcgacagagccagactccgtcwcaaaaaaaaaaaaaaaatgaattccaaagaaatgccaccaaggctagaaaacaggataatgtcattgggagactggtgaggtctccaaagctctctcaaaaacaggagacatctggactgaaccctaaatgatgaggggacaaccctcggcggagcattctgtgggaagggcattccagacagcaggagcggccagcgcaaaggcccggaggcgggcgcgggcgcaatgagagtgggacgcagaaggaaagctggagtgcctggaactcactgaaacaggaggaaagggccagataacgc

SEQ ID NO: 31965 - DNA, 601 bp, Human
ccaagaaataaagatgaattccaggccgggcgtggtggctcacgcctgtaatcccaacactttgggaggctgaggcgggtggatcacgaggtcaggagatcgagaccatcctggctaacatggtgaaaccctgtctctactaaaaaatacaaaaaattagccgggtgtggtggcgggggcctgtagtcccagctactggggaggctgaggcaggagaatggcgtgaacctgggaggcggagcttgcagtgagccgagatggcgccactgcactccagcctgggcgacagagccagactccrtcacaaaaaaaaaaaaaaaatgaattccaaagaaatgccaccaaggctagaaaacaggataatgtcattgggagactggtgaggtctccaaagctctctcaaaaacaggagacatctggactgaaccctaaatgatgaggggacaaccctcggcggagcattctgtgggaagggcattccagacagcaggagcggccagcgcaaaggcccggaggcgggcgcgggcgcaatgagagtgggacgcagaaggaaagctggagtgcctggaactcactgaaacaggaggaaagggccagataa

SEQ ID NO: 31966 - DNA, 601 bp, Human
accaagaaataaagatgaattccaggccgggcgtggtggctcacgcctgtaatcccaacactttgggaggctgaggcgggtggatcacgaggtcaggagatcgagaccatcctggctaacatggtgaaaccctgtctctactaaaaaatacaaaaaattagccgggtgtggtggcgggggcctgtagtcccagctactggggaggctgaggcaggagaatggcgtgaacctgggaggcggagcttgcagtgagccgagatggcgccactgcactccagcctgggcgacagagccagactcmgtcacaaaaaaaaaaaaaaaatgaattccaaagaaatgccaccaaggctagaaaacaggataatgtcattgggagactggtgaggtctccaaagctctctcaaaaacaggagacatctggactgaaccctaaatgatgaggggacaaccctcggcggagcattctgtgggaagggcattccagacagcaggagcggccagcgcaaaggcccggaggcgggcgcgggcgcaatgagagtgggacgcagaaggaaagctggagtgcctggaactcactgaaacaggaggaaagggccagata

SEQ ID NO: 31967 - DNA, 601 bp, Human
caagcaaaccaagaaataaagatgaattccaggccgggcgtggtggctcacgcctgtaatcccaacactttgggaggctgaggcgggtggatcacgaggtcaggagatcgagaccatcctggctaacatggtgaaaccctgtctctactaaaaaatacaaaaaattagccgggtgtggtggcgggggcctgtagtcccagctactggggaggctgaggcaggagaatggcgtgaacctgggaggcggagcttgcagtgagccgagatggcgccactgcactccagcctgggcgacagagcsagactccgtcacaaaaaaaaaaaaaaaatgaattccaaagaaatgccaccaaggctagaaaacaggataatgtcattgggagactggtgaggtctccaaagctctctcaaaaacaggagacatctggactgaaccctaaatgatgaggggacaaccctcggcggagcattctgtgggaagggcattccagacagcaggagcggccagcgcaaaggcccggaggcgggcgcgggcgcaatgagagtgggacgcagaaggaaagctggagtgcctggaactcactgaaacaggaggaaaggg

SEQ ID NO: 31968 - DNA, 601 bp, Human
tcatagtctagtggtagaaaacaaaaacctagacaagcaaaccaagaaataaagatgaattccaggccgggcgtggtggctcacgcctgtaatcccaacactttgggaggctgaggcgggtggatcacgaggtcaggagatcgagaccatcctggctaacatggtgaaaccctgtctctactaaaaaatacaaaaaattagccgggtgtggtggcgggggcctgtagtcccagctactggggaggctgaggcaggagaatggcgtgaacctgggaggcggagcttgcagtgagccgagatkgcgccactgcactccagcctgggcgacagagccagactccgtcacaaaaaaaaaaaaaaaatgaattccaaagaaatgccaccaaggctagaaaacaggataatgtcattgggagactggtgaggtctccaaagctctctcaaaaacaggagacatctggactgaaccctaaatgatgaggggacaaccctcggcggagcattctgtgggaagggcattccagacagcaggagcggccagcgcaaaggcccggaggcgggcgcgggcgcaatgagagtgggacgcagaaggaaagctgga

SEQ ID NO: 31969 - DNA, 601 bp, Human
ttactctatgactatttactccaagtatttaaagaacagaaaggaactctggggttatgtctctcctctctgctgttaggtgcagtttttagacgcacgtcatatcctcggagaacagccaggtggaaggacagcagctgcagcggaatcacgctcaggatgccctggaggcagtccacagtgtggggcagctcaattgtcttatacgcaaacttggaactttcagtatcgtccttggagcacagtataatggggcgaccctagagcagagaaatagcatcataaaatagaccctctctgraagaagctatccctgatgcatacagagtatctggaagctacattactgtgatgagaacagtcctcttttgcatttgctggagtcatgggtgaggtggtatgtgtgggacacaaatgcttggaaaggataaagtgtctgatgctttttgggggtttcttccccttccctggtaaggagattgccatcctgctgcatcatttggcacccatttgtgccttgccgagagcggggcagactcactcctaactctagcggggctcatagtctagtggtagaaaacaaaaacctagacaagcaaac

SEQ ID NO: 31970 - DNA, 601 bp, Human
ggagcttgcagtgagccgaggttgtgccactgccctccagcctgggcgacagagcgagactcaatctcaaaaaaaaaaaaaagaaagctactttaaataaaattatttactctatgactatttactccaagtatttaaagaacagaaaggaactctggggttatgtctctcctctctgctgttaggtgcagtttttagacgcacgtcatatcctcggagaacagccaggtggaaggacagcagctgcagcggaatcacgctcaggatgccctggaggcagtccacagtgtggggcagctcrattgtcttatacgcaaacttggaactttcagtatcgtccttggagcacagtataatggggcgaccctagagcagagaaatagcatcataaaatagaccctctctgaaagaagctatccctgatgcatacagagtatctggaagctacattactgtgatgagaacagtcctcttttgcatttgctggagtcatgggtgaggtggtatgtgtgggacacaaatgcttggaaaggataaagtgtctgatgctttttgggggtttcttccccttccctggtaaggagattgccatcctgctgca

SEQ ID NO: 31971 - DNA, 601 bp, Human
cacctgtaatcccagcactttgggaggctgaggcaggtggatcacgaggtcagatcaaggtcatcctggctaacacggtgaaaccccgtctctacaaaaaatacaaaaaattagccaggcatggtggcgggtgcttgtagtcccagctactcgggaggctgaggcaggagaatcgcttgaacccaggaggtggagcttgcagtgagccgaggttgtgccactgccctccagcctgggcgacagagcgagactcaatctcaaaaaaaaaaaaaagaaagctactttaaataaaattatttaytctatgactatttactccaagtatttaaagaacagaaaggaactctggggttatgtctctcctctctgctgttaggtgcagtttttagacgcacgtcatatcctcggagaacagccaggtggaaggacagcagctgcagcggaatcacgctcaggatgccctggaggcagtccacagtgtggggcagctcaattgtcttatacgcaaacttggaactttcagtatcgtccttggagcacagtataatggggcgaccctagagcagagaaatagcatcataaaatagaccctctctgaaag

SEQ ID NO: 31972 - DNA, 601 bp, Human
aaagcacttgggtagaaggcacgtggaagctgtcaagctctacaggagcacgcagaacatgtgggatgtccacttctcttcccatgtagcatccctgctgttgggacaggtctggaatcagatgaaaggtggtgatggtcttgtcacggtctcagcctcattccacagttacagacttggccagatttctggggaagtcaacctaaaatgaaagaaagtgactgttcaggaccccaaagatctcagcaacatgctacctctcacagacaattttcagagtacttaaaaacaagagacagaygttcaccatggtcaccaacctagagacctgcgtcttggaggcagattccttagtccagaagcctcatttaaccgtataaggtttagtccctcaataaacatttactgtgcacctgatgtgtgtcatgatctgttaacatgatttaaagaataaggttcatgcttttaaacacaggtaacttggtgtgtactgttaaaaattaacttttcttgcaagaatatatatgaattccatgggacttatttgtttagggtggagtgggaaggaaaggtaggaatggttcataagtacgcttctact

SEQ ID NO: 31973 - DNA, 601 bp, Human
cacaaaaagaatgaggttaacaaaatgcaaacacacacaaaaaaactgtatgttctttattgtcctaaaattgcatagtacttttgattgtgcacgcttttaaatagagagcagagttgcccacttgaaactactctcttgcatgggatatttcaagctgttttactatgggcaaggagcagggaccaaaatgctgccagggcttaaaaagagccgtgatcagattaaacagaagttggagaagtggagggatgtgggccacacacgagaagaaaatgttgaaggaggctgagatttcaaytggacttataggaggcataggtggatgcaggaggggctccacggatgtcagagaacaggattcaggagcagcctagagaggaaagaaaaggagaaaggagtccagagggccaatgccttgtgctcacatctgagatgaatgccacctgccaggagcaagcctggacacagagcatgggtagctaggatgaacagtttggccgttaccacggctacagaaagccacatactagaaaaataacttaaaagctatacagtcgtcattataaatatcttgtcttttaaaactaactctagtgtt

SEQ ID NO: 31974 - DNA, 601 bp, Human
ccacccactgttaacattctgatctatgtacttctaatattttctccattttcatatgtacacatacatttatttacatgcatatataaatatcaaagtgtatatatataattttctctgccatttaaatttttactgtgtaacaatcatggattgtaaaaaaagtgaataaaatgtacgcagtcagtttaaagactaacaaaatatgcattaaatcaccagccaggttaagaagaaatactattacttataccctggcatctccctcccacctttacatagccaaatccagaaaagatcygttttcctaaccttgttcgcctattttattatttaaattgcagcaggagggaagcatgtctactttatccaatttcacacagacgctggaagacgtcttccgaaggatttttattacttatatggacaattggcgccagaacacaacagctgagcaagaggccctccaagccaaagttgatgctgagaacttctactatgtcatcctgtacctcatggtgatgattggaatgttctctttcatcatcgtggccatcctggtgagcactgtgaaatccaagagacgggaacactccaatga

SEQ ID NO: 31975 - DNA, 601 bp, Human
atataatgagatcctaggagaatcctaggtcaaatccagcgccatgttgggtccagtgggtcttagccagcttgatccacactatgggttttcagggtcatatcagcccctagtttctgcagctatttcaacagtttccttttgctagtcatgtgaaactgctgcctggaattttctgttctcctgtgaccatcctgtattagtcctatctaaccaccaccaccactgccaccaacaacagtaataattatcataataaatcattacaaatatggcccccttggttgggcatggtggctcmtgcctgtgatcccagcactttgggagggggaggcaggaggatcactagagcccaggagttcaacaccagcctggcaatataaggagggcccttctctacaaaaaaactcaaaaaattagctgggcttagtggcttgggcttgtgatcccagctacttgggaggctgaggtagggggatactttgagccagggaggttgaggctgccctgagctgtgattgtgccactgcactccagcctcgatgacagagtgagagtctatttcaaaaacaaaacaacaacaacaaaaaaacccaacaca

SEQ ID NO: 31976 - DNA, 601 bp, Human
gataaacaccatcccaaattagagttcattcccatgaaacttttaataccataactacatatacatgtacatattgttatgcatggtctcaaacagcataaaatgaaatcatactgtatacattcttctgcaatatgtttttgtctcttaacattatgtttttgagatttatccatgttgatatggtgagctctagtgcattaattttaactgcatggtagtctattgcatcactatatcagaagatgggaatattgatggaacatttaaattgcctacaattcttttatattgcaatatwaaaatgctgcaatgaatattcctctcatgtctcattgtgcatatttgctagcatttctctagaatatgacaagaactggaatttccacattgatggggatgcttctcttcaaatcaactagaaattttgccatactgctctctgaaatgaatgcagaaattagcattcctttcagcaatgtacaagacttccttttgctccatattctcaccaacacttgctatagtaagactattccatttttctaattaagtgtgtctaaacagtatcttatactgcatgtgtgtttgtttcctgtct

SEQ ID NO: 31977 - DNA, 601 bp, Human
agaagcttttgcttcatcattgatgtaagctgtgtaccactgccacggaagtgtgtagatgaggtctgtgagggtcaccttgacacaaagaagttgagcattgagttccaggtgctcttttatacctctctagtcatgcatgctctaggcctgcaagccaattcacagcttcccaaaccaggtatcatcgtgggttgggaaattaattagacacaactttccacgtttttcttactactgtagtcaccaagataagaatgaccttgaggtcattcttaggcaggccagcatcagctctggyctgatgttaccttttgcttacaaacaattcattttgtatatgggtttgaaatttatgagagaggccgggtacggtggcttacccctgaaatcccggcactttggaaggctgaggcgggtggatcacctgaggtcaggagttcgagaccagcctgatcaacatggtgaaaccccatctctactaaattaaaaaaaaaattagctgggcatgattgcacatgcctgtaatcccagctacttgggagactgaggcaggagaatcgcttgaacccgggaggtggtggttgcagtgagccgagat

SEQ ID NO: 31978 - DNA, 601 bp, Human
tgtcttcatctttagtacagcgggcccctgtgaatattaactatggcaatgaataaaagggtgtttcatgcagggcagattttcaataagtgttggttcctgttttccagaggaagaaatattttgatatcaagtatgggagagagataaaaggcaataagacagtaaccaaacctcataaaggtaaaaaagtcaagttcaaaagtagtaggttgttttgtctgatgtacagaaaggagtatttagacaatgattgtttccttccccccaaaactatccaaataaagttaacttttttttyccaaaactcaggcaaacaaaataaataaataaataaataaataaataaataaataaaattccaaccagataagatgctagaaattaaaatgccttactctctgcatttgtctcaggccattgatcattttgcttttgttcaagacaaatgttgagcataaatattgagtaaaataacttttgtttcatttaggaactgatgagaaaatgctcatcagcattctgactgagaggtcaaatgcacagcggcagctgattgttaaggaatatcaagcagcatatggaaaggtaaggtcacatt

SEQ ID NO: 31979 - DNA, 601 bp, Human
ggggaacaaccatttctcacagtggaataggatgagagctgtgaaataagattcagctgcagtggcttggattgaggacagatggtagtgaaatttaccatttagagaggaaaaaaacactgtggcaattaaagcagagttgataacactgaatgccaccccatttgtttcagcaggaacatgccactgctgcaccccccaggagtgtggttgtgtcaatctgtgcccacagcgtttcagcaggctcagaggctaccagcctctatttcagagctgaaaataatcaggagcaggaacaaayattattcagtattatgccattgaatattgaaaatagaaaccctgttacccccctttaagcaggggagatggactgtacttaggtgtgaaaacagtgctcaaaacaatatcaataggtaatgtctgtaagaggctaaattctagtgttccatcgccctgtaggataactatagttaacaataatatagtttcaaatagctagaaggaggatattgaatattcctaaaacaaaaaaatgttacatgtttgagatgatgggtatgcaattaccctgatctgattaccatacattatatgtatt

SEQ ID NO: 31980 - DNA, 601 bp, Human
ccatttctcacagtggaataggatgagagctgtgaaataagattcagctgcagtggcttggattgaggacagatggtagtgaaatttaccatttagagaggaaaaaaacactgtggcaattaaagcagagttgataacactgaatgccaccccatttgtttcagcaggaacatgccactgctgcaccccccaggagtgtggttgtgtcaatctgtgcccacagcgtttcagcaggctcagaggctaccagcctctatttcagagctgaaaataatcaggagcaggaacaaacattattcartattatgccattgaatattgaaaatagaaaccctgttacccccctttaagcaggggagatggactgtacttaggtgtgaaaacagtgctcaaaacaatatcaataggtaatgtctgtaagaggctaaattctagtgttccatcgccctgtaggataactatagttaacaataatatagtttcaaatagctagaaggaggatattgaatattcctaaaacaaaaaaatgttacatgtttgagatgatgggtatgcaattaccctgatctgattaccatacattatatgtattgaaacatca

SEQ ID NO: 31981 - DNA, 601 bp, Human
agttgataacactgaatgccaccccatttgtttcagcaggaacatgccactgctgcaccccccaggagtgtggttgtgtcaatctgtgcccacagcgtttcagcaggctcagaggctaccagcctctatttcagagctgaaaataatcaggagcaggaacaaacattattcagtattatgccattgaatattgaaaatagaaaccctgttacccccctttaagcaggggagatggactgtacttaggtgtgaaaacagtgctcaaaacaatatcaataggtaatgtctgtaagaggctaarttctagtgttccatcgccctgtaggataactatagttaacaataatatagtttcaaatagctagaaggaggatattgaatattcctaaaacaaaaaaatgttacatgtttgagatgatgggtatgcaattaccctgatctgattaccatacattatatgtattgaaacatcactatgtaccttatgaataagtacaattattatttgtcagaaaaaataagtctaatgtattgccacacttagggttttcttttctttacttgttgccagaaaattgcttctgatgccacctagttccac

SEQ ID NO: 31982 - DNA, 601 bp, Human
acatgtttgagatgatgggtatgcaattaccctgatctgattaccatacattatatgtattgaaacatcactatgtaccttatgaataagtacaattattatttgtcagaaaaaataagtctaatgtattgccacacttagggttttcttttctttacttgttgccagaaaattgcttctgatgccacctagttccacattctcaccagagacaaatgaccagccactgtcctcccttccccttcctcttggagctctttgggagttactgagaggcaagacaccgaggaagagagcaccwcccactgaagctgggcgtgaatttataagggttcctcttcctcttcccttaccccaatctaagcattgaaagcatggcggatctaggaaatgcatttgaatacagttcctaactgtggcactcatggaatcctcccatttggctctccttcaaaaaacctctacaaaacagaacaatttgggagtaattagaaaatgcagattaatattcatagaaatattttcaacacttctgtttattccctgtggatggacatgttttgtctgattttgatacatatgttcatctttcactaggtga

SEQ ID NO: 31983 - DNA, 601 bp, Human
tgtattgccacacttagggttttcttttctttacttgttgccagaaaattgcttctgatgccacctagttccacattctcaccagagacaaatgaccagccactgtcctcccttccccttcctcttggagctctttgggagttactgagaggcaagacaccgaggaagagagcacctcccactgaagctgggcgtgaatttataagggttcctcttcctcttcccttaccccaatctaagcattgaaagcatggcggatctaggaaatgcatttgaatacagttcctaactgtggcactcrtggaatcctcccatttggctctccttcaaaaaacctctacaaaacagaacaatttgggagtaattagaaaatgcagattaatattcatagaaatattttcaacacttctgtttattccctgtggatggacatgttttgtctgattttgatacatatgttcatctttcactaggtgactttagagaaagagaaaaaaagtatttcacatttttccccttggttttttgattttaggagctgaaagatgacttgaagggtgatctctctggccactttgagcatctcatggtggccctagtg

SEQ ID NO: 31984 - DNA, 601 bp, Human
ttgggagttactgagaggcaagacaccgaggaagagagcacctcccactgaagctgggcgtgaatttataagggttcctcttcctcttcccttaccccaatctaagcattgaaagcatggcggatctaggaaatgcatttgaatacagttcctaactgtggcactcatggaatcctcccatttggctctccttcaaaaaacctctacaaaacagaacaatttgggagtaattagaaaatgcagattaatattcatagaaatattttcaacacttctgtttattccctgtggatggacatgytttgtctgattttgatacatatgttcatctttcactaggtgactttagagaaagagaaaaaaagtatttcacatttttccccttggttttttgattttaggagctgaaagatgacttgaagggtgatctctctggccactttgagcatctcatggtggccctagtgactccaccagcagtctttgatgcaaagcagctaaagaaatccatgaaggtatgagccccccacaagccatttctgcccagggtttgaccaagtcatcaaaaatagtgactttcttgcagtgcacacttgtgatg

SEQ ID NO: 31985 - DNA, 601 bp, Human
tcctcccatttggctctccttcaaaaaacctctacaaaacagaacaatttgggagtaattagaaaatgcagattaatattcatagaaatattttcaacacttctgtttattccctgtggatggacatgttttgtctgattttgatacatatgttcatctttcactaggtgactttagagaaagagaaaaaaagtatttcacatttttccccttggttttttgattttaggagctgaaagatgacttgaagggtgatctctctggccactttgagcatctcatggtggccctagtgactccrccagcagtctttgatgcaaagcagctaaagaaatccatgaaggtatgagccccccacaagccatttctgcccagggtttgaccaagtcatcaaaaatagtgactttcttgcagtgcacacttgtgatgggtggacttggatgcccttttggtctggactctcccagtggtagaatgactctgaaataggcaacagctatagaaccttaagcccaaatgttcctgggctggaagaattttgtcatatcctttgtttgacatgaagagtcaagttctctaatttgtcatcgttgaaagtaaa

SEQ ID NO: 31986 - DNA, 601 bp, Human
ttttgtcatatcctttgtttgacatgaagagtcaagttctctaatttgtcatcgttgaaagtaaatagcactatgattaaccccaacactcaagctaaaaacctagcattatccttgagcccttgttttctcttacccttccaagctcccaaatctatcagcaagttccttagttttacttcaaaatccattataaatatgtgcacttctctcaaaatccattgctactgttctagtctgaccaccatcatctcttgactggtccatatcaataggcttctaactggtccctttgcctccrtttttgcccatctcaaattcattctacacagaatagccaaaattatttttattaatttattttaaaaatcagattatgctacttacctgcataaatttccaatggctttgtacgcttaaaatccaagcttcttatcatgactttcatcacccaacatagtgcagctcctgtctaactctgtgactttttaaaattctatttatatcagtcagggttccctcagagaagcagaaccaataggcaggacatagactttaaaagatttattgtaaggccaggtgctgtggctcttgcctgtaa

SEQ ID NO: 31987 - DNA, 601 bp, Human
ttgtacgcttaaaatccaagcttcttatcatgactttcatcacccaacatagtgcagctcctgtctaactctgtgactttttaaaattctatttatatcagtcagggttccctcagagaagcagaaccaataggcaggacatagactttaaaagatttattgtaaggccaggtgctgtggctcttgcctgtaatcccaatactttgggaggccaaggtaggtagattgcttgagctcaggagtttgaaatcagcctgggcaacttggagaaaccctgtctctacaaaaaataaaaaaaaaattagctgtgcatagtagtgcattcctgtagtcccagctacttgggaggctgtggtgggaggatcacctgagcccagaaggtcaaggctgcagtgagctgtgattgtgccactgcacttcagtctgggtgacagtgagaccctgtctcaaaacaacaacaacaaaaatttattggaaagaattggaggccatggtgggaggattgcttgggctcaggagttcaaaaccagcctcaaactgagcaacatagtgagaacttgtctctacaaaaaatttttaaaaattagccaggcatggtggc

SEQ ID NO: 31988 - DNA, 601 bp, Human
gcccagaaggtcaaggctgcagtgagctgtgattgtgccactgcacttcagtctgggtgacagtgagaccctgtctcaaaacaacaacaacaaaaatttattggaaagaattggaggccatggtgggaggattgcttgggctcaggagttcaaaaccagcctcaaactgagcaacatagtgagaacttgtctctacaaaaaatttttaaaaattagccaggcatggtggctcatgcctgtagtcccagctatttgggaggctgaggtgggagaatcacttaagcccagcaggtctaggctrcaatgagccatgaccgtgccactgcactccagcctgggatgctgtctcagaaaaaaaaaaaaaaagaagaagaagaagaagaaagaagaattggttacatgattatgggactggttaggcaagttcaaaatctgtagagcaggctgtcaggaaaggcaggctggaactcttgggcacaagctgaagctgctgtccacagaaagaatcttctaaacagaagccttgcctctggtcttaaggcgtttcaactgattggatcaggtctgccgagaaaggtaatctcccttacttaaagtgaat

SEQ ID NO: 31989 - DNA, 601 bp, Human
tgagaccctgtctcaaaacaacaacaacaaaaatttattggaaagaattggaggccatggtgggaggattgcttgggctcaggagttcaaaaccagcctcaaactgagcaacatagtgagaacttgtctctacaaaaaatttttaaaaattagccaggcatggtggctcatgcctgtagtcccagctatttgggaggctgaggtgggagaatcacttaagcccagcaggtctaggctacaatgagccatgaccgtgccactgcactccagcctgggatgctgtctcagaaaaaaaaaaaaraagaagaagaagaagaagaaagaagaattggttacatgattatgggactggttaggcaagttcaaaatctgtagagcaggctgtcaggaaaggcaggctggaactcttgggcacaagctgaagctgctgtccacagaaagaatcttctaaacagaagccttgcctctggtcttaaggcgtttcaactgattggatcaggtctgccgagaaaggtaatctcccttacttaaagtgaatcgataataaactgaaattatatctacaaaataccttcacagcaacacctagattagtgtttga

SEQ ID NO: 31990 - DNA, 601 bp, Human
cctctcaaagtactggaattacaggtgtaagccactgcacctggccttttctatttttaaaatccatttgtttattatcttttttcatctaactaaaaggcaaacctccaccatggcagggaacctcattggtcttggcctatatcttctgttcctagagcaactcctgaaatgaagtgggtgctcaacgtattaattaataggaaggaggaaaaagaagggagcctagatctgaggcataagccatattctgccttgccatcagggaatggagttatcttcttttctgtggaggacataygggcatctgagaagcagatggcaagatggaatttgatgtacaggagatttattttgagaaacacctgtgaaggataaagaggcgaagagcagggtaggtggggtgaaccttcagactgcagtggtggcctgacccctatgagaggagagaggagaggaagtaggctgagattaggaagagcctcagtgcatagtgaagctccgagaaaaccttggtaggctgttggggagcccctgagcaaagactgccctttggaggagttctgtgttgggcgcaagtccagtacccctgttgtttaca

SEQ ID NO: 31991 - DNA, 601 bp, Human
aaagagtaaaggacaaagaagggttcactccctcactctaaggatactccctgagcatacatatggtacttctgcatatatcccattggtcagagtttagtttctggacatatttcactgtaaaagaagctgagaaacatagcctttatatgggtagcaatgtaccaagttaaaagttgggggttccattactaagcaagaaagacaaaagagatactgtggtaaactaggaatctctgctacagagagacagaattcagtctctgttcatatgctgcactggccttattcaatcaagtcktagtgtatatgacttttcttggagtcacagtgtgattcagtgaccttgatataaacaggactgagaggtaattagtccccatgccagccaggcccatgatgcacattactgaggatttgaaaggctccctgtatgaagagaatgatacatgctgatagacccagtacagtgatgcaaggatgaaatcattcaaaagtattatagagccttttctaaacatagtggaatgtttgaatgttggtagggttaatcctgttagactgtcacttctaatcttgaatgacacaggctttttctttt

SEQ ID NO: 31992 - DNA, 601 bp, Human
ttaatcctgttagactgtcacttctaatcttgaatgacacaggctttttcttttatactatttctttccagaattattcaattgattttcacactagagtgaaaaatttgctgtcactttattccagatgatttatgttattactaaaatatatggaaaaatagaaaacgagagcaatagagaaccttgtattgatttacttaaaagtgtcctttcatctatataaacaagataataagaccaaaaggcatgagattaagttatttaagtgttctaaaaattagattttcttttccttttyagggcgcgggaacaaacgaagatgccttgattgaaatcttaactaccaggacaagcaggcaaatgaaggatatctctcaagcctattatacaggtgtcttattttctgcttaccttcaccactgttcacacatatttgagccaatgttgcttttcctagaatcctctcaatctcttcatgaggcattttgagaagacaagacttacagaaacgagaatacattctaaaatcagctaaagactatgagtttccaggaaaaattggaatatgatctgagctagagactgctacataacaata

SEQ ID NO: 31993 - DNA, 601 bp, Human
acaagctcaggtgttttcaggctacacgtgcttttaaccagctggctacaaattcagggttctcactaccctctcaggttgaatagcacactagaatgacacagaactcaagaaagtgctgtgttcacaaatgcgatattatcataaaggaaacaaatcagggccaatccaatgtggagactgcatatggagatatttggaagggtccagtggaagcttccactctcctgaccattgatatatcattaccaaccagcaagctcacttgattattggtagccttagtttttattggggtttygttatataagcatgattggttgaaccattgttcatgtgattgaaccagtccacctacactccccagaggtcaggctgatattgtggctcaaagcctcaaccttttaatcatatggttgatctttctgatgtgaccagcctttattctgggtcatattgttagcataactgagctgtagtccaagagaccaaccatgaataacaaggacacacctatgacttgggaaatccaaagaatttagagtttacctcccaggaatcaggaataagaccagcccaattctctactattcaatggccc

SEQ ID NO: 31994 - DNA, 601 bp, Human
tgatatatcattaccaaccagcaagctcacttgattattggtagccttagtttttattggggttttgttatataagcatgattggttgaaccattgttcatgtgattgaaccagtccacctacactccccagaggtcaggctgatattgtggctcaaagcctcaaccttttaatcatatggttgatctttctgatgtgaccagcctttattctgggtcatattgttagcataactgagctgtagtccaagagaccaaccatgaataacaaggacacacctatgacttgggaaatccaaagratttagagtttacctcccaggaatcaggaataagaccagcccaattctctactattcaatggccccatagaaccctctccaagtactttaagggagccacagtttctctgtttgtgtctcacagaggtcagttgtgtcatagcagcttttgcagtgggagaggtccaaagaaggagtacatattggtcctcatgtaggtgttaaagaggatgctttgggagattcttgttagaaggtaaatacctcaatgtcaggtgactgttttgttattgatgtactaattgggttctaatcagaaaa

SEQ ID NO: 31995 - DNA, 601 bp, Human
atgaataacaaggacacacctatgacttgggaaatccaaagaatttagagtttacctcccaggaatcaggaataagaccagcccaattctctactattcaatggccccatagaaccctctccaagtactttaagggagccacagtttctctgtttgtgtctcacagaggtcagttgtgtcatagcagcttttgcagtgggagaggtccaaagaaggagtacatattggtcctcatgtaggtgttaaagaggatgctttgggagattcttgttagaaggtaaatacctcaatgtcaggtgaytgttttgttattgatgtactaattgggttctaatcagaaaaacagaaacagcactaggtattttgacagatagaatgtaatataaagaactgcttaaagggccgggtgtggtgactcacgcctgtaatcacagcacttggggaggctgaggtcagcggatcacaaggtcaggagttcgagaccagcctggccaatatggtgaaatcccatctctactaaaaaatacaaaaaaagttagatggtcatggtggcgtgcacctgtagtcccagctactcaggaggctgaggcaggagaattgc

SEQ ID NO: 31996 - DNA, 601 bp, Human
tatgacttgggaaatccaaagaatttagagtttacctcccaggaatcaggaataagaccagcccaattctctactattcaatggccccatagaaccctctccaagtactttaagggagccacagtttctctgtttgtgtctcacagaggtcagttgtgtcatagcagcttttgcagtgggagaggtccaaagaaggagtacatattggtcctcatgtaggtgttaaagaggatgctttgggagattcttgttagaaggtaaatacctcaatgtcaggtgactgttttgttattgatgtacyaattgggttctaatcagaaaaacagaaacagcactaggtattttgacagatagaatgtaatataaagaactgcttaaagggccgggtgtggtgactcacgcctgtaatcacagcacttggggaggctgaggtcagcggatcacaaggtcaggagttcgagaccagcctggccaatatggtgaaatcccatctctactaaaaaatacaaaaaaagttagatggtcatggtggcgtgcacctgtagtcccagctactcaggaggctgaggcaggagaattgcttgaacccaggaggcagagg

SEQ ID NO: 31997 - DNA, 601 bp, Human
catctctactaaaaaatacaaaaaaagttagatggtcatggtggcgtgcacctgtagtcccagctactcaggaggctgaggcaggagaattgcttgaacccaggaggcagaggttacagtgagccgagatggtgccactgcactccagcctgggcaacagaatgagattccatctcaaaagaattgcttaagctgggcacagtggctcatgcctgtaatcctggcattttgggaggctgaggtgggcagattgcgtgagccaaggagtttaagaccagcccaggcaacatgacaaaacccmgtctctataaaaaataccaaaaattggccaggtgtggtggtgcacgcctacagtcccagctcctcaggaggctcaagtgggaggatcacttgagtctaagagattgaggccacagtaagccttgatcatgccactgcactccagcctgcgtgacagagtgagaccttgtcttggaaaaaaaagaagaattgctaaacacctttcagaggactgaaaaagcaaaaagggaacaaaaggattcatgcaggttataaccccccagacctgagacaacaaaggaaagaggttgaggctatcaga

SEQ ID NO: 31998 - DNA, 601 bp, Human
agtactggtggaacctaatagggagcgggtacagacagaagtagacaagagaattgcttaatcattaatgcacaaaagagtatgttttaggtgtttaaaatatttcagttcaacaaggtttacatattttacaaaacccatcagaaccaggcactgtttcccaagttggcttggtattttctggtgtttcttagaagagccactgctccccaagtggacctgccctgtgacagatccctggagcccagcatttaggtacaaacagttccaggatgtgagctttatgaggatgaggattttygtctatgttgttcactgctgtatcctcagttctaagaacagtggggcagataagtgcaaatatttattaaatgagtgtcctcaaaattgaggttaaggtcttaagagccaagtgaaacttttaccattcaggatagtgttgtgcagatatgacagatgataatagcacaaagttaccagagcctcaatttctatgtgagtaatgctctctgaggctacaaaggatacaactgcatcaaggttaccttggttactagagattaatgatacacaagaagatcaagaaggaaattgtctcaat

SEQ ID NO: 31999 - DNA, 601 bp, Human
caacaaggtttacatattttacaaaacccatcagaaccaggcactgtttcccaagttggcttggtattttctggtgtttcttagaagagccactgctccccaagtggacctgccctgtgacagatccctggagcccagcatttaggtacaaacagttccaggatgtgagctttatgaggatgaggattttcgtctatgttgttcactgctgtatcctcagttctaagaacagtggggcagataagtgcaaatatttattaaatgagtgtcctcaaaattgaggttaaggtcttaagagccragtgaaacttttaccattcaggatagtgttgtgcagatatgacagatgataatagcacaaagttaccagagcctcaatttctatgtgagtaatgctctctgaggctacaaaggatacaactgcatcaaggttaccttggttactagagattaatgatacacaagaagatcaagaaggaaattgtctcaatcatgcatagccaaactttacagagattaaagtcacagcactacccgagggacccagttatgttgtcactctctcggcagcaggcatccattgctccccatgctaatgttt

SEQ ID NO: 32000 - DNA, 601 bp, Human
actgctccccaagtggacctgccctgtgacagatccctggagcccagcatttaggtacaaacagttccaggatgtgagctttatgaggatgaggattttcgtctatgttgttcactgctgtatcctcagttctaagaacagtggggcagataagtgcaaatatttattaaatgagtgtcctcaaaattgaggttaaggtcttaagagccaagtgaaacttttaccattcaggatagtgttgtgcagatatgacagatgataatagcacaaagttaccagagcctcaatttctatgtgagtratgctctctgaggctacaaaggatacaactgcatcaaggttaccttggttactagagattaatgatacacaagaagatcaagaaggaaattgtctcaatcatgcatagccaaactttacagagattaaagtcacagcactacccgagggacccagttatgttgtcactctctcggcagcaggcatccattgctccccatgctaatgttttccgtgacagtaactgctcctcttcctttttgcttctaatgttcttgacaccagcaagtaacatcccctcccctaccacatggtgtttgtc

SEQ ID NO: 32001 - DNA, 601 bp, Human
gacagtaactgctcctcttcctttttgcttctaatgttcttgacaccagcaagtaacatcccctcccctaccacatggtgtttgtctacccaaggcttataaatatttgtgcatagcttttggttattcttggctactgttttcttcattatttccaggagtcttttggttctttgttattctattgtctttgtctccttttctgtgtcactcgctccctaagagagaagatacaatgggttcaggaagtcactatcatgttggccctcataaagggaccagatgtcttctacagcttatycagtacagtggcacaatagagtctaaataaagagagatctaaattcttaacttttttcggtattctaaagtcaatggtgtgtgagagagagaacactgaaacagggatcagggactcaaagttctagtccaggcacctgtactattaaaatattctatttgattttatactctactgtgcctcaaaatggataaagtagttgtcaacttaggttgaaataattttttactctaatatcccacaaaatatttgaaggaaagggagaggctgtgtgaaatgacttataaagtctcatctaaa

SEQ ID NO: 32002 - DNA, 601 bp, Human
tcatggctagtatggctaatttatagaattcttgagaatggtgcagacagttcagatagccacatggtgtcacctacaacaaagggtatagtggctccaagagaatcaccaccccatggatggggcagacagagatttaagactgatgggcactgcacatcacaggccatgcaaaaggggctacaactagtcagtactaaaatatatgaacacacagttggcatttgtaaagggaaatggcatgttttgggtagctttcttacttttgggagatacgaaaaaatatggtttaattatattcattaagattagggttagattcgataaaacagaaaaattacagtggcttacaaaaggtagaagtttatttctatcatatgtagaagtctagacattggcaattctaagtctagtatgacagctactcaaagcttttaggaactcagacttcttcttgattacttttatgccatcactaagaagtggtccttatcttcacagtccaagatggctgcccaagatgcagatatcagttcacatgtaaggcagttggatggaggaaggactaagatgaacatggcctcatccctttaaggagatt

SEQ ID NO: 32003 - DNA, 601 bp, Human
tgggcactgcacatcacaggccatgcaaaaggggctacaactagtcagtactaaaatatatgaacacacagttggcatttgtaaagggaaatggcatgttttgggtagctttcttacttttgggagatacgaaaaaatatggtttaattatattcattaagattagggttagattcgataaaacagaaaaattacagtggcttacaaaaggtagaagtttatttctatcatatgtagaagtctagacattggcaattctaagtctagtatgacagctactcaaagcttttaggaactcagrcttcttcttgattacttttatgccatcactaagaagtggtccttatcttcacagtccaagatggctgcccaagatgcagatatcagttcacatgtaaggcagttggatggaggaaggactaagatgaacatggcctcatccctttaaggagatttgtctgccttcatttcattgtgaataactaagttatagaactgtactagctaagaggaaagctgagaaagtagtttttaagctgtgtacattatatcttgcttaaggttagggttctcttagtatggaagatggccagaatggaaa

SEQ ID NO: 32004 - DNA, 601 bp, Human
aaaaggggctacaactagtcagtactaaaatatatgaacacacagttggcatttgtaaagggaaatggcatgttttgggtagctttcttacttttgggagatacgaaaaaatatggtttaattatattcattaagattagggttagattcgataaaacagaaaaattacagtggcttacaaaaggtagaagtttatttctatcatatgtagaagtctagacattggcaattctaagtctagtatgacagctactcaaagcttttaggaactcagacttcttcttgattacttttatgccakcactaagaagtggtccttatcttcacagtccaagatggctgcccaagatgcagatatcagttcacatgtaaggcagttggatggaggaaggactaagatgaacatggcctcatccctttaaggagatttgtctgccttcatttcattgtgaataactaagttatagaactgtactagctaagaggaaagctgagaaagtagtttttaagctgtgtacattatatcttgcttaaggttagggttctcttagtatggaagatggccagaatggaaattgaaaggcacactagtagctcatcc

SEQ ID NO: 32005 - DNA, 601 bp, Human
ccacaacacagtgcagtaagagttacaagaagaatgtaccatctcacaacagaaaagcatgaagaaattaaataaaagggcaagatttatcttatcacatacccattctttgctagtgttggcatttaaacttttctctgttttataatcatatttttcagtttgtcaaggcttaatttcattctgatttggtttcagtatacaagaagagtcttggagatgacattagttccgaaacatctggtgacttccggaaagctctgttgactttggcagatgtaaggttttattttttattttwtaactccccagtaagctgcatgctcaataacaatttttagggagtttaaaaataaccaaactgagacaatgagttcacaattttccttatgaaatggtttgttcattttacattttcattgccaccaagcaatataatgtttaaccaagatcataaaagcatacataatgatgtaacaacaaagaaaacttatttgagtcagtaagtggaggtgttttggtcaggtttcacaattttgacattagaagacattctgatacatcatctgacatacaatatttatttccattataagtgtct

SEQ ID NO: 32006 - DNA, 601 bp, Human
ttcattgccaccaagcaatataatgtttaaccaagatcataaaagcatacataatgatgtaacaacaaagaaaacttatttgagtcagtaagtggaggtgttttggtcaggtttcacaattttgacattagaagacattctgatacatcatctgacatacaatatttatttccattataagtgtctccattttaaagaacaggtttattttcttctggactctgaagaataaatatttcttttgttagcttctaaattaaataggaagcatgatacagaagaatgatctttagagatgggrattaaattgagtatcagtctcaggattaaaaaaaagaaaatgattgctgcaatttcagccttgccaccttggaaaagctgccaaactattaatcatcatgtgacctaatgaggccacaccttgctttctctttttagaaggcttatgacttttattataaagatggtaaggtcaaggatgaggtgtattcacagctgtgtgtaagagagaacgtgatttaaaccatagctcaccaattttctttcagctgatttacatagcacctaaatgtgagaaaatcccaacaacggtctcagcctc

SEQ ID NO: 32007 - DNA, 601 bp, Human
atacaatatttatttccattataagtgtctccattttaaagaacaggtttattttcttctggactctgaagaataaatatttcttttgttagcttctaaattaaataggaagcatgatacagaagaatgatctttagagatgggaattaaattgagtatcagtctcaggattaaaaaaaagaaaatgattgctgcaatttcagccttgccaccttggaaaagctgccaaactattaatcatcatgtgacctaatgaggccacaccttgctttctctttttagaaggcttatgacttttatyataaagatggtaaggtcaaggatgaggtgtattcacagctgtgtgtaagagagaacgtgatttaaaccatagctcaccaattttctttcagctgatttacatagcacctaaatgtgagaaaatcccaacaacggtctcagcctcatggttgaaacagcacctgtcaaagtgaggcattatgccattaggaagcgatttatctaaattatggtttcagttactttaaatgtgaaaaacttatgaaggttgaacccacaacaccaaatttatgaagcattgctgcaaacatatgctctcaga

SEQ ID NO: 32008 - DNA, 601 bp, Human
atcatcatgtgacctaatgaggccacaccttgctttctctttttagaaggcttatgacttttattataaagatggtaaggtcaaggatgaggtgtattcacagctgtgtgtaagagagaacgtgatttaaaccatagctcaccaattttctttcagctgatttacatagcacctaaatgtgagaaaatcccaacaacggtctcagcctcatggttgaaacagcacctgtcaaagtgaggcattatgccattaggaagcgatttatctaaattatggtttcagttactttaaatgtgaaaamcttatgaaggttgaacccacaacaccaaatttatgaagcattgctgcaaacatatgctctcagaggtatatattcctaagtgcacatctgtttgtgtatggacatgaatgcacccacccacaggaggcagtatagagtagggctctaggacagggttctagaatcaaacagggctggaatctcatgctgccaactagctttgtatatttggacaagttctttaagtcttaaagcattcattttcatatctgtaaaactaaaatactaacaataacaagtactcatagggtgttatgaaga

SEQ ID NO: 32009 - DNA, 601 bp, Human
acctataatttgccaaataattcaggcaatcccgtgttttggttttgtctcctgtctttccataatgtgcttaagtatttgtacatgaacacacataccacacacacacacacacacacacacacacacacacacacacacaccacttaaaccatagagcctttaatatcacagttggggatctttgaggactttttattttttcttttttgagacagagtctcactctgtcatccagactggagtgctgtggtgcgatctcggctcactgcaacctctgcctcccaggttcaagcaattytcctgcctcagcctccctagcagctgggattacaggcacacgccaccacacccggctaatttttgtattttagtagagacagggtttcatcatgttggctaggatggtctcaaactcctgacctcaatcaatccacccgcctcagcctcccaaagtgctgggattacaggcgtgagccactgcgccccgcctttgagttttttttttttttaaataaactttactttttagagcagcttcagatttatggaaaaattgagcagaaagtacagagagctcccatatgaccctattctactc

SEQ ID NO: 32010 - DNA, 601 bp, Human
ctttactttttagagcagcttcagatttatggaaaaattgagcagaaagtacagagagctcccatatgaccctattctactctctcctttcctttccattattattattattattattattattttgagacaggatctggctctgttgcccaggcttgagaactatggtgtgatcttagctcactgtagtctcgacctcctgggcccaagcagacctcccacttcagcctcctgagtaactgggaccacaggtgtacaccaccacattcagctaattttttttttttttttttttttttttagagcgagagaaggtctcactcttgcattaattagtatgtgtatttattataattggtgaatgaatattgatacattattattaactgaagtttatagtttacattagggttcactctttctgtgatatagttctatggattttaataaatgtataatgtcatatgtctatcattacagtatgatagagtagtttcactgtcctaaaaatcctctgtgctctgccagttcataccttcctccccaccaactactgatcttcttactgtctctatagttttgccatctctagaatgtccta

SEQ ID NO: 32011 - DNA, 601 bp, Human
ctttatgtattttggatacaagttctttatcagatacatgttacaaatatgttctcccagtttgtaccttgtcttttcttccacataagacctctgtgttgggttgggcacagtggcccacacttgtattcccagagattcaggaggctgaggtgggaggacagcttgaggccaggagtttgagaccagcctgggcaacatagcgagatcccatctctaaaaaaaatttttaaattagctgtgtgtggtggtgtgcacctgtagtcatattagctattcaggaggctgaagcgggaagatrgcttgagccttggagttcaaggttatagtgagctatgactgcaggactacactctggcctggccaacagagagtgagaacctgtctctaaatatatatatatatgaattttcggaggagggaactgaggcccccaaaattgtgtgatttgctaaaaatttcatgactagtcaatggcagaaccagaactggagccctgagtacatgatttttctgtgcaacctgtcctgccttaaagaaaaaccactaagatcccctgctggttgaagtactatgtgttagaatcttctatctttaaagg

SEQ ID NO: 32012 - DNA, 601 bp, Human
tccacataagacctctgtgttgggttgggcacagtggcccacacttgtattcccagagattcaggaggctgaggtgggaggacagcttgaggccaggagtttgagaccagcctgggcaacatagcgagatcccatctctaaaaaaaatttttaaattagctgtgtgtggtggtgtgcacctgtagtcatattagctattcaggaggctgaagcgggaagatggcttgagccttggagttcaaggttatagtgagctatgactgcaggactacactctggcctggccaacagagagtgagamcctgtctctaaatatatatatatatgaattttcggaggagggaactgaggcccccaaaattgtgtgatttgctaaaaatttcatgactagtcaatggcagaaccagaactggagccctgagtacatgatttttctgtgcaacctgtcctgccttaaagaaaaaccactaagatcccctgctggttgaagtactatgtgttagaatcttctatctttaaaggatggcccttgttttcgtcctcctgtttagggcagaagagatgaaagtctgaaagtggatgagcatctggccaaacaaga

SEQ ID NO: 32013 - DNA, 601 bp, Human
agtttgagaccagcctgggcaacatagcgagatcccatctctaaaaaaaatttttaaattagctgtgtgtggtggtgtgcacctgtagtcatattagctattcaggaggctgaagcgggaagatggcttgagccttggagttcaaggttatagtgagctatgactgcaggactacactctggcctggccaacagagagtgagaacctgtctctaaatatatatatatatgaattttcggaggagggaactgaggcccccaaaattgtgtgatttgctaaaaatttcatgactagtcaatgkcagaaccagaactggagccctgagtacatgatttttctgtgcaacctgtcctgccttaaagaaaaaccactaagatcccctgctggttgaagtactatgtgttagaatcttctatctttaaaggatggcccttgttttcgtcctcctgtttagggcagaagagatgaaagtctgaaagtggatgagcatctggccaaacaagatgcccaggtcagtaacaaagcgggaaaacatttcctttacctattctcctatgtggctgcctttgcatttatgtgaaaagggagaaaaatagcagca

SEQ ID NO: 32014 - DNA, 601 bp, Human
gaagacttactgttggccataggtaagacttcgagtgctggtaaactaagttactttgcacttgctttaactcagtgccgaggcctgctccttttgggcaagaatcctgactgatccattttttttgctccctacagcccccaacatggtccaggatacacacagtacgctcaacaaatattgttaaatgaatgcttgaagaagttatttttttaagtcttttttctttttcttttttgaaacaggatctcactctgtcacccaggctggagtgcagtggtgtgatctcagctcactgcascctcaacctcctgggctcaagcagtcctcccacctcagcctcccaagtagctgagacaacaagcatgtataccacctggcccagctaattttgtattttttgtagagatggggtttcaccatgttgcccaggctggtcgtgaactcctgagctcaagcaatccatccacctcagcctcccaaagtgttgggattacaggtgtgagctaccacatccagccatctttttaaatcttaccttgctttttaaatttgtatttgtcttgtgaccatgtttagcttgtagacttcttgagagctg

SEQ ID NO: 32015 - DNA, 601 bp, Human
gtaaactaagttactttgcacttgctttaactcagtgccgaggcctgctccttttgggcaagaatcctgactgatccattttttttgctccctacagcccccaacatggtccaggatacacacagtacgctcaacaaatattgttaaatgaatgcttgaagaagttatttttttaagtcttttttctttttcttttttgaaacaggatctcactctgtcacccaggctggagtgcagtggtgtgatctcagctcactgcagcctcaacctcctgggctcaagcagtcctcccacctcagcytcccaagtagctgagacaacaagcatgtataccacctggcccagctaattttgtattttttgtagagatggggtttcaccatgttgcccaggctggtcgtgaactcctgagctcaagcaatccatccacctcagcctcccaaagtgttgggattacaggtgtgagctaccacatccagccatctttttaaatcttaccttgctttttaaatttgtatttgtcttgtgaccatgtttagcttgtagacttcttgagagctgaaatattttatttctactggcatttttattgagctttgtt

SEQ ID NO: 32016 - DNA, 601 bp, Human
cacacacatgcaactaagacctaagccagtttggtaatccaccatatttggttatttatgaaagatatcagtggcttttcttttctttctttcttttttttttttcttttgagatggagtctcactctgtcacccagactagagtgcagtggcacaatctcagctcattgttgactctgaattgctaaaagataagccgaggaggctaagaaagggaaaactttcttcttcaattaaaaaagtagaattgagatcagtcttcataattagttctcagactgttccagtggtaatgatacamctggttaatttttttttccattttacattgttaatctttttttctttttttttctttgtgacggagtctcgctcggttgcccaagctggagtgtggtggcgcaatctcaggtcactgcaacctccgccttccaggttcaagcaattcttgtgcctcagcctcctaagtagctgggattacaggcacacgccaccacgcctggctaacgtttgtatttttagtagagacagggtttcaccatgttggccggggtggtctcaaattcctgacctcaagtgatccgcccacctctgcctccca

SEQ ID NO: 32017 - DNA, 601 bp, Human
taattctgcttgctgtttttcatttggtgttcttgctaagccgtaatgtttgaaaaactttgttgagatgtacaaactctcattcactgagctaaggagcattcttggaaatatatcattgaataatgtattacatttgggctataatgcacattattttatcatgtaaaaaaagaccttataattcaattgaagttcaaaatatgttacactttcattttgtttcagtctaccattggaataaaccagtttataaaattttttattgagatataacttacataccataaagttcacccaytcaaagtgtgcaattcaatgctttttaatgtagtcacaaggttttgcaaccatcaccacaatctaagtttaggacgttttaatcagccgcataagaaaccctgtaactattgacagtcactttccaatcctccccaccccctggctcctataatcattaatctactttctgtctctatagatttgcctactctgcatatttcatacacaaggaatccaatacaatggtcaacacatagtttttgacatgaaaaacgatctgagctgtgtcatcttagaatcgtgtaataggagcatacta

SEQ ID NO: 32018 - DNA, 601 bp, Human
atattaaagattctacaaaaaaataaaaaattagctgggtaggttggtggacgcctgtagtcccagctactcaaggggctaaggtgggaggagtgcttgaacccaggaggtcgaggctccagtgagctatgttggtgccactacaccagagcctgagtgacaaaagtgagatcccatctctaaaagatggggaaaaatgtgcaaaagtttcaaaatccaacagaaaagtcttagcagcaacttttaatgttgggcaagcacaagggcatgatcactggggattgacaggaaacacgtctgkcagtggacagctggactctcaagataagctgcaacagaggcatgttctgcattttagggcttgcccaggactggggacaagccagagttcaggaacctgtgggaggagagaggcctgatggaagtgtggtcaagacaatgaagagggtagggaatgggcaattatgaattcttggtcatggtaattaactctaacggactcccaagcttccctgcctatggtgctgggtgataaagcctccttcccactgaaacatactgccaccttccaaaactttcagatatgaagaacaaatctagt

SEQ ID NO: 32019 - DNA, 601 bp, Human
tcttagcagcaacttttaatgttgggcaagcacaagggcatgatcactggggattgacaggaaacacgtctggcagtggacagctggactctcaagataagctgcaacagaggcatgttctgcattttagggcttgcccaggactggggacaagccagagttcaggaacctgtgggaggagagaggcctgatggaagtgtggtcaagacaatgaagagggtagggaatgggcaattatgaattcttggtcatggtaattaactctaacggactcccaagcttccctgcctatggtgctggrtgataaagcctccttcccactgaaacatactgccaccttccaaaactttcagatatgaagaacaaatctagtaggtaagaatataaagcagaaggcaagctaaagggaagaaaggatcatgaaaagaagggattgtacaaatctagttggcagggaggtgactggaaagcttaataggatgaaagtgggcatcattattttttatcaagctattatggcttacttaatgtgagttttactagtttaaatggttagtttcttgtcagagaacttcatgtaacagtttgattctaaatgctg

SEQ ID NO: 32020 - DNA, 601 bp, Human
ttccttaagacagtctataagccacgatgagaaagtcacttattcttgttctgagctccaaaattcattataaaatccattcacttttggttggattcctacctagagatcagatttaagattataaaaataattgtgttgctgtaaataggtttcttccctacagacttttctattcctattttctttttatttaaaagataatttactcttgcgtttttgtcagtttcctttttcttgttttatttctgctttacttgttatttcaaaataaagaattgaaggattgtattttttttttaaggcaactgaatttagatgacagatacttgttctaatggagtcactctaaccagcctataaattctaatccagtcatttaaaagaaaattctttccatgggaaaaattgcttttaaatggaactccagtgcccctgcgtgcctaatgagttatttggagcaacatcgctgcagttgtcaggcccaggttgttcatcagtagcccgagatgctagtagctgagcagtgtcgcaccctagggagttatcagggaaagcgtaggtgttcggggtgtctgggatccagagatgagtcagtcgc

SEQ ID NO: 32021 - DNA, 601 bp, Human
aaggtaaaaatatggcttaatgttgatagaatgtcatatttcttttccacttagattagttttctacagtagctaatttgtctactgatttgcctcataggttaatagtattctaacccatatagagataggtacagagaagtattgaccacattattttcactgcttcacagtaagtgcaggcagtaaaacttgttttagaatgccaaacctcaagcttgagacccagtagatcctgtggcctctcaaactgccttgcttaaaataaaccaagctgagttggcagcctttaatgatgccrtaaccctgtgtttgcttgtctgtctttactgccagatggtgcgctccatgagtacagactcctgtttatcctcagaccctagggccttgtgcacagaagatgcttacctccatctctttaccagccattttctgtggtcccacacgtaccttcaaagtcatatcctaagtgaacacatcctttccttcatctcgcccagccccacatctgctccccttcccctgttcagtcatcccagagaatggccccaacaggaatttgcccaactctctgaagtcgtaccattcctccccagacttc

SEQ ID NO: 32022 - DNA, 601 bp, Human
tgctcatcctctagatctttacctagctgactccttctcatctttcaggtttcagctctcctcctgagagaggtctcccctaactgtaccaggccaattggttccctttcagtcactctccatgccatttccagctttcttttcttcatatttctgatcactatttacttaagcaatagttaatttgctttgctgtctgtctccatctactagaacataagctccatgcagacagagatataatctgttctgttcaccgccattggcacagcacatggaataatgcctggctatagtcgaygctcataagcatttgctggatgaattacatagatgaatggaatatcatttagtatgttggccatcattaggtcaaaatccacctaactgctcagctagaaattttacactatctctctttttcattatcctgtagcgatacatcattatgttttgtcaatccatttacataagcaactctcaaatcttcccattttctccatccctactgcctttattctaaggatggccatcatcatctcttaattactcagtctcctcaagatgagtctcaaagcctctagtcttaactcccttatct

SEQ ID NO: 32023 - DNA, 601 bp, Human
tgcattccttaacagggtattggaactgatgagtttactctgaaccgaataatggtgtccagatcagaaattgaccttttggacattcgaacagagttcaagaagcattatggctattccctatattcagcaattaaagtaagtctacttttaaaaatagcaaaacatattttgcccttctctacccatctccttactcttatatgccttaaaatataaagatatttgacttagatttctctctccttgtcaatgtataaatgtgttgtctgagcttaaaatagtagcagcaaaatatccyttattttcagctctaaaatcccaggcatataatagacactcaatatttttttaggtgtactagccactaatttttcttcttttgtgaattacatatgcaagttgtttacctgttttttatattgcactgtttttatttatttcagtctttatgacaatgtaagaaaagaaaaatacgtattttaaatttcctctctgttttacatgagacagcatggttctgcagcttagagtgcttttcatttcagtatataggaaactttctcattttatttaacagctgtatatcattccattgttt

SEQ ID NO: 32024 - DNA, 601 bp, Human
tctggtcatattttcccagtccgttctttgtcctttgacttggccaaaagtatttttttccaagcagaggttgcacatcttatttaattaaatttatcaatctttcacagtattttagtttttaaaaaatctggtcccttctgtttctttcattctggatgagaatcttcctaaaatgggctccttcctttctcttttaaagcatgaaacccattttcattgttttcagatctcagttgatatattatacatagaaacttcaaataaattacaaattatttgaattaatagggcagtaagsctgacaaaaattgtacaagaggcttctgtaccttaagctcatggttcaaaagtcatagtcccaacaggaagatggcaactagttagtggagaactaaggggctagccccacacctgctcagtagccttccattgatttacttttctaccttgatgctccagaccacatatgaaagtctctagtaaatgagtgatagagagtgttagtccaagctggttccctggaacaaagtggaagctggggttggtgagtggagcaatccactgtccttgcctccaaggccacactgaccaggggaaa

SEQ ID NO: 32025 - DNA, 601 bp, Human
ggacccaggtgaactctccaaggtctaagctgagacttggggcctagaaggtgatccaggatgaagagggaagcagcagccaagcagagtgtttgctctgagtgctgagggtctaaaactgggaatggagtccatgctgattagaccccctaagctgtggatcattatgcaccatgcacatcctgatcctgggtagcagcaccctctctcaagcccctacaaggctggagcactacctctgtgggggagcttacactcagcgatgtcccctggggacacctggcttagaccacattccagygtccctgccagcagctggagtctttggtccaaccttcgctatggccctacccacaatagccacccttgaacaggcacaaatattagcctgggtctttctgcagctatcttgggaaggtttctgcctctgactttacaaatggcctttgaatgaatgaatgaatgaatgaacatcaatcagtcaactagattcattcactaaaatctctctctctctctttttaatcagagtttttgtttttgcactaaacttttacagaaagagagctgagatgcatgcataagttgaaatcaggaactt

SEQ ID NO: 32026 - DNA, 601 bp, Human
accatgcacatcctgatcctgggtagcagcaccctctctcaagcccctacaaggctggagcactacctctgtgggggagcttacactcagcgatgtcccctggggacacctggcttagaccacattccagtgtccctgccagcagctggagtctttggtccaaccttcgctatggccctacccacaatagccacccttgaacaggcacaaatattagcctgggtctttctgcagctatcttgggaaggtttctgcctctgactttacaaatggcctttgaatgaatgaatgaatgaatgaacatcaatcagtcaactagattcattcactaaaatctctctctctctctttttaatcagagtttttgtttttgcactaaacttttacagaaagagagctgagatgcatgcataagttgaaatcaggaacttactcaaaaaggcaattctcagactgtgcctgggacttagcacaaattgcatcaactgctcacactcaattctatttgaatcagtcctgacacatcacaatagtttcaatcatcagaggaagattcaataacattaaccatgttgtagctactaaggcagaaaaatagact

SEQ ID NO: 32027 - DNA, 601 bp, Human
tcccctggggacacctggcttagaccacattccagtgtccctgccagcagctggagtctttggtccaaccttcgctatggccctacccacaatagccacccttgaacaggcacaaatattagcctgggtctttctgcagctatcttgggaaggtttctgcctctgactttacaaatggcctttgaatgaatgaatgaatgaatgaacatcaatcagtcaactagattcattcactaaaatctctctctctctctttttaatcagagtttttgtttttgcactaaacttttacagaaagagtgctgagatgcatgcataagttgaaatcaggaacttactcaaaaaggcaattctcagactgtgcctgggacttagcacaaattgcatcaactgctcacactcaattctatttgaatcagtcctgacacatcacaatagtttcaatcatcagaggaagattcaataacattaaccatgttgtagctactaaggcagaaaaatagactcacacattttctaaagattgtcagtaacaaggttgagacataaagagggctttcagttcaccctcagcaaaccagaaaattaaattaaccagtgg

SEQ ID NO: 32028 - DNA, 601 bp, Human
agtacaagatttctttatttctaccacctaacacatattattaagtaatctcattacatttttgctattgaagaacaggatctttttagatggttgtttctgaaattcatgggatagagttccattttgcatatcatctcagcctgtcatcctgcctgttttcttccttccacctattgtttagacatttctttgtccattgacacctttctcagggggtaaccggtgggaaggagaaggcaaggaagaacagaggtgaaaaaccaatgtgtacctcttactactttataagaagatattwtggaaaatttagatgaaattatattttttggtagttttccttcatagacaaattctgtatttatttaataaatagcacaattccaagctttttatgggaaaatatagtagccactcacaatcaactcataatctatgtggagacttgaggtaggtatgaagaaacaattagaagataataattgaaacaacagacaattaaatactagattgttgaatatagagctagtactatcggaattgagaagaaaagaagtttggggttagagaaatgggtcttgagcctgcctttcaggtcaac

SEQ ID NO: 32029 - DNA, 601 bp, Human
cctgtcatcctgcctgttttcttccttccacctattgtttagacatttctttgtccattgacacctttctcagggggtaaccggtgggaaggagaaggcaaggaagaacagaggtgaaaaaccaatgtgtacctcttactactttataagaagatattatggaaaatttagatgaaattatattttttggtagttttccttcatagacaaattctgtatttatttaataaatagcacaattccaagctttttatgggaaaatatagtagccactcacaatcaactcataatctatgtggaracttgaggtaggtatgaagaaacaattagaagataataattgaaacaacagacaattaaatactagattgttgaatatagagctagtactatcggaattgagaagaaaagaagtttggggttagagaaatgggtcttgagcctgcctttcaggtcaacaagcatgtgttgagtgtctcctgtgggccaggtgctctgctggagcatttacctttaagaccccagatcaatagggtcttaaaagtaaatgctctagagacagatatgggaagaagcaagagggaaagaagtaataaggcat

SEQ ID NO: 32030 - DNA, 601 bp, Human
tataagaagatattatggaaaatttagatgaaattatattttttggtagttttccttcatagacaaattctgtatttatttaataaatagcacaattccaagctttttatgggaaaatatagtagccactcacaatcaactcataatctatgtggagacttgaggtaggtatgaagaaacaattagaagataataattgaaacaacagacaattaaatactagattgttgaatatagagctagtactatcggaattgagaagaaaagaagtttggggttagagaaatgggtcttgagcctkcctttcaggtcaacaagcatgtgttgagtgtctcctgtgggccaggtgctctgctggagcatttacctttaagaccccagatcaatagggtcttaaaagtaaatgctctagagacagatatgggaagaagcaagagggaaagaagtaataaggcatttgtttgattagagggtctaccttggggaatattgagaaataaaatccaagtagcaagatgagttcagttgaaagagagctttgagatcagcgaattcactcattcaattaaaaatattatcaaatgcatattatgtgctaggc

SEQ ID NO: 32031 - DNA, 601 bp, Human
cggaattgagaagaaaagaagtttggggttagagaaatgggtcttgagcctgcctttcaggtcaacaagcatgtgttgagtgtctcctgtgggccaggtgctctgctggagcatttacctttaagaccccagatcaatagggtcttaaaagtaaatgctctagagacagatatgggaagaagcaagagggaaagaagtaataaggcatttgtttgattagagggtctaccttggggaatattgagaaataaaatccaagtagcaagatgagttcagttgaaagagagctttgagatcagcraattcactcattcaattaaaaatattatcaaatgcatattatgtgctaggctcagggttacaattataagcaaagggggtagggtgggggaagacattttctgcccttatggaattacaactatgttaaatgtaaaggaaagtgacattgtgctaaaagatcctacaatagtaggacttgacttagaggaaaggcttctatgagaaagtcatgattcagatctggaaaataagtagatattaataaggcaaaatgtatggaggtaagggagccagtagaacattctaataaaagaaatga

SEQ ID NO: 32032 - DNA, 601 bp, Human
ttgggttacctcaaataaaataaaaataatgtgagcatcttacacaatccaggttgaaagccaagttttacctcctgtgaagtcttttgcgttacaaacttggtatctttgccctttaagcctcaacctcacgtagtatcttttctggacaacagtctatttttggttggccttgggaaaaggaactgataaacatattctttaaaaatgtggttcatttcactttcctaagttaggcagtgtagcagggtattaaggagccaggatatagggattcaaatcctgcttttgtcacttattytcgataagatttgaggcaagtttcctaacctgtctttctcattttacttatctgttaaatgggggatacgtatagtacctattgcagagagcttttaaaagggttaaagtagttaatacacattaagccttttgaatagcaagtgttcgataaatattattaaaactaaaatttgaagtttttatagaaatcaatattatgtaagtgatgcaatcttattttattaaaccaaaattgaaatttaactgcagtatatcaggaagaatctaaatattacttacagtgaagaagatgctggtc

SEQ ID NO: 32033 - DNA, 601 bp, Human
aagatttgaggcaagtttcctaacctgtctttctcattttacttatctgttaaatgggggatacgtatagtacctattgcagagagcttttaaaagggttaaagtagttaatacacattaagccttttgaatagcaagtgttcgataaatattattaaaactaaaatttgaagtttttatagaaatcaatattatgtaagtgatgcaatcttattttattaaaccaaaattgaaatttaactgcagtatatcaggaagaatctaaatattacttacagtgaagaagatgctggtcagaacrtaattacactcaggtatgaatgaatgatggaattgcaggtatgttttactaaatggtatagctcatgagtctcacacccaggtgaattccctagtgctataggatttgattcatttatggtctcccattatttatactgtatttgttcttcattgattttattctttgcagtcggatacttctggagactatgaaatcacactcttaaaaatctgtggtggagatgactgaaccaagaagataatctccaaaggtccacgatgggctttcccaacagctccaccttacttcttctcatac

SEQ ID NO: 32034 - DNA, 601 bp, Human
atattattaaaactaaaatttgaagtttttatagaaatcaatattatgtaagtgatgcaatcttattttattaaaccaaaattgaaatttaactgcagtatatcaggaagaatctaaatattacttacagtgaagaagatgctggtcagaacgtaattacactcaggtatgaatgaatgatggaattgcaggtatgttttactaaatggtatagctcatgagtctcacacccaggtgaattccctagtgctataggatttgattcatttatggtctcccattatttatactgtatttgttyttcattgattttattctttgcagtcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtat

SEQ ID NO: 32035 - DNA, 601 bp, Human
acttacagtgaagaagatgctggtcagaacgtaattacactcaggtatgaatgaatgatggaattgcaggtatgttttactaaatggtatagctcatgagtctcacacccaggtgaattccctagtgctataggatttgattcatttatggtctcccattatttatactgtatttgttcttcattgattttattctttgcagtcggatacttctggagactatgaaatcacactcttaaaaatctgtggtggagatgactgaaccaagaagataatctccaaaggtccacgatgggctttyccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaattt

SEQ ID NO: 32036 - DNA, 601 bp, Human
ttgggaggccgaggcaggcggatcacctgaagttaggagttcaagaccagcctgggcaacatggcgaaacgccgtctctactaaaaatacaaaaaattagccaggcatggtggtgcatgcctgtaatcccagctatttgggaggttgagacagaagaattgcttgaacccgggaggcagaggttgcagtgagccgagatcgcaccactgcactccagcctgggtgacagagcaagactccgtctcaaacaaacaaaacaaacaaatccttcaaacaacacagaagtgaaaaaagtagatasgacatgcagtctcctcccgcctgggactgtgtctctcagtttaatttgcatctgtcattgccaaggagctggacagatcaatgcagatgaggacgacaaagcgctctgtcacgatgaccgtctccacggggccccagtgtgtttacaaagcacgttacattgctgcacgaaggcaggagataggtgttagatcagctgcctctttctgccgaggaaatggaggctcagagaggttaagggagggcctcaaggtcacacagcaagagacacagttggggtgcaagcctctgccctcctgcc

SEQ ID NO: 32037 - DNA, 601 bp, Human
ttaaaataaatctcgacaaggcgcagcctcaagtgtgatccttgtaaaaaacttcaaacgggccaggcatggtggctcacgcctggaatcccaggactttgggaggccgaggcaggcggatcacctgaagttaggagttcaagaccagcctgggcaacatggcgaaacgccgtctctactaaaaatacaaaaaattagccaggcatggtggtgcatgcctgtaatcccagctatttgggaggttgagacagaagaattgcttgaacccgggaggcagaggttgcagtgagccgagatcgcrccactgcactccagcctgggtgacagagcaagactccgtctcaaacaaacaaaacaaacaaatccttcaaacaacacagaagtgaaaaaagtagataggacatgcagtctcctcccgcctgggactgtgtctctcagtttaatttgcatctgtcattgccaaggagctggacagatcaatgcagatgaggacgacaaagcgctctgtcacgatgaccgtctccacggggccccagtgtgtttacaaagcacgttacattgctgcacgaaggcaggagataggtgttagatcagctgcctc

SEQ ID NO: 32038 - DNA, 601 bp, Human
tcttccctgggtctccagcctgctggcctacactgcagatttcagagcttgccttaaaataaatctcgacaaggcgcagcctcaagtgtgatccttgtaaaaaacttcaaacgggccaggcatggtggctcacgcctggaatcccaggactttgggaggccgaggcaggcggatcacctgaagttaggagttcaagaccagcctgggcaacatggcgaaacgccgtctctactaaaaatacaaaaaattagccaggcatggtggtgcatgcctgtaatcccagctatttgggaggttgagrcagaagaattgcttgaacccgggaggcagaggttgcagtgagccgagatcgcaccactgcactccagcctgggtgacagagcaagactccgtctcaaacaaacaaaacaaacaaatccttcaaacaacacagaagtgaaaaaagtagataggacatgcagtctcctcccgcctgggactgtgtctctcagtttaatttgcatctgtcattgccaaggagctggacagatcaatgcagatgaggacgacaaagcgctctgtcacgatgaccgtctccacggggccccagtgtgtttacaaa

SEQ ID NO: 32039 - DNA, 601 bp, Human
agactcaccggccgatcagaaccacctgtgccacctggccagcagggacgactctgtccgcctccccgctgggagcaaagcaagggccggtcaccccttcctaataaattcccgtggccaataatgacaagctggtgacaggtgctggagagctgagttctgagtggatacgtggggtgatggctgattttatgggtgcactagggcgggccatggtgccccagggtttggttaaatgtttttttgtttttgttttttttctgagatggagtctcaccctgtcgcttggggttggagggcrgtggcgcaatctcagctcactgcaacctctgcctctcgggttcaagctattctcctgactcagtctcccaagtagctgggactataggagcctgccaccacgcctggctaatttttttgtaattttagtagagacggggtttcaccatattggccaggctggtctcgaactcctgaccttgtgatccgcccacctcagcctcccaaagtgctgcgattccaggcgtgagtcaccgtgcctggccagttaaatgtttttttagatgttgctgtgaaggttgtttttttcttgtttcttttt

SEQ ID NO: 32040 - DNA, 601 bp, Human
gagcccgccggccgcggcctgtgatgactcggacctggcctgctttctagacttctatttgggaagcggccctcctggacgacagaaatagcctccagaccccgaaaatagctggcattgtggctccagcacgtggcaccttggcaccaccccccatgcccactgcgctgggctggtgagccccaagatcgtcgccgttgaggttctgtggttctggtcgccgcgttggagctggggatgtaaaacctcaggcgggactgggagtggggacgggtcaaatcctggctccccccgaggcccracattcaaaggggcggtgggggcccctcctcaacatcaaacagggcaggatgagtcaccgccctccgcccgggctgggggctggcacccactcgtaaaaggaaaaccacttcaaccagggctttctctcttttcagcccgaaggaatgctttgaatgctcaggtctgtcctcagcagtcagattgctggaacattcagacacctcgtgggaggcagacccctcccctactggttggatcccggccagcagcagcgtgatggggtctgggagggctcagagctgcgctggagggagactca

SEQ ID NO: 32041 - DNA, 601 bp, Human
atgcccacagagtgagcccgccggccgcggcctgtgatgactcggacctggcctgctttctagacttctatttgggaagcggccctcctggacgacagaaatagcctccagaccccgaaaatagctggcattgtggctccagcacgtggcaccttggcaccaccccccatgcccactgcgctgggctggtgagccccaagatcgtcgccgttgaggttctgtggttctggtcgccgcgttggagctggggatgtaaaacctcaggcgggactgggagtggggacgggtcaaatcctggctccccccgaggcccgacattcaaaggggcggtgggggcccctcctcaacatcaaacagggcaggatgagtcaccgccctccgcccgggctgggggctggcacccactcgtaaaaggaaaaccacttcaaccagggctttctctcttttcagcccgaaggaatgctttgaatgctcaggtctgtcctcagcagtcagattgctggaacattcagacacctcgtgggaggcagacccctcccctactggttggatcccggccagcagcagcgtgatggggtctgggagggctcagagctgcgct

SEQ ID NO: 32042 - DNA, 601 bp, Human
cataatttttagaataattttctggtacagatgaggtctcactatgttgctcaggctggtctcgaactcctaggctcaggcgaccctcccgcctagacctctgaaagtgctggggttacaggcatgagccgcctcgcctggccagtacctctgcatcccagatcctctgtcctcctttggaccccaaggatacctgggacctgggcccctcaaacggccaggagcctgtgggacagctttggggtcttgcccagctgggcagccgggggacgctcatgcccacagagtgagcccgccggcygcggcctgtgatgactcggacctggcctgctttctagacttctatttgggaagcggccctcctggacgacagaaatagcctccagaccccgaaaatagctggcattgtggctccagcacgtggcaccttggcaccaccccccatgcccactgcgctgggctggtgagccccaagatcgtcgccgttgaggttctgtggttctggtcgccgcgttggagctggggatgtaaaacctcaggcgggactgggagtggggacgggtcaaatcctggctccccccgaggcccgacattcaaaggg

SEQ ID NO: 32043 - DNA, 601 bp, Human
ctggtctcaatctcctgacctcaggtggcccgcccacctcagcctgccaaagtgctgggattacaggcatgagccaccgtgcctggcctggccataatttttagaataattttctggtacagatgaggtctcactatgttgctcaggctggtctcgaactcctaggctcaggcgaccctcccgcctagacctctgaaagtgctggggttacaggcatgagccgcctcgcctggccagtacctctgcatcccagatcctctgtcctcctttggaccccaaggatacctgggacctgggcccytcaaacggccaggagcctgtgggacagctttggggtcttgcccagctgggcagccgggggacgctcatgcccacagagtgagcccgccggccgcggcctgtgatgactcggacctggcctgctttctagacttctatttgggaagcggccctcctggacgacagaaatagcctccagaccccgaaaatagctggcattgtggctccagcacgtggcaccttggcaccaccccccatgcccactgcgctgggctggtgagccccaagatcgtcgccgttgaggttctgtggttctggtcgc

SEQ ID NO: 32044 - DNA, 601 bp, Human
ttcatttttattatttatttatttttttgagacagagtctcactctgtcagccaggctggagtgcagtggcgtgatctcggctcactgcaacctccgccccctgggtccaagcagttctcccacctcagcctcccaagtggctgggactccaggcgcacgccaccacgccagggtaatttttgtatttttagtagagacggggtttcaccatgttggccaggctggtctcaatctcctgacctcaggtggcccgcccacctcagcctgccaaagtgctgggattacaggcatgagccaccrtgcctggcctggccataatttttagaataattttctggtacagatgaggtctcactatgttgctcaggctggtctcgaactcctaggctcaggcgaccctcccgcctagacctctgaaagtgctggggttacaggcatgagccgcctcgcctggccagtacctctgcatcccagatcctctgtcctcctttggaccccaaggatacctgggacctgggcccctcaaacggccaggagcctgtgggacagctttggggtcttgcccagctgggcagccgggggacgctcatgcccacagag

SEQ ID NO: 32045 - DNA, 601 bp, Human
tgagtagctgggactacgggagtgagccactacacctggccataattttcatttttattatttatttatttttttgagacagagtctcactctgtcagccaggctggagtgcagtggcgtgatctcggctcactgcaacctccgccccctgggtccaagcagttctcccacctcagcctcccaagtggctgggactccaggcgcacgccaccacgccagggtaatttttgtatttttagtagagacggggtttcaccatgttggccaggctggtctcaatctcctgacctcaggtggcccrcccacctcagcctgccaaagtgctgggattacaggcatgagccaccgtgcctggcctggccataatttttagaataattttctggtacagatgaggtctcactatgttgctcaggctggtctcgaactcctaggctcaggcgaccctcccgcctagacctctgaaagtgctggggttacaggcatgagccgcctcgcctggccagtacctctgcatcccagatcctctgtcctcctttggaccccaaggatacctgggacctgggcccctcaaacggccaggagcctgtgggacagcttt

SEQ ID NO: 32046 - DNA, 601 bp, Human
aaaaagaaaaggctgagcttccttcagcaagcgttgccagattttgaacacaaagggtcagggacagatggaccccgttttcggagtccaagacctcattctcaccccaaggaaggaaggtcctgataggaaaacgctgcctgcacatttgatgagcttgagggaggtttcacggtgacacccggccagggggctgggcccggtgaggacgagataagcccgtctccatgtttctcttgcagcctgaaccccctgatgactccaaccctctgaggggctgatgcttccggtcacaggaggsaccccctgccccgggctgctgccagcccgccccaggctacacgcccgtctctcctggccatgcctttgggggtgccgctgccactccccgcttagctcaccccagcagggctggggctggggtgtccggtgtcctgggtcaggctacacggggacacgtccatctggccctggatctcatcccgtaaccggtaactgtgtctctgtgggactcagcgacctttctctccttgctttctttcctggaaggcgagagggcgatcacagggggaggattagatgtggcagaggtgaggggatg

SEQ ID NO: 32047 - DNA, 601 bp, Human
tcaagcaattctcctgcctcagcctcctgagtagctgggactacaggtgcctgccaccacgcccagctaatttttgtatttttagtagagacgggtttcagcatgttggccaggctggtctcaaactcctaacttcaagtgatccacctgccttagcctcccaaagtgctgggattacaggcgtgagccacggcacctggcctaaaaaatatttttttaaaaaagaaaaggctgagcttccttcagcaagcgttgccagattttgaacacaaagggtcagggacagatggaccccgttttyggagtccaagacctcattctcaccccaaggaaggaaggtcctgataggaaaacgctgcctgcacatttgatgagcttgagggaggtttcacggtgacacccggccagggggctgggcccggtgaggacgagataagcccgtctccatgtttctcttgcagcctgaaccccctgatgactccaaccctctgaggggctgatgcttccggtcacaggagggaccccctgccccgggctgctgccagcccgccccaggctacacgcccgtctctcctggccatgcctttgggggtgccgctgc

SEQ ID NO: 32048 - DNA, 601 bp, Human
tcccgaaaacccatttctggcacagaggggaccctgcagaaaggacccatggctaacatcatgcaggggagtcacacttggcaacttttcatagacgaagccccctcccgacccccacactccatcgtgcattcattgcaggatcgtgcagtttagcgacgggttcaaccatcacaatccgagtttagccgtatggagtaacaattttttaaataaagagatatttccaaaaaacttcatgatgtcacctcccgccccccatctcaattttacctctacttaaaaacaacacaaagcattycagtgaccctatgaagtctttttaccaatggccaattctcccggaactattgccaccgggcgaagtcacctccctttccccctcggcgccggtccacaattgaaacggcaatcgagagttttaaaaaattgttaccccatcgctgggggatttcagttattccgaacgggaagtggccgtaaagcctccatcccttttggcccaaactgagagggccatggggtcggacctgaaaattcatctccacctacaaggtccattctaccccatccgggcggtgggaacgccttttttggcggg

SEQ ID NO: 32049 - DNA, 601 bp, Human
aatggacttaaatgtcagaaaataatattaatttgtgactagctgcataccctatcgcagacctgagccccaactccgtccagataaggtgaaagacaactttatttggaagctggatgatctcctcctaagtatagcaaacttgccagaaatgtttggctagttgaagattggaagcaaaagggcaaatgtaaactcattgcctatcacttcatctgcttccccgtgtgtgtttgtggtgagtgttcatttgagattgtgtgtgtttgtgatgatatgaaagctgttgcagtaatagtgratgaaaacatattattctgctttagagaaaagaagatgccttctttcttatcagtgcaacaaatttagggattaactgaaactgatctctggtggcatttctcagattctattaaacctagtctgctaaggggctgtccaggtaatattagaagatttcacttcgtagaggagacgcaaatattttgaaacaaaatctcaccgctcgcagcttggccaaactggctccaacattcagctggtgttcacatagcttttcatacacatggtcacaaaagtacaaaatgctgaaaggcatttt

SEQ ID NO: 32050 - DNA, 601 bp, Human
tggccaaactggctccaacattcagctggtgttcacatagcttttcatacacatggtcacaaaagtacaaaatgctgaaaggcattttcagtaggcttagttttggctgaactctaattatgacaccctcgagagaattctgataaaagagaagagccgaggccatctgaacttctttctgtcaggcttttgtccttgtgcaaagtgcttccgttcctgatgtctcggttttctatattttaataaagcacagtatagaaaatgaactatttcttgtcaatcttgaagagttatgaactcragagctgttacatggcattaaaatgctttctaaaatgaaagccatacctgaattagggcatttcaagaaattgcgattataccagtagcaggaatatcaaccttgcttgatttttatattttctttctcaaaatgggttccacacttatttcatatagatttattgcttttaatattgttactgtaattatagttccttctcttgacctgtatttacacattatttttagcttctttcatagaagaaaacataaaacatagttttaatttcacagaattacaccaaattcttaattggat

SEQ ID NO: 32051 - DNA, 601 bp, Human
tgcttatttttctttgtattattggatactaattacagtaatacctagccttatgctattgattgggctgtcaaattggccatttattaaagtaaaaataagtacaattaccaagtcaatatatggttcatctatttcaataaggaataaataataaaagtttctgaaaccatgataaattccaatttaataatatgttacattggaatgtacttttaccatttaagaaaagttttatcttgcctttttattgcctatgtaattttcccctatatttaaaatgtaatattcttcacatcarcccagtgtggtggtgtgctcctgttgtcccagctacgcaggaggctgaggcaaggggtccttgagcccgggatcagtctgggcaacacggtgagaccctgtctttaaaaagcaaaatgaaatccttcatctttaacgtcatttaatattagctacatgaacaatattctttgtagaaaaagtctgattgcggtgaacttggctgttcttatctatggatgtcctgctgtgtttgccgtcttcctatagatgaaatctttttcttaaattctcctaagctctcggagccctttagggtcaa

SEQ ID NO: 32052 - DNA, 601 bp, Human
tcaataaggaataaataataaaagtttctgaaaccatgataaattccaatttaataatatgttacattggaatgtacttttaccatttaagaaaagttttatcttgcctttttattgcctatgtaattttcccctatatttaaaatgtaatattcttcacatcagcccagtgtggtggtgtgctcctgttgtcccagctacgcaggaggctgaggcaaggggtccttgagcccgggatcagtctgggcaacacggtgagaccctgtctttaaaaagcaaaatgaaatccttcatctttaamgtcatttaatattagctacatgaacaatattctttgtagaaaaagtctgattgcggtgaacttggctgttcttatctatggatgtcctgctgtgtttgccgtcttcctatagatgaaatctttttcttaaattctcctaagctctcggagccctttagggtcaagattttgccaggagatagaaagtttcctttatactttgattaaagaagggaagacaagtccataagaaattgatgtacttaataatgaatgaacttggtctgaaattacccccaacctcttagtttctcagattaa

SEQ ID NO: 32053 - DNA, 601 bp, Human
ttaataatgaatgaacttggtctgaaattacccccaacctcttagtttctcagattaaaccattagtcacactttacctttgttaatatagacatctttcttgcttcatcttctttactcccttcttccttctctcttttctccctaactatttattcctctatgcctcctttctacccattctcctatgtctatagactctttgtgtctccttcaaatccttgccctccacatcaactcccgcacctggtgcaggtagatttgtggcccttccctgtggagaagaatgttcctggtatgrttacccagtcctagcctttttcattcataatgtcacctgggccctttttcattgacattgtcaccttgactttttaaaaaagcatcatttggggtggtaactcctatacacttgaggtctcattgttctgcactaaaatagcaaatcttgaaatagcgtaagatgggccgatgaaagagtgaaaagactcattgtcaagtggagatctactttcacatatataaataggaagcttgcctctgacattgatcagaagctgtaaagagaaaggcttttctctgaaaaacacggaattatctc

SEQ ID NO: 32054 - DNA, 601 bp, Human
ataaattaaattgcttgctagcatggcagctcatgtctgtgatcccagaactttgggaggctgaagtgggaggattgcttgagcccaggagtttgaaaccagactgggcagtatagggagacttcttctctacaaaaaatttaaacaactagccaggaggcccaggtaggttgatcacttgagctcagaagttttagaacagcctgggcaacatggagaaaccctgtctctccaaaaaatacaaaaaattagctgggcatggtgacacctacctgtagtcccagctacttgggaggctgargtgggagatcacctgaccctggggaggtcaaggttgcagtgatcacaccactgcacacgagcctgggcaacagagtgagaccgtgtctcaaaaaaaaaaaaaaaaaaaaaaaaatcaaatctcttgcttttgttttctttacttgtaacattttcacctaaggggaaaatgccatatttcttgtcatcataaaataagaggtgggaattactaagtttaaatttgccgattagtttcgatgattcaccagtgcttgatgattaaggggtattggtgcagtgccactgagttgctgttcat

SEQ ID NO: 32055 - DNA, 601 bp, Human
gctgaagtgggaggattgcttgagcccaggagtttgaaaccagactgggcagtatagggagacttcttctctacaaaaaatttaaacaactagccaggaggcccaggtaggttgatcacttgagctcagaagttttagaacagcctgggcaacatggagaaaccctgtctctccaaaaaatacaaaaaattagctgggcatggtgacacctacctgtagtcccagctacttgggaggctgaggtgggagatcacctgaccctggggaggtcaaggttgcagtgatcacaccactgcacacsagcctgggcaacagagtgagaccgtgtctcaaaaaaaaaaaaaaaaaaaaaaaaatcaaatctcttgcttttgttttctttacttgtaacattttcacctaaggggaaaatgccatatttcttgtcatcataaaataagaggtgggaattactaagtttaaatttgccgattagtttcgatgattcaccagtgcttgatgattaaggggtattggtgcagtgccactgagttgctgttcatagtctccagtaagggcagtacaagagaggagaaaagtaaagttgcacatcaggccaata

SEQ ID NO: 32056 - DNA, 601 bp, Human
taatgctgttgtttttttcccttcgtttatttatctttaattgacacctgttgctattcttatgcctgctcaccttcacataaatgtcagcatccatgcaccatgtatgtcacacacacacacacacacacacacacacacacacacccctctaaaagttctgatgagtatttgataaatagtagagttttgaggagagatggaggaaagtgtttacaagtttaactttttgaatttgcttttaactctctgctgttccctcacctgtaaaatctgcctcatctctgcccctctttcttcytgcaaacctcacttctcatagcctcctccagcagcactgacttctggagattccctgtcagtgaaataaaactggaaagctggtctcataataaaagcccaacagtttatgggcaaagcccaaccacctgtggttcttcaggtgtggttttcttgaggagtgcttatttaccctgccacattttcctctctttctctccaaggaggctttctctccagggtggattaagtgaaattatgctgttacttagggactgatttacatatttcttatccctcacactctgggtttctctatgtt

SEQ ID NO: 32057 - DNA, 601 bp, Human
ccagcagcactgacttctggagattccctgtcagtgaaataaaactggaaagctggtctcataataaaagcccaacagtttatgggcaaagcccaaccacctgtggttcttcaggtgtggttttcttgaggagtgcttatttaccctgccacattttcctctctttctctccaaggaggctttctctccagggtggattaagtgaaattatgctgttacttagggactgatttacatatttcttatccctcacactctgggtttctctatgttagctacatctaggaaaaaaatggggaaraaaatcaccttgattggaagtgcagttaattcctgaaaataaagcctgatcacgagtggtaatcacagatcaattagttactggatccctagataatgcatccctgtcattgtgagacaaaagaggggaaagtggggtgggaggaggggaacttggcttggaggcagggtgagttccattcccagttacaagaccttaggcaagttgactgacttttatttattcctcattgccataatagggaatgtattaaaaaatgtattaaaatagggaatggattaaaaaatagtcatttctcag

SEQ ID NO: 32058 - DNA, 601 bp, Human
ttagctacatctaggaaaaaaatggggaaaaaaatcaccttgattggaagtgcagttaattcctgaaaataaagcctgatcacgagtggtaatcacagatcaattagttactggatccctagataatgcatccctgtcattgtgagacaaaagaggggaaagtggggtgggaggaggggaacttggcttggaggcagggtgagttccattcccagttacaagaccttaggcaagttgactgacttttatttattcctcattgccataatagggaatgtattaaaaaatgtattaaaatagrgaatggattaaaaaatagtcatttctcagtttatttacgtagtgataaaaacaaaaaataattataaagttcttggcaaatgcaatactaaagaaaatagagcaattaatcattctaccatttcccagatatgtcctccttctaagagacaagacactgtgacttctttgtttttattaacagctttgtgatgatataattcacatgccatacagctcatccatttgaagtgtatagttcagtggttctcagtaattcgcagagttgtgcatccatctccacaattaattttagaacatt

SEQ ID NO: 32059 - DNA, 601 bp, Human
ttttattgtctgcttttcatattgcagccatcctagtggccatgaagtggcatctcactgtggtttggattttgcatttctctgatggctgatgaggttaagcatcttttgattgatcatggcttctttgaaacatcaggtacagctctgaccatagcatgaaagatggaaagccattacacattttcttattctggaacgaaaagtcatgctacactctttatgagacctcacataatatagttgagagagttaagaggagggcactctaacctattagcagtgaggataataattggarttttccccttactttgcctcagccactttggtcttctcttttagtttctgaatagagtggggctatttaaatctaagggccattgtacttgctatttcctttgcctctaagtgcacctcctctaacattttgcatgagtcattccttctcattatttaggtcttagctcaaatgtcacttcctgttcagatatggctaaagtagcttctcatcctttagtctccttctgtgacatcatgcattttagttccttcatgtcactcttgcaatttgaaatgattttttttttaatagagatgg

SEQ ID NO: 32060 - DNA, 601 bp, Human
tctctgatggctgatgaggttaagcatcttttgattgatcatggcttctttgaaacatcaggtacagctctgaccatagcatgaaagatggaaagccattacacattttcttattctggaacgaaaagtcatgctacactctttatgagacctcacataatatagttgagagagttaagaggagggcactctaacctattagcagtgaggataataattggaattttccccttactttgcctcagccactttggtcttctcttttagtttctgaatagagtggggctatttaaatctaagsgccattgtacttgctatttcctttgcctctaagtgcacctcctctaacattttgcatgagtcattccttctcattatttaggtcttagctcaaatgtcacttcctgttcagatatggctaaagtagcttctcatcctttagtctccttctgtgacatcatgcattttagttccttcatgtcactcttgcaatttgaaatgattttttttttaatagagatggggtctcgctaaattgaccagactggtctcaaactctaggcctcaagtgatcctcccatcttggcctctcaaagtgctg

SEQ ID NO: 32061 - DNA, 601 bp, Human
ccccgaccttccatgctcaagtgatcctcctgcttcagcctccccaatagctggaactacaggtgtgcaccaccatgcctggctaaattttgtattttttatggagatggggttttgccatgttgcccaggctggacttaaactcctttggtactttttaactttagtatgcaaaatgacaattatacacatgccactcttgtgttttctttaaaataatataaaaagtaaactttagtacttcagaagaaacactggaccagaacacagagaccatgtctccatatacctcgtataaacrggtctgactcctggctgtcagaataaccctatatgatccctagaatcatttctgatgcccacttttatgattctttgcaaacggcatttgtgttctcaggatccttctgttttctacacttggccaatattattaacataattgaaaacattaaaatatatcgtaaaagggaatcgtttaatctgatagtaggagaaaataaaagacaataatccttctattgaagaaagaacaaaagaaaatgcaacatgaagattttacatcacacaggcagccgccctagaggaggtgtatcatttt

SEQ ID NO: 32062 - DNA, 601 bp, Human
tggtgatatgaagtctaaatagaggccaagcatggtggctcacacctgtaatttcagcactttgggagtctgaggcaggtggatcgcctgaggttgagagtttgagaccagcctggccaacatggtgaaaccctgtctctactaaaaatccaaaaattagccaggcgtggtggcacacatctgtaatcccagctactctcctggaggctgaggcaggagaatcacttgaacccaggaggcagagactccatctgaaaaaaaaagaagtctaaatagaatagggagtaactgctaatggccrtggggtttcttttcgggatgatgaaaatgctctagacttataagccagctacttggatagtttctccaaatatttgtgagagtaaacttgttgttattattctagcatgtagaagaaggatcgatgaatctagatctgcatgtctcaaagtgtgttctttggacacaaattctcataaaatgcttagttaaatgataatcccactgtcacatacatttagggtgtgcacgtccccacgctttcttcaaaaagtcccatggtgtacatgggtatgttaaaggccctgcctgaggcatcctg

SEQ ID NO: 32063 - DNA, 601 bp, Human
tctgaaaaaaaaagaagtctaaatagaatagggagtaactgctaatggccgtggggtttcttttcgggatgatgaaaatgctctagacttataagccagctacttggatagtttctccaaatatttgtgagagtaaacttgttgttattattctagcatgtagaagaaggatcgatgaatctagatctgcatgtctcaaagtgtgttctttggacacaaattctcataaaatgcttagttaaatgataatcccactgtcacatacatttagggtgtgcacgtccccacgctttcttcaaaragtcccatggtgtacatgggtatgttaaaggccctgcctgaggcatcctggaggaaagaactggtctcactttgtacagttaagagttcctctcactgacttaacatgtaaccctgttcttgtttttttgagacagggtctcactctgtcacccaggctggagtgcagtggcaccatcacagctcactgcagcctctaactcctgtgctcaagcaatcctcccacctcagcctcccgaataactgggattaccatgcccagctaatttcttttttttttgagatgggggtgtctcactat

SEQ ID NO: 32064 - DNA, 601 bp, Human
aggtgtggtggcagctcaggtggcctaggatttgaaatgtgtgtccctaaccggggtggtgctaagcttgggaccaactggagatgctggctcctttatcacctgcgatacacggggctttgcttttctcctctttctcttctcctgcctcgacagataatgttgaattctctgcataaatatgaaccccaggttcacatagtgcgtgttggaagtgcccatcgaatggtaacaaactgctccttccctgaaacccagttcatagccgtgactgcctatcagaatgaggaggtaagagtgtgtgtgtgtgtgtgtgtgtgtgtgtgtgtgtgtgtgtgtgtaactgtcacctgggagatcatggcaggatgggcggggggggtccttttagatgaaaggtgggttttccaggatttggatacactcagcagacatgaagttaaacaatggagtagctgctctccctccctcttggctgtttgctaaaggctcaccagcatgtgctctcctggtgccaacaaggcacagctgtgcattgtcatgaaactcctgagttctgttgaaactctggagtctttgttgtcaggaccctatgtgtcct

SEQ ID NO: 32065 - DNA, 601 bp, Human
cgaatggtaacaaactgctccttccctgaaacccagttcatagccgtgactgcctatcagaatgaggaggtaagagtgtgtgtgtgtgtgtgtgtgtgtgtgtgtgtgtgtgtgtgtgtaactgtcacctgggagatcatggcaggatgggcggggggggtccttttagatgaaaggtgggttttccaggatttggatacactcagcagacatgaagttaaacaatggagtagctgctctccctccctcttggctgtttgctaaaggctcaccagcatgtgctctcctggtgccaacaagrcacagctgtgcattgtcatgaaactcctgagttctgttgaaactctggagtctttgttgtcaggaccctatgtgtccttggcctgtgcagagctgagtgtgtcttgagtgggtacaattgggcaggagctgtcaggtctcctgctctagaagcaagtctgtagcaagtgatccaaacatgcaccctcccttgggttttattatgctatcattactgcttgttaatgttcaatatcagcacagttagtctgctgctgcccagtgacttgagccgcctggctgtgagggctgagtggttagc

SEQ ID NO: 32066 - DNA, 601 bp, Human
aggaaaaaaaaaaagatcttgttgttgcttccatctatatttatttggaagctttaaagacagattttgggctgccactcagccaactgagtcagaatctccaaggatgatgctcagattctgtagatttaaaagtctccccagaggattctattgatcatccaggtttggaagctactgtcttgtgcctacaggtgaaatgaagttgcagatttaactcacatcacagatgtgcagagaaaatgtcatttctataagtaaactggcctcttggcagagcccctgcagccagtcaatggamacagaaatgaactagctaataatgtaaacagtccctcagctggtggccagtctttcgatgataaagtaattccattttgcagatagccctctctcccagcttttctccctgggctggagtctgggtctatgaggggaggtatggcctttgtaactctgggaaacggggtggtggggggtgcatgtggaattggagaccatgtcctaacctcctctggtctcccggcaaggcccctgcccactggtgtgctgttggtttagttggtggtgtgcggaacttgtcatttggctgctgacttgg

SEQ ID NO: 32067 - DNA, 601 bp, Human
ccaccgggaccgtcccacaacacgtgggaattatgggagctacaattcaagatgaaatttgggtagggacatagccaaaccatatctgggtcttattttgctttccttcttccatcaagtctcagatccttgctgacataaatattctgtgagctgggtgtggtggctcatgcctgtaatcccagcactttgggaggctgaggcaggaaaatcacttgaacccaggtggcagaggttgaagtgagccaagattgagctactgtactccagcctgggagcaagactcccgtctcaaaaaaattatatatatatgtgtgtgtatatatatattctgtaaatatttatttactcaacaaatatttgctgggcattactacatgctggatattgttctagatgctggaaatactgcaatgaataaaacagatgaataccctgtcttcaaggcacttacatcccagtggggagagatgaaaaataaatatttctttgtctctatctatctgttttatctctatcacgatcactatctatctatacgtcagatgtctctaatgagaaatgaagcaggctcaggctaaggcagatacagagagtgaca

SEQ ID NO: 32068 - DNA, 601 bp, Human
tgggtagggacatagccaaaccatatctgggtcttattttgctttccttcttccatcaagtctcagatccttgctgacataaatattctgtgagctgggtgtggtggctcatgcctgtaatcccagcactttgggaggctgaggcaggaaaatcacttgaacccaggtggcagaggttgaagtgagccaagattgagctactgtactccagcctgggagcaagactcccgtctcaaaaaaaatatatatatatgtgtgtgtatatatatattctgtaaatatttatttactcaacaaatatttgctgggcattactacatgctggatattgttctagatgctggaaatactgcaatgaataaaacagatgaataccctgtcttcaaggcacttacatcccagtggggagagatgaaaaataaatatttctttgtctctatctatctgttttatctctatcacgatcactatctatctatacgtcagatgtctctaatgagaaatgaagcaggctcaggctaaggcagatacagagagtgacagtgaatggcagtgatagtttgctttttgcattgacatggccccatgtgtaagtgattat

SEQ ID NO: 32069 - DNA, 601 bp, Human
ccaggtggcagaggttgaagtgagccaagattgagctactgtactccagcctgggagcaagactcccgtctcaaaaaaaatatatatatatgtgtgtgtatatatatattctgtaaatatttatttactcaacaaatatttgctgggcattactacatgctggatattgttctagatgctggaaatactgcaatgaataaaacagatgaataccctgtcttcaaggcacttacatcccagtggggagagatgaaaaataaatatttctttgtctctatctatctgttttatctctatcacratcactatctatctatacgtcagatgtctctaatgagaaatgaagcaggctcaggctaaggcagatacagagagtgacagtgaatggcagtgatagtttgctttttgcattgacatggccccatgtgtaagtgattatttatgaatgagggactcgatgctagatggcactcatccagaggggcaggatcacacctgtgctgctctccactgtgtaccaagtaactagaaaagtaaatcacatgtagtaggggatcaaggattgttgaaaaaaataaatacatgagtaaaaaaatgaatg

SEQ ID NO: 32070 - DNA, 601 bp, Human
aaagggcctctgcctctcagagtgctgggattacaggcataagccatcgtgcctggtgggaaagggaaggaaaagagagggaattaaactggttttacagaagacaaagggttctgtttgcccatgtgtatcctacttttactaacacttcttgtctttgtaaatgcaagataacggctctcaaaatcaagtacaatccttttgccaaagccttcttggatgccaaggaaaggtaagtaaagaaattttagtgaaatcttctaatgaatgatttatgcaaatacaaatgtggaatttatgrttatcttgaaaggaactagactagtagcactttcattaccttttatagaaataggctttcggccaggtgcggtggctcatgcctgtaatcccagcactttgggaggccgaggcgggcagattacgagatcaggagatcgagaccatcctggctaacatggtgaaaccccgtctctactaaaaatgcaaaaaattagccgggtgtggtggcgggcgcctgtagtcccagctactcgggaggctgaggcaggagaatggcgtgaacccgggaggcggagcttgcagtgagccgagatggcgc

SEQ ID NO: 32071 - DNA, 601 bp, Human
gagccaccgtgcccagactctatgtcttttgcatcccaggaaaaagaagatgatggtgcttatcactgactttttaattgacaaagcctacagtataatatgattatctttttaatgttcagattttattgcttgagtttcaaatcttttaaatagtttttataactgtctaatctttcctgttcaccttaaaggctctgataaggctctagattaatggacagatgttcataatgatgcatcacatgaccctgtcctgtccaatatttgaatatattattattattattttagagatggkgtcttgctctatcacgcggactggagtacagtggtgtgatatagctcattgcagccttaaattcctgggctcaagctatcctcctgcttcagcctcccaagtagtggggactacaggcatgtgccaccatgcctggctatgtgttttttttaaagagacaggggctctcagtatgttgcccagacagtctcaaactcctggcctcaagtgatcctcctgcctccgcctccttagttgctgagattgcaggagtgagctactgtgcctagctccaatattggaataaattatgatgatata

SEQ ID NO: 32072 - DNA, 601 bp, Human
ctccgcctccttagttgctgagattgcaggagtgagctactgtgcctagctccaatattggaataaattatgatgatatacaagacacacttataacgttttcagttaacaaaaggcctaaaggataaactgatatgtgagatgacacaatctagattcaaagtgacagtagcatggtataatacaaagaatttaggactttgagtaagaggtcctgactgaatccttgctctgtaatttactggctgtttgttcttgcataagtcagtttacctcctcgagatccacttttctaatctayaaaattagaaaaatatgttaatatttccctcacagggtcattggtggatctagcatatcacatatgtaattgtgccatggaattgtgctgttattattgcttgaatcttgtcagtcaggagcaatatccccaaattattcagatcaaaataaacagggatagctgtaaatgtggtaaagaggggtaaacagtaaaactgcaactccaagagcaattgcacaagtagagacagcaccccgaaggaaggagaatggggaaggacaggagcttaggaaaaaggtgtttggttttcttattcta

SEQ ID NO: 32073 - DNA, 601 bp, Human
atacaagacacacttataacgttttcagttaacaaaaggcctaaaggataaactgatatgtgagatgacacaatctagattcaaagtgacagtagcatggtataatacaaagaatttaggactttgagtaagaggtcctgactgaatccttgctctgtaatttactggctgtttgttcttgcataagtcagtttacctcctcgagatccacttttctaatctacaaaattagaaaaatatgttaatatttccctcacagggtcattggtggatctagcatatcacatatgtaattgtgccmtggaattgtgctgttattattgcttgaatcttgtcagtcaggagcaatatccccaaattattcagatcaaaataaacagggatagctgtaaatgtggtaaagaggggtaaacagtaaaactgcaactccaagagcaattgcacaagtagagacagcaccccgaaggaaggagaatggggaaggacaggagcttaggaaaaaggtgtttggttttcttattctaagaaattgattgctcttcaaggagaattttgggtatgctttatagtggacatacataaaaagttggacagccatggt

SEQ ID NO: 32074 - DNA, 601 bp, Human
tgtgagttgggtgtacatgaggcgggaggtgcgtggggctgtacctggagccagctccttccacactcagactctttgcctgtcaggactgcttaaggacttccaaatcaaaacccaacacacagtttattctattaaggacaaatttgtgccctttccagaattccagagagagagccaatggtcctaggcttaagagacttaaaaaaatcttaggcaggagataagaatgaaaatgatgaatttcttagactctggttttcttgtcagtaaggctctgagccctcaacagtgtgttctyggcttgcctcctaacgttatgcttgccactctggtctctctgttttggagttctcctgttcttagtgtttgctaattttggagttggttcccatagcaatgtgtcatgcaggctgtagcctccatggggaagagtctttatttgtgggctggaaggctgtaggaagaggtggagtaatatagctgggattctgaaggtagtgttggatgttcccatcagggtgttaccttgtccatgtcccaggatggtggagggaatcctctgcagctgcaatgcaacccacgatcagtgacatcagag

SEQ ID NO: 32075 - DNA, 601 bp, Human
tgcttaaggacttccaaatcaaaacccaacacacagtttattctattaaggacaaatttgtgccctttccagaattccagagagagagccaatggtcctaggcttaagagacttaaaaaaatcttaggcaggagataagaatgaaaatgatgaatttcttagactctggttttcttgtcagtaaggctctgagccctcaacagtgtgttctcggcttgcctcctaacgttatgcttgccactctggtctctctgttttggagttctcctgttcttagtgtttgctaattttggagttggtycccatagcaatgtgtcatgcaggctgtagcctccatggggaagagtctttatttgtgggctggaaggctgtaggaagaggtggagtaatatagctgggattctgaaggtagtgttggatgttcccatcagggtgttaccttgtccatgtcccaggatggtggagggaatcctctgcagctgcaatgcaacccacgatcagtgacatcagagtaggaaagttaaccctgatgtctgaaaccctctttaatttggattatattggcttgcaaagatcccttatgcagtttgccagctgcaga

SEQ ID NO: 32076 - DNA, 601 bp, Human
attctgaaggtagtgttggatgttcccatcagggtgttaccttgtccatgtcccaggatggtggagggaatcctctgcagctgcaatgcaacccacgatcagtgacatcagagtaggaaagttaaccctgatgtctgaaaccctctttaatttggattatattggcttgcaaagatcccttatgcagtttgccagctgcagagttctttacttcttccttcccttcaatcttactgcaccttccataacagacctgggagtatagccgcataaagagaagcagctctcagaaaagcactcttttttttttgagatggagtctcgctctgttgcccaggctggagtgcaatggcccagtcttggctcactgcaacctccgcctcccgggttcaagtgactcctctccctcagcctctcgagcagctgggcccacaggcatgtgccaccatgcccggctaatttttgtatttttggtagagatggggtttcaccatataggccaggctggtcttgaactcctgaccttgtgatccgcctgcctcgacctcccaaagtgccgggattacaggcatgagccattgcccccggccgaaaagcactc

SEQ ID NO: 32077 - DNA, 601 bp, Human
ttcccatcagggtgttaccttgtccatgtcccaggatggtggagggaatcctctgcagctgcaatgcaacccacgatcagtgacatcagagtaggaaagttaaccctgatgtctgaaaccctctttaatttggattatattggcttgcaaagatcccttatgcagtttgccagctgcagagttctttacttcttccttcccttcaatcttactgcaccttccataacagacctgggagtatagccgcataaagagaagcagctctcagaaaagcactcttttttttttgagatggagtctygctctgttgcccaggctggagtgcaatggcccagtcttggctcactgcaacctccgcctcccgggttcaagtgactcctctccctcagcctctcgagcagctgggcccacaggcatgtgccaccatgcccggctaatttttgtatttttggtagagatggggtttcaccatataggccaggctggtcttgaactcctgaccttgtgatccgcctgcctcgacctcccaaagtgccgggattacaggcatgagccattgcccccggccgaaaagcactctttaaaaatgactgtcaaccta

SEQ ID NO: 32078 - DNA, 601 bp, Human
taacttctgcattcagatagtatttctttttatttatttatttatttatttttgttatactttaagttctagggtacatgttcacaacgtgcaggtttgttacatatgtatacatgtgccatgttggtgtgctgtacccattaactcgtcatttacattagatatatctcctaatgctatccctccccactcccactaccccacgacaggtcctggtgtgtgatgttccccttcctgtgtccatgtgctctcattgttcaattcccacctatgagtgagaacatgcggtgtttggtttttygtccttgcgatagtttgctgagaatgatggtttccaccttcatccatgtccctacaaaggacatgaactcatcgtatttcatattgctatattccagtgttgctttagaggttttccaccctttgatagagtcctttgataggactgtaaccacctgataggttcttcctgctggttgcacaaaaagatgttactgagaaggggtcctgatccagaccccaacaaagggttcttggacctcatgcaagaaagaattcagggcaagtccacagagtaaagtgaaagcaagtttatttagaa

SEQ ID NO: 32079 - DNA, 601 bp, Human
tttgttacatatgtatacatgtgccatgttggtgtgctgtacccattaactcgtcatttacattagatatatctcctaatgctatccctccccactcccactaccccacgacaggtcctggtgtgtgatgttccccttcctgtgtccatgtgctctcattgttcaattcccacctatgagtgagaacatgcggtgtttggttttttgtccttgcgatagtttgctgagaatgatggtttccaccttcatccatgtccctacaaaggacatgaactcatcgtatttcatattgctatattcyagtgttgctttagaggttttccaccctttgatagagtcctttgataggactgtaaccacctgataggttcttcctgctggttgcacaaaaagatgttactgagaaggggtcctgatccagaccccaacaaagggttcttggacctcatgcaagaaagaattcagggcaagtccacagagtaaagtgaaagcaagtttatttagaaagtaaaggaataaaagaatggctacttcataggcagaacagaggcatgggctgctcaactgagtatacttatagttatttcttgattatatgcta

SEQ ID NO: 32080 - DNA, 601 bp, Human
ttgaagtgtcttttagcattctaatgcattatgattcgcatataactagcagtgaggataaccagaggtcattttcattgccatcttggttttggtgggttttggccggcttatttactgcatcctgttttatcagcaaggcctttgttgtatgttgtgctcacctcctatcttatcctgtgactaagaattcctaaccacctgggaatgcagcccagtaggtctcagcctcactttacccggcccctattcaagatggagtcactctggttcaaacacctctgacacaaagaccacagcrttgcaataaagaaagagtttaatagacatgaatctggccatgccattttggggacagagctcttactcaaatcaatctcttcaaaaacttgtaggttaggttacctttttcagaggcaatttcagggaagaagtgggggtagctagacaataggtgcttgctgctgattggttggatcagagatgaaatcacagggaattgaagctgtcctctggtgctgagtcacttctgggtggggccacaggtggggttggtgggtccaggtggagccactggtgtcagatatgccaaaaacctgaa

SEQ ID NO: 32081 - DNA, 601 bp, Human
tgaggataaccagaggtcattttcattgccatcttggttttggtgggttttggccggcttatttactgcatcctgttttatcagcaaggcctttgttgtatgttgtgctcacctcctatcttatcctgtgactaagaattcctaaccacctgggaatgcagcccagtaggtctcagcctcactttacccggcccctattcaagatggagtcactctggttcaaacacctctgacacaaagaccacagcgttgcaataaagaaagagtttaatagacatgaatctggccatgccattttggrgacagagctcttactcaaatcaatctcttcaaaaacttgtaggttaggttacctttttcagaggcaatttcagggaagaagtgggggtagctagacaataggtgcttgctgctgattggttggatcagagatgaaatcacagggaattgaagctgtcctctggtgctgagtcacttctgggtggggccacaggtggggttggtgggtccaggtggagccactggtgtcagatatgccaaaaacctgaaaagatatctctaaaggcctatcttaggttctacaatagtgatgttatctgca

SEQ ID NO: 32082 - DNA, 601 bp, Human
caaaaacctgaaaagatatctctaaaggcctatcttaggttctacaatagtgatgttatctgcaggagtaattgggaaagttgcgtatattgtaaagtctggaataatggctggcaatcatttgtgtctacatcttagcagaattcaggctcctctatgctcctagcctggtagtctttcattagctttacaaaggcagttgagttttagagaaggattactattatttaaactataagctaaatgtctcccaaagctagcttggcagcttgaaggctaaaggcaagagggagattgggtrgatcagaagtcttcaactgccaaaattttctcactgatacaatttttgcaaaggcagtttcaggactggtcatgcatttccagagaagccaagttagctgctcatgggcaagggcagtggcagctaggggatggtaccaccacacaggctggcaccatcacacaggctggcatcagtgtcatttacaagaattgtagctgtgtaaagtagctggtcacctgatttttggtgtgggagttcacagactcagtcttggtgtattcctcttgtctattttagtgggaggctggatcttttcca

SEQ ID NO: 32083 - DNA, 601 bp, Human
gagaaatggataaacagctaggaaaaggagtagctaaagatggaaccccgtcatctaatatacatctatgatatgattgtttttgtgttttattttattgttattttatgtacaaatatttgattaactaggtataacaatcttagttttttttaaaaaaattatttcataaaacccccagtctcctggtttctaatgagcgtgaaaggccaggacactgatattctgagcagttcaggcagatctctaaaagccatgtcaagttgtgtgggtctgaaacactcagctcatcaccttcgcwtggctcttttctatagttgcattcatggctcagttcagggaatactgggtctagcattagggaattattaggaaggtctctgggaagctggatccctatatgttcaggccttagtctgattcagttggagacatgcaaacccaaccttagtattttaaaataatttttgctgtctgtttgttttaagttagcagtattgtttgtgtgcttttttctcattgactattgccttttccacctttgccttatgtaggcccagaccttgcctgattattagatttgtagaaagaagggagaaat

SEQ ID NO: 32084 - DNA, 601 bp, Human
aattgcttgaatccgggaggcagaggctgcagtgagccaagattgtgccactgcactctagcctgggcaacaagagcaagacgccatctcaaaaaaaaaaaaaaaaaaaaaagatatagcttcttccctggaggagctcggggttacacaaatacgtaaataatgaatcctaatgtaatgcagaaacatcacctgggaacttgttagaaatgtagactttcaggctctactcctgagtcagggtctgcattttaacaagatcaccaggggattcataagcgctctagaatttgagaaacartctataaaacacataagtcagggtgccatgtgaatgaaggaaaaagagcagctagatatgcctggtggaggagcaaaggctgcccagaggggttaacatttaaatggagccttgaaagatgaatagaaaaggacagagtgggagtgggcaggggtaaaaggtggaggatgacatgtgccaaaggcagaggtgcagggcattccaggtagagagagtgggctgagcaaagatacagaaaggggaaagaccctaggttgtctgggaacagctttggagcagagtgtagggggagtggggaca

SEQ ID NO: 32085 - DNA, 601 bp, Human
cagaaaggggaaagaccctaggttgtctgggaacagctttggagcagagtgtagggggagtggggacagatggaagatgtaagagttagggctggagagcttggaagtgccagatcgtaaaaagaagagacatggccaggtgtcttagtcccctttgtggcgctataacaaaatacttgagattgggtaatttataagcaatagacctttattttctcatagtcctggaggctggggagtttaagattaaggtgccagcatatggtaagggttttttggctgtatcataacattgcgaaargcatcacatggatggtgggggaaagagggggagagggcaggaggctaaacccatccttttatcagaaacccattcctgcaatactgacattagcctattcctgagggtagagcccccatggcctagtcacctcttaaaggccccacctctcaacactcttgcattgggaattaagttcccaacacatgaaccttgggggacacattcaaaccatagcaccagagatagacgttggaatcttccttctctctctcccttctcccccttttcccttccttcctccctccctctgccttcttc

SEQ ID NO: 32086 - DNA, 601 bp, Human
cacatagttactttttttcatgatgagagcacctgaaatctattctcttagcaaatttccagtacacagtacaatattattaactatagtcttcagattgtaagttagatctctagacttattcatcctacacaagtgcaactttatatcctttgaccaatatctcatttccccagcttcccacccctggtaaccactgttgtactctcagcttctatgtattcaactttcttagagtccacatataagtgagatcatattatgttcttctttttgtaaaaaggtatgtttttttcttaattttttttttttttaattgtagagatggtgtctctctgtgttgcccagagaggtctcaaattcctgggctcaagggattcccctgccttggactcccaaagtgccaggattacaggtgtgggcaccatgccgggccaaaaggcactgtgcttgagatatttaaacctactcagggatggccgagaagaataagttcctggacctcagaaatctcatctggggcactggtggcccttaggcttagcttgaggggaggctggtatggtcccttcttaaaagagagtgactgtggtgaaatgag

SEQ ID NO: 32087 - DNA, 601 bp, Human
ttgttatttccccaagtgaatttgatagaaagctcaagcaataatctgcaagttttctcgggacctgacagctggacttccttatcctccacaccccatgccagcatcctgtctgtaccccacaccaacggaccaatcaatccagggcccaggtaagaccaacaccatcaactcgctcattggtcgtcttgggggtttactttagcactggggactcaagttcattctttttcctagggtggcttggtctaacctattgtcttgacttctaaaacactaagaagtcaaggtggcaacaggrtggagttctttcataaggggagaaacagctcagtcatatactgtttcttttatttagaaggataggccgggtgcagtggctcacacctgtaatcccagcactttgggaggccaaggcaggtggatcacctgaggtcagcagttccagaccagcctggccaacatagtgtaaccccatgtctactaaaaatacaaaaattagctgggcatggtggcgcatgcctgtaatcctagctactcaggaggctgaggcaggagaatcgcttgaacccaggaggcagaggttgcagtgagctgagat

SEQ ID NO: 32088 - DNA, 601 bp, Human
gtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctwtgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcact

SEQ ID NO: 32089 - DNA, 601 bp, Human
aacccggaaatgcagggtgcagtgcggggggtaagggaccggccaactatgttgacccgactcagagaaaccccgcccttgccgccaccgcccacccataacgtcctcctcgaccctccctcgaccatccctcgccccgcggccctcaccgaaaaggggagggcggtggaagagagaggagtcaagggagcgcacgcgaagccccgcccctgccgtgacgtctggagacgcgacgcgtcgcctcgcaatgcaaatcgggaaaagggggtgagctgggctggcttccgtcctggtagccaasgctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggtagaatcagcttgtggagaggaaaggcccaaccttgagtcttttacgccatctacctaggattgccaagcgagtttcgtgt

SEQ ID NO: 32090 - DNA, 601 bp, Human
acatgtaaacgctttgattattcttactgctagttcctttgacaggtaagattcccaactcttaaggcaaaatgatacaaaaagtaattcatttggttaatgaaaatttgaaaaaaattattacattcttcactcatattctgcatatcttaaactcctgaaatagatattctaaacaatttaaaattaaccctgttagcaaaggatatggtttaggaatttttttttttaaactgctcacttgttttattgtgaatgaggaaaattagtataattatttgtatttgtttcaggaaagaascacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagaggtatgatgtatccttcgctagtttgattgaatcaaatattaatttttagttcgtttccatattaaagttagatgaatgttaaagtttatttgaaaaataacaccatcacacgaataaagtaggacctccttagagaaag

SEQ ID NO: 32091 - DNA, 601 bp, Human
aatttaaaattaaccctgttagcaaaggatatggtttaggaatttttttttttaaactgctcacttgttttattgtgaatgaggaaaattagtataattatttgtatttgtttcaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagaggtatgatgtatccttygctagtttgattgaatcaaatattaatttttagttcgtttccatattaaagttagatgaatgttaaagtttatttgaaaaataacaccatcacacgaataaagtaggacctccttagagaaagttgtaatgtaatcgtagcacaatacatatatattctgctcatatgcatattatctactctccagacagatcatacagatatgatctctaggtcataaagtttaagaggcaaagattatgaggcttctaaaaaaaaattcagccagaagtcattgtcttttcataaaacgatacaaaa

SEQ ID NO: 32092 - DNA, 601 bp, Human
gaaaataagcactaagaggtatgatgtatccttcgctagtttgattgaatcaaatattaatttttagttcgtttccatattaaagttagatgaatgttaaagtttatttgaaaaataacaccatcacacgaataaagtaggacctccttagagaaagttgtaatgtaatcgtagcacaatacatatatattctgctcatatgcatattatctactctccagacagatcatacagatatgatctctaggtcataaagtttaagaggcaaagattatgaggcttctaaaaaaaaattcagccrgaagtcattgtcttttcataaaacgatacaaaaataattcctttttggccgggtgcggtggctcacgcttgtaatcccagcactttgggaggccaaggtgggcggatcacctaaggtcaggagtttgagacaagcctggctaacatggtgaaaccccatttctactaaaaatacaaaaaattagccgggcgtggtggcgcacatctgtaatcccagctactcgggaggctgaggcaagagaattgcttgaacccgggaggcggaggtttcggtgagccgagattgtgcgattgcactgca

SEQ ID NO: 32093 - DNA, 601 bp, Human
tcacgcttgtaatcccagcactttgggaggccaaggtgggcggatcacctaaggtcaggagtttgagacaagcctggctaacatggtgaaaccccatttctactaaaaatacaaaaaattagccgggcgtggtggcgcacatctgtaatcccagctactcgggaggctgaggcaagagaattgcttgaacccgggaggcggaggtttcggtgagccgagattgtgcgattgcactgcagcttgggcaataagagcgaaactctgtctcaataataataataataataataataataataaatttttttttccactttgggaggccaaggtgggcggatcacctgaggtcaggagttcgataccagcctcggcaacatggtgaaaccccgtctctactaaaaatacaaaaattaacttggcatggtggcataggcctataatcccagctagtggggggctgagggatccctgagtccaggaagtggaggttgcagtgagtcaagattgcaccgttgcactccagcctgggtgacagagtgagactctgcctcaaaataaaattaaaaagatcttttgaagggcagaaagtaagagagggatt

SEQ ID NO: 32094 - DNA, 601 bp, Human
cagctactcgggaggctgaggcaagagaattgcttgaacccgggaggcggaggtttcggtgagccgagattgtgcgattgcactgcagcttgggcaataagagcgaaactctgtctcaataataataataataataataataataataattttttttttccactttgggaggccaaggtgggcggatcacctgaggtcaggagttcgataccagcctcggcaacatggtgaaaccccgtctctactaaaaatacaaaaattaacttggcatggtggcataggcctataatcccagctagtkgggggctgagggatccctgagtccaggaagtggaggttgcagtgagtcaagattgcaccgttgcactccagcctgggtgacagagtgagactctgcctcaaaataaaattaaaaagatcttttgaagggcagaaagtaagagagggattgggctatttatcttgcgaagttgggaagttgatgaggtgacagaaaacaactctaactcctgttgaatgattttcagatgggaaacaatgggaaagataaagccacctttagataagacaaggtcaggcctaagaccgtttattcctttct

SEQ ID NO: 32095 - DNA, 601 bp, Human
aaccttggctaggcgcggtggctcatgcctgtaatccgagcactttgggaggctgagatgggaggatcacttgaggtcaggagttcaagaccagcctgactaacatggtgaaacctcgtctctactaaaactaaaaaattagccaggcatggtggtacactcctgtaatcccagctacttgggaggctgaggcaggagaatcacttgaatccgggaggcagaggttgcagtgagccaagatagcccattgcactccagcctgggcaagaagagctagaccccatctcaaaaaaaaaaaaaaggagtgcacaacctagatccctcacatgtgcagttcacaatagggttcgtgctcctatgggaatctaatgccaccatgatctgacaggaggtggagctcaggtggtaatgcgagcaatggggagtgactgtaaatacagatgacactttgctggctaacccaccactcatcgtctgctgtgcgtcctggttcataacaggccgtgaaccagtaccaatctgtggccctggggttggggatccctgataaagattatctgtggactttgtatatgacctgtattttttcccagatgtcaat

SEQ ID NO: 32096 - DNA, 601 bp, Human
attaagtaagaaaacatgactgtgtttttttttatagtacttttattgcgctttcttaagagtcaaggtttagtctcttgtttttatgtgacagctttttatatatgactgacattgtacccatattacaaatgtcagtttgcaaaattgatactgatcactccctaaatcttttttttttttttttttttttttgagacggagtttcactcttgttgtccaggctggagtgcagtggcgtgatatcggctcactgcaacctgtctcctgggttcaagcaattctcctgcctcagcctccygagtaactgggattacaggcatgtgccaccaagcctggctaattttgtatttttggtagagatggggtttctccatgttggtcaggctggtctcaaactcccagcctcagttgatctgcctgcctcggcctcccaaagtgctgggattagaggcataagcctctgcatccagcccactcaccaaatctttaaacttctttttgcttttaatcctttgaacaggtgcttgtcttccatttgattgaagccatggatagggagggcaggggcaatataaatgaatagaaaaaattgatgact

SEQ ID NO: 32097 - DNA, 601 bp, Human
tagcaaagttattctaataatagttactaggttttttttgttttttgtttttttaaagacggagtctcactctgtcgcccagactggagtgcggtagctcaatctcggctcactgcaacctctgcctcccaggttcaagcggttctcctgcctcagcctcccgagtagctgggactacaggtgtgcaccaccacgtccagctaatttttgtgtttttagtagagatgggctttcaccatattggccaggctggtcttgaactcctgacctcatgatccgcctgcctctgccttccaaagtkctgggattccaggcttgagccatcatgcctggccaattactaggttttaaatctgtctttgaagagggggccccttgcatttggaggttcattcatctgtccacaatggatgaattagtcctgccctgggaaaaatactgtttaatatttttggccatacttatctgcaggtaagagacagaggccttcctaaattcaaacaagtttttgcacgctctgtgaaatatgttaaagtggaattgcttaaaacgcagtgtaagtggtgctcactaaagtaaatatttttgaaagtcttaaaat

SEQ ID NO: 32098 - DNA, 601 bp, Human
gagatgggctttcaccatattggccaggctggtcttgaactcctgacctcatgatccgcctgcctctgccttccaaagtgctgggattccaggcttgagccatcatgcctggccaattactaggttttaaatctgtctttgaagagggggccccttgcatttggaggttcattcatctgtccacaatggatgaattagtcctgccctgggaaaaatactgtttaatatttttggccatacttatctgcaggtaagagacagaggccttcctaaattcaaacaagtttttgcacgctctgtraaatatgttaaagtggaattgcttaaaacgcagtgtaagtggtgctcactaaagtaaatatttttgaaagtcttaaaatttggataactttggtagttttgttgtttgctgttttgtttgtgtggtaggtttttttttttttttttttttttaaggtgacagtcttgttctgtcacccaggctggagcgcgatggcatgattttggctcactgcaacctccacctcccaagttcaagtgattctcctgcttcagcctcccgagtagctgggattacaggcacccgccaccacgcctggcc

SEQ ID NO: 32099 - DNA, 601 bp, Human
aaacctatttttgtttaggaaatcatgaaagttgtttgaattcatatattcaggaatcaggaaagttctggtaaacctcagaagcaaacatttttagttatgtaataattggatgttatctttttcttctgtcaattatcatactattgaaattttggaagtatttatatttactttaactgtgctcctttaagagcacagagataaataattgacaggaaatctcactaatattaggggaatgtctgatagtgtgtaacagacatgcccaaccataaacaattttttgtgtttaaataggtttaagctgggcttacaggctggctttttggtgagttcatgtgtaaaaatgaataaaacaagttatagcatttttggttttactttgtattttgtatttattcagaatgattacattatgatttctgttaaatggttctgttaatgtaatgattacattgtattttctgttgagagaattgcatcagtagtcaggacatggtgtgctaactgaaattattgtaatgttcaattgatacgatattgaacaaactgtacacttttattggaattacatagtgaagggtccttctagtatatt

SEQ ID NO: 32100 - DNA, 601 bp, Human
aattttttgtgtttaaataggtttaagctgggcttacaggctggctttttggtgagttcatgtgtaaaaatgaataaaacaagttatagcatttttggttttactttgtattttgtatttattcagaatgattacattatgatttctgttaaatggttctgttaatgtaatgattacattgtattttctgttgagagaattgcatcagtagtcaggacatggtgtgctaactgaaattattgtaatgttcaattgatacgatattgaacaaactgtacacttttattggaattacatagtraagggtccttctagtatatttaggctttagaagaatcagccaaacaaagcatgatctacttttaggctagatagacatatgataactcttatcaacagactttttttgagacagggtctcactctgttgctcaggctgaagtacagtggcactatcatggctccctaaagccttgacctcctgggtacaagctatccacctgctttggcctcccaaagtgctgggattacaagcgtgagccacctggcctggccatcaacagatttttcttcttaaaaataagtcttatgttaactggga

SEQ ID NO: 32101 - DNA, 601 bp, Human
tttttgtgtttaaataggtttaagctgggcttacaggctggctttttggtgagttcatgtgtaaaaatgaataaaacaagttatagcatttttggttttactttgtattttgtatttattcagaatgattacattatgatttctgttaaatggttctgttaatgtaatgattacattgtattttctgttgagagaattgcatcagtagtcaggacatggtgtgctaactgaaattattgtaatgttcaattgatacgatattgaacaaactgtacacttttattggaattacatagtgaarggtccttctagtatatttaggctttagaagaatcagccaaacaaagcatgatctacttttaggctagatagacatatgataactcttatcaacagactttttttgagacagggtctcactctgttgctcaggctgaagtacagtggcactatcatggctccctaaagccttgacctcctgggtacaagctatccacctgctttggcctcccaaagtgctgggattacaagcgtgagccacctggcctggccatcaacagatttttcttcttaaaaataagtcttatgttaactgggacac

SEQ ID NO: 32102 - DNA, 601 bp, Human
aacaacaacaacaacttcattgtacttgttagtaaattatatgccaaatcttttaccttttgcattttttaaaggtggaattttttttttttttttaagacagagtttcgttctgtcgcccaggctggagtgcagtggcgcaatctcggctcactgcaacctccgcctcctgggttcaagtgattctcctgcgtcagcttcctgagtagctgggattacaggcacataccaccacacccagctggtttttctatttttagtagacatggggtttcaccatgttggccgggctggtcttgamctcctgtcctcaagtgatgtgcccgcctcggcctcccaaagttctgggattacaggtttgagccactgcacccggcctagattatactattaattatttattttctatcatttggtttttagttgcttagagtttcctaatgtgtaaaacttgttttatgtatcaaaagtgttttgactccagttgggatgtgagtagctattctaaagtacaggtggaagcaaaaatatctgtttagaacaagtaaacaaaacacattccatgttgtgtctgtacacaatttgctttattgtgagactg

SEQ ID NO: 32103 - DNA, 601 bp, Human
ttttgtatttttagtagagacagggtttcaccatgttagccaggatggtctcgatctcctgaccttctgatcctcctgcctcggcctcccaaagtgctgggattacaggtgtgggccaccatgcctggccccaatatttctttttttttttttttttttttctgagacggagtctcactgttgcccaggctggagtgcagtggcgcgatctcagctcactgcagactccgcccctggggttcacgccattctcctgcctcagcctcccgagtagctgggactacaggcgcccgccacctcrcccggctaattttttgtatttttagtagagacggggtttcactgtgttagccaggatggtctcgagctcctgacctcaagtgatccgcccgcctcagcctcccaaagtgctgagattacaggcgtgagccacccggccccaatatttctaatttataatatttgtaagtttctggcattattctttagaaaaattcaattcttcatatgttctttggtggattctgctcctggatactgtgcgtataggaatgaagtatttactgttacttttgatctgcttagttacagaagttattta

SEQ ID NO: 32104 - DNA, 601 bp, Human
ggtgtctttcatggacatttagagcaaccctgtgtgaacatatcttcatatctgtcctgtcctaattctgtaataagtcaaccacaaagctcttttcctcctttaagtctctgaaatctgcatgactagaatttctcttgtcaggccggcagtctgagaatgggcatgagggagggtatatgctctctaggtttggagaatagattataactttaaagtgaaagcccttaacatcttggggtagattttctgctaaattctgcctaatcatctgatgtcatggtctatgaccacggaggcrtgtgtgccgagtggggtccgtggcctgctggcccctgtcctaggggtggccgcatggtcccaggtgcggccgctatagacatagccccagattctgaaaaaaatgctttagcaaaaagacctagtgagtggctagaaaatagatttcagtatcacctgccattaaggaatacttgttaagcatttatttgcctgtcccgtttcttattattatcttttttcatggacacctctcataacatagacttaatccatttctgttacattcatgttaggggaggtcttagaggtaattttgacc

SEQ ID NO: 32105 - DNA, 601 bp, Human
catgcctcgctctcacttcagcttaccaactgaaattggaaagtaggagagacatcagctctatttaattagatttatggagactgtagaacaaatccaaggtagggggtaaggtgtggataagagaagaaaataggaaaaaagagaatcttaaagttttttcatttctgccctcaaattggatttaggctgactgtgcttacttcttagggcagacagttcacatactgttccagcatagagcactactagagaagaaatatagagcagtaggtaagtgtacggagccagactccctggktatggatcccagtttttttcttattaattgtgtgagcttgggcaaattacttagcctccctctgcctcagtttcctcatctgtaactaggataatcataaaacctacctcatagtgcattaagaaaattaacatttacaaacacttagatggtgtctggcacataccaaataataagtttttgtgctattattttcgttgttattaacagtggaagcattcttgttctgtaacacctttcgtcctggcactctagtgatttgcattgaggaggcaaggtaaaacagttgcataattttgc

SEQ ID NO: 32106 - DNA, 601 bp, Human
tgtaactaggataatcataaaacctacctcatagtgcattaagaaaattaacatttacaaacacttagatggtgtctggcacataccaaataataagtttttgtgctattattttcgttgttattaacagtggaagcattcttgttctgtaacacctttcgtcctggcactctagtgatttgcattgaggaggcaaggtaaaacagttgcataattttgctcttgttccaaatctttcacttctgtttctaacagtgaaatgatgctagcatatgagataggcaggaaagtggtgttgatrtttccatagagataataggaatacatgcttgctattctgtgaccaagttcttaacacagtgcagtagagaagtgggggaagtgagcataccagtaagcaaggtcctgctggagatttgagaatccattatccctggttattgcctaagcagatggaatatgatgaaacatctgtttttgtaaaattctatctgaagttactctgtttttcttttctcctctcacatctattgatgggttcatcattcacttttgttccatttattttattttaacacactgattttcataaatctattgt

SEQ ID NO: 32107 - DNA, 601 bp, Human
gcacgtttttggtcactattaacatgatgttgaaaatgtgtggtacaaaataattttgagttcagaagtcatttttaaagtaaacttaaaattttaaatatgtgaagctggcacagttatttgaatagtcaccatttctattgtatagttttatctgtttatttagaaatttttcattttggaatattcactcaaaagagcatataagaccaggtgcggtggctcacacacctgtaatctcagccttttgggaggccgaggcaggtggatcacctgaggtcaggagttcgagaccagcctkgccaacatagtgaaaccccacctctactaaaaatacaaaaattaggtgggtatggtggcacacaccggtagtcccagctacttgggaggttgaggcaggagaatcgcttgaacccaggaggcagaggttgcagtgagctgagatcatgggactgtaccccagcctgggtgacagagtgagactctgtctcaaaaaagaaaaaaaaaaaaaaacagccagccacggtggctcacacctataatcccagcactttggaaggctgaggcaggtgggtcacctgaggttaggagtttgagacaa

SEQ ID NO: 32108 - DNA, 601 bp, Human
tagtagggaatagttctaaattcctcagatatctgctaactgtagttcagatagctgtttaactgccaacaagttggaaatttcagtgaagtcatcctttaaaaaaatgtaacttgggaccttggtaagactttccacagctttttgaatgtttgttttcacatttttattctaaattatcaacataagtgtgatatttgggctgtttcttttgcagaaaaaattaggatttttcctttgaaaagcaaattgcagcagatttgaatcaatataaaaggttgaaattagtaggagagaaagrgcaaaaagcactaaataatttcaacttgagaacatacagtttctttttaatagttctgggcaatttgaagtaaatctacagatggcctcaggtggcagatgtgtgaattgtggtggagggagaaagcatatagccatgaaatacctcaaggcaggatactaattttacagaactgaaactcctttaatttccacgattaacgccaataaaagacaatcttgacttattttttcaactagatatgaagaagctgaagtccggaaaaaacttgaggaaaaagacaggcaggaggaagcacag

SEQ ID NO: 32109 - DNA, 601 bp, Human
atcctttaaaaaaatgtaacttgggaccttggtaagactttccacagctttttgaatgtttgttttcacatttttattctaaattatcaacataagtgtgatatttgggctgtttcttttgcagaaaaaattaggatttttcctttgaaaagcaaattgcagcagatttgaatcaatataaaaggttgaaattagtaggagagaaagagcaaaaagcactaaataatttcaacttgagaacatacagtttctttttaatagttctgggcaatttgaagtaaatctacagatggcctcaggyggcagatgtgtgaattgtggtggagggagaaagcatatagccatgaaatacctcaaggcaggatactaattttacagaactgaaactcctttaatttccacgattaacgccaataaaagacaatcttgacttattttttcaactagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaa

SEQ ID NO: 32110 - DNA, 601 bp, Human
gaatacatggtaaactttaagtaggacttattatcatttatgactaggttgtagatttaattttttctccccccatccatcctgtggtcaaagactaaattatttaacagtcatttacatcccccataaaaaaaaatcgaggccaggcacagtggctcactcctgtaatcccagcactttgggaggctcaggaaggaggattgcttgagcccaggagttcaagaccagcctaggtaacatggtgaaacccctgtctctacaaaaaatacaaaaattagctgggtgtggtggtggatgcccktagtcccatctgctcaggaggttgaggtgggagaattgttcgagcccgggaggttgaggctgcagtgagccacgatcacaccactgtactgcagcctatgacagtgagaccctgtctcaaatccaaaccagtaatatggaaattatccataggtggcgttgatgctctagtgacaaatatgtgacctaaacaagactttggaattcctcttcatctgctagagacgttttcctctctcagaaaaggtttaccttgtctacagccataccacctaacgcgcccgatctcgggagcgaagca

SEQ ID NO: 32111 - DNA, 601 bp, Human
catccatcctgtggtcaaagactaaattatttaacagtcatttacatcccccataaaaaaaaatcgaggccaggcacagtggctcactcctgtaatcccagcactttgggaggctcaggaaggaggattgcttgagcccaggagttcaagaccagcctaggtaacatggtgaaacccctgtctctacaaaaaatacaaaaattagctgggtgtggtggtggatgcccttagtcccatctgctcaggaggttgaggtgggagaattgttcgagcccgggaggttgaggctgcagtgagccaygatcacaccactgtactgcagcctatgacagtgagaccctgtctcaaatccaaaccagtaatatggaaattatccataggtggcgttgatgctctagtgacaaatatgtgacctaaacaagactttggaattcctcttcatctgctagagacgttttcctctctcagaaaaggtttaccttgtctacagccataccacctaacgcgcccgatctcgggagcgaagcagggtcaggcctggttagtacttggatcagagaaaaggttgaacttaaacataattataggtaacagtaaaata

SEQ ID NO: 32112 - DNA, 601 bp, Human
ggtcttttagcataggagctactgagactacttttcttctcacagctcactgctgaaacagcttattatataatctcaactctcttgtagtgccttttaatctttcacttcagtagagctaaggaaaaatagtaacatagggaatatttattttgacagattgctgccctcccccaaaagtaaataaattaaatattgcattagctttacttagtttcctttttgttagccttcttagaaaacaaaataatcttttttccttctggctgggagctaacaaatgaacatcaagtagaatgasaattggcaaatttttcttaaagggatagatggtaaacattttaggcttggggaaccttatgggcttggagagtcctgtggtctctgacacaactattgatctctgctgttgcagtatgaaaaaatgtgtaaacaaactagtgtggcagtgatccagtaaaaacagatggccatagtttttcaacctctgatgtagaatagcaagcttttgacttgttattctaagaatacttggatatctaagtttttcaaaaagctaccgtaagactgccatcagagaccttttgaatttagaactttt

SEQ ID NO: 32113 - DNA, 601 bp, Human
tctgacacaactattgatctctgctgttgcagtatgaaaaaatgtgtaaacaaactagtgtggcagtgatccagtaaaaacagatggccatagtttttcaacctctgatgtagaatagcaagcttttgacttgttattctaagaatacttggatatctaagtttttcaaaaagctaccgtaagactgccatcagagaccttttgaatttagaacttttccagaattttagaaccatagatatttctttcttccagttagcatttttctaatgtcttaatttttgaaaacatactattttcmtgagacacatatattaatgttctttattttatgttggtaacagagtcaataccaggtgtagctgtaaactcaacagaaagttttgatttttaagtctttgtaaacagagcatcgaactggtttcttgataaatgttaaaaacacaaggtcaggtatgtggtggctcacgcctgtaatcccaacactttgggacgccaaggtgggcagatcgcttgaggtcaggagttccagaccagcctagtcaacatggtgaaaccccatctctactaaaaatacaaaaattagccaggcgtggtaaca

SEQ ID NO: 32114 - DNA, 601 bp, Human
agatatttctttcttccagttagcatttttctaatgtcttaatttttgaaaacatactattttcctgagacacatatattaatgttctttattttatgttggtaacagagtcaataccaggtgtagctgtaaactcaacagaaagttttgatttttaagtctttgtaaacagagcatcgaactggtttcttgataaatgttaaaaacacaaggtcaggtatgtggtggctcacgcctgtaatcccaacactttgggacgccaaggtgggcagatcgcttgaggtcaggagttccagaccarcctagtcaacatggtgaaaccccatctctactaaaaatacaaaaattagccaggcgtggtaacagcctgtgttcccagctactcaggaggctgaggcaggagaatcacttgaacctgggaggtggaggttgcagtgagctgagatcatgccactgcactccagcctgggttacagaacgagaccctgtctcaagaaaaaaaacaagttgtatttaatgttagtttacaagataataaatggtatgatggagtagtaaatatgtggcatccatatatattcagtatactttgctcttctag

SEQ ID NO: 32115 - DNA, 601 bp, Human
ctattttcctgagacacatatattaatgttctttattttatgttggtaacagagtcaataccaggtgtagctgtaaactcaacagaaagttttgatttttaagtctttgtaaacagagcatcgaactggtttcttgataaatgttaaaaacacaaggtcaggtatgtggtggctcacgcctgtaatcccaacactttgggacgccaaggtgggcagatcgcttgaggtcaggagttccagaccagcctagtcaacatggtgaaaccccatctctactaaaaatacaaaaattagccaggcrtggtaacagcctgtgttcccagctactcaggaggctgaggcaggagaatcacttgaacctgggaggtggaggttgcagtgagctgagatcatgccactgcactccagcctgggttacagaacgagaccctgtctcaagaaaaaaaacaagttgtatttaatgttagtttacaagataataaatggtatgatggagtagtaaatatgtggcatccatatatattcagtatactttgctcttctagaaaaagcggtttgtcctgtgttttgtgatgtcagcacatcttgtgctgtttcttgt

SEQ ID NO: 32116 - DNA, 601 bp, Human
gagtgaggggtgcccaagtgggatttccctaaatctttgcttcttaaagacacacctccaccctttttgaaggttgaagttacggatttgccaacttttgatttggctgttttctcctattggtggtatttagaatcttatcaaaagagaaatgaagttgccttttccctctctccccagatgtttgttaactgatttttcctattattttctgtttataagcatgtgaatcgtatgtaccaaattgattaaaataatgaactaattgaattgttttacatactgaaattccctatatttwctgtgatacacgctacacaaatactttgtgtgtgcttaagttaaaagagtatagtctctgatgccagactctattcaaataactgtcacttactagttgcattattactaggtagtgacctaacatttctaagctcaggtttccatctgtaaaatggggataatagtagaacatatcttacagaggtttcaggagatttaaatgagaaacattatatacacatacacactttagcacaggtcctggcacgagtaaggacttaatttaaatttttttctttcttttttggtaagaaggcct

SEQ ID NO: 32117 - DNA, 601 bp, Human
ttacctctcttggtcttggtttaaaattatatatttttaaaattaggtaataaaatctgtatagttcttggcatattgcagatgcttgataaatgtttgacctgaagcgtagagtgctttgtaaataagctatttaaaaattagagctcttaggccgggcacactggctcacacctgtaatcccagcacttggggaagccaaggcaggcggatcacttgaggtcaggagttccagaccagcctggccaacatggtgaaaccccatctttactaaaaatacttcagccaggtgaggtggcgyatgcctataatcccagctactcgggaggctgaggcaggagagtggcatgaacccgggaggcggaggttgcagtgagccgagatcacggcactgcactccagcctgggctacagagggagactctgtctcaaaaaaaaaaaaaaaaaaattagagctctttgaggaagacgctgttgaaggtagtgctgagctgtggtcagcccgctcctgctcctgctgtactgctgttgctctcgcagaggaaccggtcggtcaggaagccgcacagcagccgtggcttttaaagatgctggaaaaaca

SEQ ID NO: 32118 - DNA, 601 bp, Human
tcagcccgctcctgctcctgctgtactgctgttgctctcgcagaggaaccggtcggtcaggaagccgcacagcagccgtggcttttaaagatgctggaaaaacacccatggagccggagatagcaattcactgaattcgaatcactctctatgagccacagcataaaatccctggagaaggtgtgtgctgacttgatcagaggagcaaagaaaaagaatctcaaagtgaaaggaccagttcaaatgcctactaagactttgagaatcgctacaagaaaaactccttttggtgacggttctragacatgggatcatttccatatgagaatccacaaacaactcattgacttgcacatcctttctgagattgttaagcagattacttccatcagtactgagccaggagttgaggtggaagtcaccattggagatgcttaagtcaactattttaataaattgattactggttgttaaaaatatatatattagagtactcagtctaattaaacatgtgaatatattcccaggatttgaacagacgaagttataattagtctttgggtagtctagtctgtattaatagagagctggtggtcgttat

SEQ ID NO: 32119 - DNA, 601 bp, Human
tacaagaaaaactccttttggtgacggttctaagacatgggatcatttccatatgagaatccacaaacaactcattgacttgcacatcctttctgagattgttaagcagattacttccatcagtactgagccaggagttgaggtggaagtcaccattggagatgcttaagtcaactattttaataaattgattactggttgttaaaaatatatatattagagtactcagtctaattaaacatgtgaatatattcccaggatttgaacagacgaagttataattagtctttgggtagtctartctgtattaatagagagctggtggtcgttattactgagtttacatggaagtttcccaaaatgtgagatttggactactatgaaactcaagatgattttaggttgaagattaaagaacaatgaaatgcatactgagaaaattattctcttttaatttatgttacagtccttttgagttagtttaaaggagtttcagtttggtgctagtatatcttttaaatacttgcttatctctcttaactgaagggaacaggtctcagagctttctgtaggttacagtacctacaactagctgatagtg

SEQ ID NO: 32120 - DNA, 601 bp, Human
gttgaagattaaagaacaatgaaatgcatactgagaaaattattctcttttaatttatgttacagtccttttgagttagtttaaaggagtttcagtttggtgctagtatatcttttaaatacttgcttatctctcttaactgaagggaacaggtctcagagctttctgtaggttacagtacctacaactagctgatagtgattactgtattttttcattatctatttttatttatttatttttgagacagggtctcactctgtgcctgggttggagtgcagtggcatgattacagctcacygcagccttgacctcctgggtttagatgatcctctcacctcagcctcctgggtagctgggaatacaggcacatgccaccatgcccagctgatttttgtatttttttgtagagacggggttttgccacattgcccagacagctctcaaactcctgggctcaaacagtcctcccaccgtagcctcccagagtgctgggattatagatgtgagccattgcacccggcctatctgttcttaaaattttaagctttttattttattgtatttattttaattttttaaattttaatttaatttattt

SEQ ID NO: 32121 - DNA, 601 bp, Human
caattgatcctcatgtctcatgtctcagcctcccaagtggctgggattataggtgtgcgccaccacacccggctaatttttgtatttttagtagacacagggtttcactatgttggccaggctggtcttgaactcctggcctcaagtgatccaccggcatcggcttcccaaagtgctgggattacaggtgtgagccacggtgcccagcctatttcttttttaaacttttattttaggtttggtggtacatgtgaaggtttgttacataggtaaacgttttcacgggggtttgttgtacatrcatattttatcaccgaggtattaagctcagtacccaatagttatcttttctgctcctctccctcctcttacactcccccctcaagtagaccccagtgtctgttgtttccttctttgtgttcataagttcttaccgtttagctcccatattcttaacttttaatacattatagtatatataccgaagtactcctgtcttaagtgtctagcccaatgaattttcattaactgaatgcacccacttaattggcatccagaccaagaaacaatgttatcatcccccctgaacccgatatacccc

SEQ ID NO: 32122 - DNA, 601 bp, Human
ttgtatttttagtagacacagggtttcactatgttggccaggctggtcttgaactcctggcctcaagtgatccaccggcatcggcttcccaaagtgctgggattacaggtgtgagccacggtgcccagcctatttcttttttaaacttttattttaggtttggtggtacatgtgaaggtttgttacataggtaaacgttttcacgggggtttgttgtacatacatattttatcaccgaggtattaagctcagtacccaatagttatcttttctgctcctctccctcctcttacactccccsctcaagtagaccccagtgtctgttgtttccttctttgtgttcataagttcttaccgtttagctcccatattcttaacttttaatacattatagtatatataccgaagtactcctgtcttaagtgtctagcccaatgaattttcattaactgaatgcacccacttaattggcatccagaccaagaaacaatgttatcatcccccctgaacccgatataccccctgtaagttactacccgtatcccactgcccaaggaaaccaccagtttctgacagaatatattctttttgtctgcttttg

SEQ ID NO: 32123 - DNA, 601 bp, Human
ccccctgaacccgatataccccctgtaagttactacccgtatcccactgcccaaggaaaccaccagtttctgacagaatatattctttttgtctgcttttgtactttatataaatggaatttataatatgtagtcttttatatctgtcttctatacccaacctgtgtttgtgacagtcatctttgttattgtgtgtagttgtagtttgttcattctcattgccatatgatgttctgttgtgtgaatatagcgcaatttacttaaatattttatttatcttcagacataccttttacttacyggatatgatttcgttttttcatgtatttagggctatacaatttcctattaaatttatttaagtaaaaaattatttttaattaaattaattaaatttaataaaagacaagtagagcagagttggagcagattgtgaagatggtacataaaagacagaagtttgagaaatgttggctgatactgttgtttcccaaagtgttttctgtagaatactaatcctgaaaacagtatttaggtaaatatacccctagggttggaaatagtctttaagaatatcacattttattttttttccttcttt

SEQ ID NO: 32124 - DNA, 601 bp, Human
tttgtactttatataaatggaatttataatatgtagtcttttatatctgtcttctatacccaacctgtgtttgtgacagtcatctttgttattgtgtgtagttgtagtttgttcattctcattgccatatgatgttctgttgtgtgaatatagcgcaatttacttaaatattttatttatcttcagacataccttttacttactggatatgatttcgttttttcatgtatttagggctatacaatttcctattaaatttatttaagtaaaaaattatttttaattaaattaattaaatttrataaaagacaagtagagcagagttggagcagattgtgaagatggtacataaaagacagaagtttgagaaatgttggctgatactgttgtttcccaaagtgttttctgtagaatactaatcctgaaaacagtatttaggtaaatatacccctagggttggaaatagtctttaagaatatcacattttattttttttccttctttgttgaccaagcatccttctgatctgtgtacatcaggagaggatattagtagacaatattttatatttcttctacttctttacttcctggaagataca

SEQ ID NO: 32125 - DNA, 601 bp, Human
tgatctgtgtacatcaggagaggatattagtagacaatattttatatttcttctacttctttacttcctggaagatacagtaaccaacattattatataggaactggatttcaaaattaaaatgatcttatttggttttacttgtggataaaagttgtaccagtccggcccagcttgccagtatcatcagttaaatattgaaatgccacgatatactaagtgctttgctaagaataatatggagctccttacccagaggtgtaaatctgtattattcactcattcaattattaaatccaatttttttttttttttttttgagacagagtctcgctcttcacccaggctggagtgcagtggcgtgatctcggctcactgcaacccccacctcccaggttcaagctattcttctgcctcagcctcctgagtagctgagactccagtcatgcaccaccacttccagctaatttttgtatttttaattagagacagggtttcgccatgttggccaggctggtctcgaactcctgacctcaagggatcagccagccttggcctcccaaagggctgggattacaggtgtgagccaccgcgtccagct

SEQ ID NO: 32126 - DNA, 601 bp, Human
ttcaaaattaaaatgatcttatttggttttacttgtggataaaagttgtaccagtccggcccagcttgccagtatcatcagttaaatattgaaatgccacgatatactaagtgctttgctaagaataatatggagctccttacccagaggtgtaaatctgtattattcactcattcaattattaaatccaatttttttttttttttttttgagacagagtctcgctcttcacccaggctggagtgcagtggcgtgatctcggctcactgcaacccccacctcccaggttcaagctattctyctgcctcagcctcctgagtagctgagactccagtcatgcaccaccacttccagctaatttttgtatttttaattagagacagggtttcgccatgttggccaggctggtctcgaactcctgacctcaagggatcagccagccttggcctcccaaagggctgggattacaggtgtgagccaccgcgtccagctgattaaaccaatattcactgaacactttctgtgggctgggttactgtgttctaagtgctgggctaagccattgaacaaacaaaaaattgtctttggagcttttaacaga

SEQ ID NO: 32127 - DNA, 601 bp, Human
taaatattgaaatgccacgatatactaagtgctttgctaagaataatatggagctccttacccagaggtgtaaatctgtattattcactcattcaattattaaatccaatttttttttttttttttttgagacagagtctcgctcttcacccaggctggagtgcagtggcgtgatctcggctcactgcaacccccacctcccaggttcaagctattcttctgcctcagcctcctgagtagctgagactccagtcatgcaccaccacttccagctaatttttgtatttttaattagagacasggtttcgccatgttggccaggctggtctcgaactcctgacctcaagggatcagccagccttggcctcccaaagggctgggattacaggtgtgagccaccgcgtccagctgattaaaccaatattcactgaacactttctgtgggctgggttactgtgttctaagtgctgggctaagccattgaacaaacaaaaaattgtctttggagcttttaacagagaggtgagataggtaagacgtacaataaaagcttgaaatgtttagtttgtcttatgttgagtgccttggaaatgggaatatc

SEQ ID NO: 32128 - DNA, 601 bp, Human
tttgcagtgagcagagatcgcaccactgcactccagcctgggagacagagcgagactctgtctggaaaaaaaaaaaaaaaaaatattgcaaggcagggccaggcgtggtggctcatgcctgtaatcccaacactttgggaagctgaggcgggcagatcacctgaggtcaggagttcaagaccagcttgaccaacatgcagaaacctcgtctctgctaaaaacaaaaaattagtcgggcatggtggtgtgcacctgtaatcccagctactcagaaggctgaggtaggagaatcgattgaacycgggaggtggaggttgcggtcagccaagatcacaccattgcactccagcctgggcagcaagagcagaactgtgtcttacacacacacaaaaaaagattacaaggcagaagacaggcagaaatatttacaacacatatggcagtggtttaaaatacctaaaatccaaagagcttctacaaataagaaaaatacttaagataaaatagtaaaataagtcgtgggcacagatagccatgaacagaaagtgaaatgcaagtggacgtaaccataaaaatggcaactttactagtatcagataaa

SEQ ID NO: 32129 - DNA, 601 bp, Human
ctgtctggaaaaaaaaaaaaaaaaaatattgcaaggcagggccaggcgtggtggctcatgcctgtaatcccaacactttgggaagctgaggcgggcagatcacctgaggtcaggagttcaagaccagcttgaccaacatgcagaaacctcgtctctgctaaaaacaaaaaattagtcgggcatggtggtgtgcacctgtaatcccagctactcagaaggctgaggtaggagaatcgattgaacccgggaggtggaggttgcggtcagccaagatcacaccattgcactccagcctgggcarcaagagcagaactgtgtcttacacacacacaaaaaaagattacaaggcagaagacaggcagaaatatttacaacacatatggcagtggtttaaaatacctaaaatccaaagagcttctacaaataagaaaaatacttaagataaaatagtaaaataagtcgtgggcacagatagccatgaacagaaagtgaaatgcaagtggacgtaaccataaaaatggcaactttactagtatcagataaatgcatattaaaacgagtgccattttcactgatcaagttaacaaaggtttaaaaaata

SEQ ID NO: 32130 - DNA, 601 bp, Human
tgcatataaactacacatattctctcatgtaatttaaatcttctgtagattccttataataactaataaaaagtaagtgctttgtaaatagttgttataccatattgtttggagaatagtgacaagaaaaaagtctgtacatgctcagtacagacataaccatcataggcctaactatatattttttaaatttatttgttttaattttaatttttatttttttaagagacaaggtttttctcagtcacctagacttgagtgcagtggcacaatcatagctcactgcagccttgaactcctrgctcaagtgatcctactgcctcagcctcctgagtagctgggactacaggtacgcaccatgcctggctaattttttaaaattttctagtagagacaaggtattgctatgttgcccaggctagtctcaaactcctggcctcaagcattcctcccaccttggccacccaaagtgttgggattacaggcgtgcaccactgtgttgggcatctaagtatatatatatatatatttttttaatttaatttaattttatttatttcgagatggagtctcactctgtcacccaggctggagtgcagtg

SEQ ID NO: 32131 - DNA, 601 bp, Human
gacaaggtttttctcagtcacctagacttgagtgcagtggcacaatcatagctcactgcagccttgaactcctggctcaagtgatcctactgcctcagcctcctgagtagctgggactacaggtacgcaccatgcctggctaattttttaaaattttctagtagagacaaggtattgctatgttgcccaggctagtctcaaactcctggcctcaagcattcctcccaccttggccacccaaagtgttgggattacaggcgtgcaccactgtgttgggcatctaagtatatatatatatatwtttttttaatttaatttaattttatttatttcgagatggagtctcactctgtcacccaggctggagtgcagtggtgcaatcttggcccactgcaacctctgcctcccaggttcaagcaattctcctgcctcgtcctttccaagtagctgggattacaggcgcccaccatcatgcacagctaattttttacttactgttttttgaagacatatcttactctgttgcccaggccaaagtgcagtggtgccttctcagctcactgcagccttgacatcctgtgctcaggtagtcctcccaact

SEQ ID NO: 32132 - DNA, 601 bp, Human
caggctggtctcgaactcctgacctcaggtgatcctcccgcctcggccttccaaagtgctgggattacaggcatgagccaccgtgcccgaccaatatatttatatatatttttaagtgatcatttctaagattagcaatatattgaaaaccttaaaatgttcgtgtaccttagcttaagcaactccctttctgggagttttccttaaggaggtgactaggtatgtgcatgtataaggatcttttgtgtttatttcagcattgcttataattaaatggggaaaaaacccaaatgttcaaacrattgactcagttttggggtctgtgtataaagtagaataggccatgtgcagcggctcacgcctataaatcccagcactttgggctgagccaggtcgatcacttaagcccaggagttcgagaccagcctgggcaacatggcgaaaccccagctcacgaaaagtacaaaaattagctggccgtgttggcgcgtgcttgtaagtcccagctactgggaaggctgaggtgggaggatcaatagagcccaagaggtcaaggctgcagtgagtcgtgattatgccgttgcattccaacttgggtgat

SEQ ID NO: 32133 - DNA, 601 bp, Human
agttcgagaccagcctgggcaacatggcgaaaccccagctcacgaaaagtacaaaaattagctggccgtgttggcgcgtgcttgtaagtcccagctactgggaaggctgaggtgggaggatcaatagagcccaagaggtcaaggctgcagtgagtcgtgattatgccgttgcattccaacttgggtgatagagtgagaccttgtcaatcagtcaaccagtagtcgaatattacctagcattgcaaatgatgatatagctctatagtgatgaaagatgttcatagaaaagcaacatcataarggttttattgaaaactctctataagagtaaactccagaatgtaaagtggtattggggtggtgaggttatgggtcatttttgttttatatttagtaatttattttctaatttttcttctaagatcattgattatttgtatggtttttaaaacctcacctatataaccatttcatttaatgttgaattttgaattcagttctcattttgtcattatttagaagataaattttgtccttaagggaacaactttaaaatttagatttgttgtgtttttagctgttgaaagattgctgccctatt

SEQ ID NO: 32134 - DNA, 601 bp, Human
agctggccgtgttggcgcgtgcttgtaagtcccagctactgggaaggctgaggtgggaggatcaatagagcccaagaggtcaaggctgcagtgagtcgtgattatgccgttgcattccaacttgggtgatagagtgagaccttgtcaatcagtcaaccagtagtcgaatattacctagcattgcaaatgatgatatagctctatagtgatgaaagatgttcatagaaaagcaacatcataaaggttttattgaaaactctctataagagtaaactccagaatgtaaagtggtattggggtggtgaggttatgggtcatttttgttttatatttagtaatttattttctaatttttcttctaagatcattgattatttgtatggtttttaaaacctcacctatataaccatttcatttaatgttgaattttgaattcagttctcattttgtcattatttagaagataaattttgtccttaagggaacaactttaaaatttagatttgttgtgtttttagctgttgaaagattgctgccctatttaaaatatgatttccttatttatagtgggaaagtaaaactgtcctgcgcaatgagcctt

SEQ ID NO: 32135 - DNA, 601 bp, Human
aatattaaatatatagtatagctgggcacagtgcctcacgcctgtaatcccagcactttgggaggctgagaggggcagatcacctgaggtcaggagtttgagaccaacctggccaacatggtgaaacccccctctctactaataatacaaaaattagctgggcatggtggtgggtgcctataaatccagctgtttgggaggctgaggcatgagaattgtctgaacccaggaagcggaggttgcagtgagtcgagattgcaccactgcaccccagcctgggtgacagcaagactctgtctcaaaaaaaaaaaaaagaattaaatacatagtatagaaacgaagtttaatatataacctttaacatcttagaaaaaagtatcgatgagaacagtctgtatgttttgataaattttttgtttaaaaatttttcatcataattcagcattaccgccacgcctatattagagtagataattaaggggtttccaagccagttggcgatccatttgctacaaacaatgccaatgaaagattgcattatcacagtgaattagaatagcccttttgggattttttgtattataatttgacccatattatt

SEQ ID NO: 32136 - DNA, 601 bp, Human
tctgaacccaggaagcggaggttgcagtgagtcgagattgcaccactgcaccccagcctgggtgacagcaagactctgtctcaaaaaaaaaaaaaagaattaaatacatagtatagaaacgaagtttaatatataacctttaacatcttagaaaaaagtatcgatgagaacagtctgtatgttttgataaattttttgtttaaaaatttttcatcataattcagcattaccgccacgcctatattagagtagataattaaggggtttccaagccagttggcgatccatttgctacaaacartgccaatgaaagattgcattatcacagtgaattagaatagcccttttgggattttttgtattataatttgacccatattattttcataaatagcttggcttacatatgataggtatgtgatgtcagtattttggttttaaaacagtgctttagtttcatttccttagaatttgacacgcaaataacaggcatgtttaacaataatcatgtaaaagtttttaaataaccaagacattacaaataaaaaaattttagtttttatatccttcatttggctttatttaaagaaaggttaactaa

SEQ ID NO: 32137 - DNA, 601 bp, Human
tctcaaaaaaaaaaaaaagaattaaatacatagtatagaaacgaagtttaatatataacctttaacatcttagaaaaaagtatcgatgagaacagtctgtatgttttgataaattttttgtttaaaaatttttcatcataattcagcattaccgccacgcctatattagagtagataattaaggggtttccaagccagttggcgatccatttgctacaaacaatgccaatgaaagattgcattatcacagtgaattagaatagcccttttgggattttttgtattataatttgacccataktattttcataaatagcttggcttacatatgataggtatgtgatgtcagtattttggttttaaaacagtgctttagtttcatttccttagaatttgacacgcaaataacaggcatgtttaacaataatcatgtaaaagtttttaaataaccaagacattacaaataaaaaaattttagtttttatatccttcatttggctttatttaaagaaaggttaactaatgttccccctccatgcatttcccaataacattttttagcattcatttttaattttttccccagatatatttaaaacag

SEQ ID NO: 32138 - DNA, 601 bp, Human
gatatatttaaaacagtatttcacatttaaagtggatgacgtttgatttgtggagcaggtattgaatagaaaatctggtaattttttgttataaactgaagtggttcatttcttcatttttttaaggtcttttagtattgcagaataaattgcagactaaatagatgtgattaaacaacttttcttaaagggtgaatttaggaaagtctaaaaagagcttctctatgttattgcatttcctttcaacttaatctatttaaacgctaatccttttgtgtcccaacataactttatgagataygtacaattttcagacatattttgaagatcttctatataaaaaacagcatgagggctgggtgccatggctcgtgcctgtaatcccaacactttaggaggcggaggcaggtgggtcacctgaggtcaggagttccagaccagcctggtcaacatggtgaaaccccatctctactgaaaataccaaaattagccaggcgtggtggtgcgtgcctgcagtcccagctactcaggaggctgaggcaggagaatcacatgaacccaggaagcagagttgtagtgagccgagatcaggccactgcac

SEQ ID NO: 32139 - DNA, 601 bp, Human
actgcactccagcctgggtgagagtgagactctgtctcaaaaaaaaataaaaataaaaataagacagcatgaaagtttgtatatacaagagatgggttcttctgatgtttggaaggagagatctgtataaaatcagccacagcataaggcagaatatcataattgctctacaaggcactggagcacagagcaaggagaatattctagctgagaagatcaaggacgtcttcatggaggagacagtattttatctgggctttaagagtaggattggaggatagaagaaacaagtagaaaattstatgaccaaaggcatagggcatgctctggggccagtgaacagttttggcatatgtgggcgctagtctctgttggagagaggaagttatgatagtagataagattagaaggatggacaagagtcatcaagagagacttggatcaaatttgaattttgtcctgtaggcacaaggaaccattaaagaattttaaacttgagagtaacatgatcataactatacttttaaaattagggaaaaatagatcaagccaccaaaatgtaaatggaaacaacatttatttttgtttctgttccacctct

SEQ ID NO: 32140 - DNA, 601 bp, Human
ttaacctcatccccatagtggttcttcctactttattctcaaatacatgcaaaaaaaaagacaaaggattttttttaagaggcagaaagagaagtgaacaggaaaaaaattattttttctacactaacctcgttttctttttcttttcttttttttttgaaaacggtctcactctctcacccaggctggagtgcagtggcgtgatcacagctcactgcagcctcgacttcctgggttcaagcaatcctcccacctcagcctcctgagtagctgggattataggcacatgccaccacgcccrgctaatttttgtattttttttgtagagatggggttttgccatgttgcccaggctggtctcgaactcctggcctcaagtgatctatccggctcggcctcccaaagtgctggtattacaggcgtgagtcactgcgcctggcaacttcttttattttctagtagaaaaacataaattcgttttgtaagaacactatgtagattgttattggcacatgttcttataagtttttatttttctttcagtacacagtattctcaagaaatgatgttagggtcacttctctagtgttaacatgctgtt

SEQ ID NO: 32141 - DNA, 601 bp, Human
tgcaaaaaaaaagacaaaggattttttttaagaggcagaaagagaagtgaacaggaaaaaaattattttttctacactaacctcgttttctttttcttttcttttttttttgaaaacggtctcactctctcacccaggctggagtgcagtggcgtgatcacagctcactgcagcctcgacttcctgggttcaagcaatcctcccacctcagcctcctgagtagctgggattataggcacatgccaccacgcccggctaatttttgtattttttttgtagagatggggttttgccatgttgyccaggctggtctcgaactcctggcctcaagtgatctatccggctcggcctcccaaagtgctggtattacaggcgtgagtcactgcgcctggcaacttcttttattttctagtagaaaaacataaattcgttttgtaagaacactatgtagattgttattggcacatgttcttataagtttttatttttctttcagtacacagtattctcaagaaatgatgttagggtcacttctctagtgttaacatgctgttaaattgaggtaataaacatttaactcattaaatcaggaacttaggta

SEQ ID NO: 32142 - DNA, 601 bp, Human
acaaaggattttttttaagaggcagaaagagaagtgaacaggaaaaaaattattttttctacactaacctcgttttctttttcttttcttttttttttgaaaacggtctcactctctcacccaggctggagtgcagtggcgtgatcacagctcactgcagcctcgacttcctgggttcaagcaatcctcccacctcagcctcctgagtagctgggattataggcacatgccaccacgcccggctaatttttgtattttttttgtagagatggggttttgccatgttgcccaggctggtctygaactcctggcctcaagtgatctatccggctcggcctcccaaagtgctggtattacaggcgtgagtcactgcgcctggcaacttcttttattttctagtagaaaaacataaattcgttttgtaagaacactatgtagattgttattggcacatgttcttataagtttttatttttctttcagtacacagtattctcaagaaatgatgttagggtcacttctctagtgttaacatgctgttaaattgaggtaataaacatttaactcattaaatcaggaacttaggtagtttattacacaa

SEQ ID NO: 32143 - DNA, 601 bp, Human
ctagtgttaacatgctgttaaattgaggtaataaacatttaactcattaaatcaggaacttaggtagtttattacacaacctgaaggaaactagttagtattttacctcatgtaaaagtttttagggaagattgcatttgttccctcagtaacatagttactaactgtgccaggcacagtctttatccttttagagcttatattctaggagggaagaaaaattttaaataagtaattatagttatttgatcagaattccggtagagaagaataaagtattataagagcatgtatcaggggwcttggctagttctaggaaccagggaagtcttttcagagggagagatgtgtaagccaagacctaatgtgggcattatctagatgaacagctgatagacctaagttgggaaggagcatggcatcttggaataattttttttttaaggcaagtatagctggtatacacagccatatgactggagaggtaggcagatgtaagaccatacagggcattacagactatggtaaagattttaggtgtactgagagcatagtgggtagcaaatcaaatttgttttaaaatgagtcctctggctataat

SEQ ID NO: 32144 - DNA, 601 bp, Human
gtgatgtttgaatatctaccattcaagttctgttttatgagaaatcttgacactgagtaattaacaaatagatgtgctgatagatgttgtctccacaaagtgacacttcttttatcacaacttgatctcaagaactgaggttatttcctgatttttgacaaaaatgttttgctctggttttgttgctctagattgatcgtactaaaaaaccagcagtcaaattgcctgaagagcatagaataaaatctgaaagtacaaaccatgagcagcaatctcctcagagtggaaaagttattcctgrtcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaa

SEQ ID NO: 32145 - DNA, 601 bp, Human
gaacatgaaacttctgatgccaagaaatctgtagaagatagggggaaaaggtgtccaaccccagaaatacagaaaaagtcaacaggagatgtgccccatacatctgtgacaggggattcaggttcaggcaaggtaagcagaaacagtacaaattgccaacgaagtgaaagaaaatgtatatgaaaatgtgaaaacaccagtggcattccataaaagggcaggcatttcaaatagtcttttcaggggtgatagaatgtactgatctatccacatttgctcatctattctcctttgaggccartgccatacatttatgaaatgattggttgggaatgaaattgctttttgtatattacatctataaaatgcaatatatttcaaataattgagataaatagctacattcttcatttttatgtttgatgtatgatcatgggaagactagagtgaaatataatctccttctcagtatggggaaactagatgctaatatttgtatgatagaatttatatctgtttagaatatatccaaaatcagtgacatctaaatggcctaacatttatctttgcatatagtgattttttggtcagatcggtgtca

SEQ ID NO: 32146 - DNA, 601 bp, Human
ttatataatgctaattttgggttttgaacctgtttttttttttcttttccatctaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccarcagttaatcgggaaaacaagtatgtttatcttaactcctagaactaaaataatgtgctgtatttcaaagtttctactctgaatctgtcagtatgttagtgtcagggagttggaaatttctgtggatggctataccagccgttattatttaccacagagaacaaaacaaatgaatagagaaaatgttgttggtttttctcccaagtgctcacttaatatcataccagagaggattattttaagtgttaatgtagatataaaatcattgttatgttttacagtttcatgccagagtaccctc

SEQ ID NO: 32147 - DNA, 601 bp, Human
acaagtatgtttatcttaactcctagaactaaaataatgtgctgtatttcaaagtttctactctgaatctgtcagtatgttagtgtcagggagttggaaatttctgtggatggctataccagccgttattatttaccacagagaacaaaacaaatgaatagagaaaatgttgttggtttttctcccaagtgctcacttaatatcataccagagaggattattttaagtgttaatgtagatataaaatcattgttatgttttacagtttcatgccagagtaccctcacgtttttcatagacygcctgtggtcccggaatctccctttgaggaccataattttcagcaatattgagcttgccttgttgcagcactcaagttccaaactttttttccccttagccaataatgtaagcgaagttttcctatagtattaaaataacaagcactttagtatatcatcctctaatccttattctgttcccttttccttcgttgtagttttgctattctgtttacaaatattgaccaataggttaggtttcccaaaatagtttcatttagctatacttctggcttcgtcccttttggaatcctcttagc

SEQ ID NO: 32148 - DNA, 601 bp, Human
aacttctttttagcactttttgtctcacatattttggggtcaccattcttaaccactgaacagatatatatatatatacacacacacctacacaaaaatatttgtgtgtatatatatatacgtgtatatatacatacatatatacacatatatatacacatacatatatacatatagagagagagagaggctagggcaacaaaattatatatgtccagttgtagccctaattcccagctatatgtgggatatcttttctaaaaaccaaactttttagctttttctttttttagtagagatkggaggggggggtctcactatgttgcacaagttggtctcgaactcctggccccaagcagtcctcctgccttggcttcccagaatgctgggattacaagcatgaaccaccacatctggcccttttcagctttttaaataaaaatttgggaaatttcaacaagtcacattccttcaataaagtgagtgagttttttttggtatttttggctagaattattttttgccacactcagtgagatcagaactcctttatgagaactacaggtgtttctaaatctggcaagtgtttgtattcactttt

SEQ ID NO: 32149 - DNA, 601 bp, Human
acttctttttagcactttttgtctcacatattttggggtcaccattcttaaccactgaacagatatatatatatatacacacacacctacacaaaaatatttgtgtgtatatatatatacgtgtatatatacatacatatatacacatatatatacacatacatatatacatatagagagagagagaggctagggcaacaaaattatatatgtccagttgtagccctaattcccagctatatgtgggatatcttttctaaaaaccaaactttttagctttttctttttttagtagagattggaggggggggtctcactatgttgcacaagttggtctcgaactcctggccccaagcagtcctcctgccttggcttcccagaatgctgggattacaagcatgaaccaccacatctggcccttttcagctttttaaataaaaatttgggaaatttcaacaagtcacattccttcaataaagtgagtgagttttttttggtatttttggctagaattattttttgccacactcagtgagatcagaactcctttatgagaactacaggtgtttctaaatctggcaagtgtttgtattcactttta

SEQ ID NO: 32150 - DNA, 601 bp, Human
ttctttttagcactttttgtctcacatattttggggtcaccattcttaaccactgaacagatatatatatatatacacacacacctacacaaaaatatttgtgtgtatatatatatacgtgtatatatacatacatatatacacatatatatacacatacatatatacatatagagagagagagaggctagggcaacaaaattatatatgtccagttgtagccctaattcccagctatatgtgggatatcttttctaaaaaccaaactttttagctttttctttttttagtagagattggrggggggggtctcactatgttgcacaagttggtctcgaactcctggccccaagcagtcctcctgccttggcttcccagaatgctgggattacaagcatgaaccaccacatctggcccttttcagctttttaaataaaaatttgggaaatttcaacaagtcacattccttcaataaagtgagtgagttttttttggtatttttggctagaattattttttgccacactcagtgagatcagaactcctttatgagaactacaggtgtttctaaatctggcaagtgtttgtattcacttttatt

SEQ ID NO: 32151 - DNA, 601 bp, Human
aaaatgatttattggataaaaatgctgtttttatggatatagagatgtaaatttctggtctttacccttacaaacattttatcagtaaaactcggccgggcgcagtggctcataccttgtactcccagcactttgggaggccgaggtgggcggatcacgaggtcaggagatcgagaccatcctggataacacggtgaaaccccatctctactaaaaatacaaaaaattagccgggcgtggtggtgggcacctgtagtccccgctactcaggaggctgaggcaggagaatggcgtgaaccckggaggcggagtttacagtgagctgagatctcgccactgcactccagcctaggggacagaacaagactccgtcttaaaaaaaaaaaaaaaaaaaaccttttatcagtaaaactcaatataaattctgttttataattaggcctatgtagattagaaagaattagaaatttcttttttaaagatacctttattaaatattctttcaggatttcaggattgttagtatgtttttaaaaagttttataagttaatttggaaagttgtctgttgactaacttaggcctacttttcataagcattt

SEQ ID NO: 32152 - DNA, 601 bp, Human
attttatcagtaaaactcggccgggcgcagtggctcataccttgtactcccagcactttgggaggccgaggtgggcggatcacgaggtcaggagatcgagaccatcctggataacacggtgaaaccccatctctactaaaaatacaaaaaattagccgggcgtggtggtgggcacctgtagtccccgctactcaggaggctgaggcaggagaatggcgtgaaccctggaggcggagtttacagtgagctgagatctcgccactgcactccagcctaggggacagaacaagactccgtcttaaaaaaaaaaaaaaaaaaaaccttttatcagtaaaactcaatataaattctgttttataattaggcctatgtagattagaaagaattagaaatttcttttttaaagatacctttattaaatattctttcaggatttcaggattgttagtatgtttttaaaaagttttataagttaatttggaaagttgtctgttgactaacttaggcctacttttcataagcatttgctttacatggggatatcaaataaatatcctgttttccatgtatcaacaatgtttcttatataaaagcttgttga

SEQ ID NO: 32153 - DNA, 601 bp, Human
ggcgcagtggctcataccttgtactcccagcactttgggaggccgaggtgggcggatcacgaggtcaggagatcgagaccatcctggataacacggtgaaaccccatctctactaaaaatacaaaaaattagccgggcgtggtggtgggcacctgtagtccccgctactcaggaggctgaggcaggagaatggcgtgaaccctggaggcggagtttacagtgagctgagatctcgccactgcactccagcctaggggacagaacaagactccgtcttaaaaaaaaaaaaaaaaaaaacctkttatcagtaaaactcaatataaattctgttttataattaggcctatgtagattagaaagaattagaaatttcttttttaaagatacctttattaaatattctttcaggatttcaggattgttagtatgtttttaaaaagttttataagttaatttggaaagttgtctgttgactaacttaggcctacttttcataagcatttgctttacatggggatatcaaataaatatcctgttttccatgtatcaacaatgtttcttatataaaagcttgttgatacctttagtcttaaagtacctc

SEQ ID NO: 32154 - DNA, 601 bp, Human
ctatgcttctcactagatcacaagctttgggaaggcaggaactcttttgtgtagattgctgttgaatcactggtgcctgcagagtgactaactaaataggtgctctctgacattattgaagaatcgaattaacgagtatctgctacttgtttttttctgccaggattgccttagattattttccaaagaagaaaaactcacagataacaacagattttactgcagtcattgcagagctcgacgggattctctaaaaaagatagaaatctggaagttaccacctgtgcttttagtgcatctraaacggtaaaggggaaagtttgtcctcctgttcagtgaaattaaatgagggaattttaagttctgtgtaatttatacttgttgtactgcctgccatgggcacataacaaagggcgattatctggttacagtagatctagggaaataaagcagaaatgagactgttagttcacctcagtgttttcagtaccacagcaaaatgacaataccactatttcatgtaattccttataattttaaataattacaaagcatcaagtgaaaatgtataaaaatattacagtataattcaaacaaatta

SEQ ID NO: 32155 - DNA, 601 bp, Human
ctaaactatcagtagtgctgaggcagagaaaccctagggtacagcagggcggggcggggggcagatgtgagttggggagctcgctgagagccagaggataagatggattggaggggtcaggtgggagccggggacccaatgtaggggccatgagggttcaggcaagggaagctgaagtctgagcagggcagggccagggaaggccagggcgcaggcccagggtgtggaggacaggcccaggctccaggacctcggagcactgcccagcctggctctccctccagggctaccgactaccacrggatggctggcagggccctacttacaaaggagacaagggcagccagcagcaggatgcgcaccaggaggtcctcaaactgttccagcaccagctcccacagggacttccctgggaacgggggtcatgtgtgaggctgggcccccaccactgaccctgcccactcagagctgggatggcccgggagacctcccggcccattccctccctgcactcagaagagggagaacccaggtcgctgagaggctcaggtgggtgatcctggggagctcagcaaggcctcactcagcggggagaaggaag

SEQ ID NO: 32156 - DNA, 601 bp, Human
attgtcaagaatcgatgaggttcttccccgtaggactttagctgattaaccttaatgttgggccaggtgcagtggctcatgcttataatcctagcactttgggaggccaaggtgggcggatcacttgaggtcaggagttcgagaccagcctggtgaacgtggtgaaaccttgttgctactaaaaatacaaaaattagccgggtgtggtggcaggtgcctgtagtcccagctacttgggaagctgaggcacaagagtagcttgaacctggggggcgggggttgcagtgacccgagatcgtascactgcactccagcatgggcaacagggccagaaaaaaaaatattttttttttttttttgagacagagttttgctctcgtcacccaggctggagtgcagtggcacaatcttggctcactgcaacctccgcctcccgggctcaagtgactctcctgcctcagcctcccaagttgctgggattacaggcacacgccaccacccccagctaatctttttgtatttttagtagagacggggtttcaccatgttggccaggctggtctcgaactcctgacctcaggtgatccacccacctcagcct

SEQ ID NO: 32157 - DNA, 601 bp, Human
cactggcattgatcgccacacaccgtccctgccctccgcctgcatctctgtccacttcctgtcagcctccttcaccggtttctgctgtctgggcccgcttccaccctcccacctgctctccctggggccctttgctgagccccaagcccagatgtccagctgcctgctgaaccttgttccccggggacccctcaggccacctctcccactctctgtatttgccactccggcgacagccccagacagcacaagaaccaggagcccccctggcttcctccctgtctctttcacctaaccagtyaccaagtcccaggatttttggctcctaaatgtctctgacccataccttctcccctctccccaaggctccagccagggctcagcccgcatctctctggcctgaatgaccacataggcctccctggcttcggtcctctactgtctgtctggcctccacacggaagcctcagtgatcttctgtaaatgcacatctgactatgtcactctcctgctcaaaactcttcgttggtgctctactgccctcagcttggcctcggactgggtctggccaaggacctccctttgggcagacgcctgctgc

SEQ ID NO: 32158 - DNA, 601 bp, Human
ttgctggagttccgtgtaacctcctttgcaccggcccgtgagcccttcccagcctggccgccctggggtcggggtggtgtctgacactgacattcagccccccacactggcattgatcgccacacaccgtccctgccctccgcctgcatctctgtccacttcctgtcagcctccttcaccggtttctgctgtctgggcccgcttccaccctcccacctgctctccctggggccctttgctgagccccaagcccagatgtccagctgcctgctgaaccttgttccccggggacccctcaggmcacctctcccactctctgtatttgccactccggcgacagccccagacagcacaagaaccaggagcccccctggcttcctccctgtctctttcacctaaccagtcaccaagtcccaggatttttggctcctaaatgtctctgacccataccttctcccctctccccaaggctccagccagggctcagcccgcatctctctggcctgaatgaccacataggcctccctggcttcggtcctctactgtctgtctggcctccacacggaagcctcagtgatcttctgtaaatgcacatctgact

SEQ ID NO: 32159 - DNA, 601 bp, Human
cttggcctggcaaggacccaggggatagggagtgaggggcaggcagcctccagcccgcatccccagcctcactcactccttgcccctgcagctgcctttgctggagttccgtgtaacctcctttgcaccggcccgtgagcccttcccagcctggccgccctggggtcggggtggtgtctgacactgacattcagccccccacactggcattgatcgccacacaccgtccctgccctccgcctgcatctctgtccacttcctgtcagcctccttcaccggtttctgctgtctgggcccgctyccaccctcccacctgctctccctggggccctttgctgagccccaagcccagatgtccagctgcctgctgaaccttgttccccggggacccctcaggccacctctcccactctctgtatttgccactccggcgacagccccagacagcacaagaaccaggagcccccctggcttcctccctgtctctttcacctaaccagtcaccaagtcccaggatttttggctcctaaatgtctctgacccataccttctcccctctccccaaggctccagccagggctcagcccgcatctctctggcc

SEQ ID NO: 32160 - DNA, 601 bp, Human
aaacttcagtgtcctgtctgccttctccagatgtcccagaagccccagccatgcagccggaggcctgagcccccagccctgctcaccgtgttacaggcgccagctcgctccacccgggacagagcctgcaggtcggtgtcgaacacgttcatcttctccaccaggcaagtcagagctgtctccgtggcctctcccaccttctcatacacacccttggcctggcaaggacccaggggatagggagtgaggggcaggcagcctccagcccgcatccccagcctcactcactccttgcccctgmagctgcctttgctggagttccgtgtaacctcctttgcaccggcccgtgagcccttcccagcctggccgccctggggtcggggtggtgtctgacactgacattcagccccccacactggcattgatcgccacacaccgtccctgccctccgcctgcatctctgtccacttcctgtcagcctccttcaccggtttctgctgtctgggcccgcttccaccctcccacctgctctccctggggccctttgctgagccccaagcccagatgtccagctgcctgctgaaccttgttccccggggac

SEQ ID NO: 32161 - DNA, 601 bp, Human
aaaacaaaaacttcagtgtcctgtctgccttctccagatgtcccagaagccccagccatgcagccggaggcctgagcccccagccctgctcaccgtgttacaggcgccagctcgctccacccgggacagagcctgcaggtcggtgtcgaacacgttcatcttctccaccaggcaagtcagagctgtctccgtggcctctcccaccttctcatacacacccttggcctggcaaggacccaggggatagggagtgaggggcaggcagcctccagcccgcatccccagcctcactcactccttgcccctgcagctgcctttgctggagttccgtgtaacctcctttgcaccggcccgtgagcccttcccagcctggccgccctggggtcggggtggtgtctgacactgacattcagccccccacactggcattgatcgccacacaccgtccctgccctccgcctgcatctctgtccacttcctgtcagcctccttcaccggtttctgctgtctgggcccgcttccaccctcccacctgctctccctggggccctttgctgagccccaagcccagatgtccagctgcctgctgaaccttgttccc

SEQ ID NO: 32162 - DNA, 601 bp, Human
gttgcagtgagccaggattgcaccattgtactaaagcctgggcgacagaatgagactccgtctcaaaaaaaaaaaaaaacaaaacgaaacaaaacaaaaacttcagtgtcctgtctgccttctccagatgtcccagaagccccagccatgcagccggaggcctgagcccccagccctgctcaccgtgttacaggcgccagctcgctccacccgggacagagcctgcaggtcggtgtcgaacacgttcatcttctccaccaggcaagtcagagctgtctccgtggcctctcccaccttctcrtacacacccttggcctggcaaggacccaggggatagggagtgaggggcaggcagcctccagcccgcatccccagcctcactcactccttgcccctgcagctgcctttgctggagttccgtgtaacctcctttgcaccggcccgtgagcccttcccagcctggccgccctggggtcggggtggtgtctgacactgacattcagccccccacactggcattgatcgccacacaccgtccctgccctccgcctgcatctctgtccacttcctgtcagcctccttcaccggtttctgctgtctg

SEQ ID NO: 32163 - DNA, 601 bp, Human
agtttcagactagcccggacaacatggtgaaaccctgtctctactaaaaaatgcaaaaattagccgggtgtggtggcacgcgccgggaggtcgaggcacgagaatcacttgaacccgggaggcagaggttgcagtgagccaggattgcaccattgtactaaagcctgggcgacagaatgagactccgtctcaaaaaaaaaaaaaaacaaaacgaaacaaaacaaaaacttcagtgtcctgtctgccttctccagatgtcccagaagccccagccatgcagccggaggcctgagcccccagycctgctcaccgtgttacaggcgccagctcgctccacccgggacagagcctgcaggtcggtgtcgaacacgttcatcttctccaccaggcaagtcagagctgtctccgtggcctctcccaccttctcatacacacccttggcctggcaaggacccaggggatagggagtgaggggcaggcagcctccagcccgcatccccagcctcactcactccttgcccctgcagctgcctttgctggagttccgtgtaacctcctttgcaccggcccgtgagcccttcccagcctggccgccctgggg

SEQ ID NO: 32164 - DNA, 601 bp, Human
gaaggacagagccagcaactctcgcctgccttcccaccaactgcttggccccaagagagcctcttgctctgtgtgggatgacatctacactcctctgaccccaccattcaaggcctccatttccctctccagccccagaaatggcaatacgatgccgtttgctgaccatgctgtgtgcagcccaactccaaacctttgcccacacgcagccttctcccctcttttctccaagtcttacttcaccgtcagccaggagcggtggctcacgcctgtaatcccagcactctgggaggccaaggcrggcagattacctgaggtcaggagtttcagactagcccggacaacatggtgaaaccctgtctctactaaaaaatgcaaaaattagccgggtgtggtggcacgcgccgggaggtcgaggcacgagaatcacttgaacccgggaggcagaggttgcagtgagccaggattgcaccattgtactaaagcctgggcgacagaatgagactccgtctcaaaaaaaaaaaaaaacaaaacgaaacaaaacaaaaacttcagtgtcctgtctgccttctccagatgtcccagaagccccagccatgca

SEQ ID NO: 32165 - DNA, 601 bp, Human
tcttcggttttgggagcagcaacggagacgctgtagacagtggtctgcaagggagtcgattcctttccctccctgggactcagtttccaaaacacagagcaccaagggtggcaccaaccacccctacaccaccggttagaggcaaaaggggctcctgagaacttgtaacccaaccctgccattcacacgggaggactggggctcacagaggagcgtggatgaccaggttccccagggcgcgcaggggcccaggccagccaggcaggcccccaccttcacaaacatcttgctgccctggccrgtagggtgagggcgggtgggcgtgcagtacacggacatggatttccggtctcgggagaactccagggtgaactccttccgcatcagctgcttgatgacctgcggggtccaggcaggtcagggcatgaaggacagagccagcaactctcgcctgccttcccaccaactgcttggccccaagagagcctcttgctctgtgtgggatgacatctacactcctctgaccccaccattcaaggcctccatttccctctccagccccagaaatggcaatacgatgccgtttgctgaccatgctgtg

SEQ ID NO: 32166 - DNA, 601 bp, Human
cagaaatagagccatacacagggtatggcgggcatagccctgggaagggggtccagggatgacaggcccctcagtggcctcaggtctcacctcagacctcaccccgggcctaggaacagcctctaaagctccttcagtggcttctcctgctcctaaaaggtcacccaggcactgacttttccaagtggcccgagctcccagtacagaagccttttcatttcaaaaggggtttaaacttcccttgcagggtgaagctagagctgtatttctctcttcggttttgggagcagcaacggagacrctgtagacagtggtctgcaagggagtcgattcctttccctccctgggactcagtttccaaaacacagagcaccaagggtggcaccaaccacccctacaccaccggttagaggcaaaaggggctcctgagaacttgtaacccaaccctgccattcacacgggaggactggggctcacagaggagcgtggatgaccaggttccccagggcgcgcaggggcccaggccagccaggcaggcccccaccttcacaaacatcttgctgccctggccagtagggtgagggcgggtgggcgtgcagta

SEQ ID NO: 32167 - DNA, 601 bp, Human
gcgctccagccctgggtgacagagcgagactctgtctaaaaaaaaaaaaaaaaaaaaaaaaaagcaataatctgatacgacaaggcagatagatctcaaaaaagccccaaaccaaaacagtccatactgtatgattccattcatttgaaaatctagggcagataaaactcatatacggtgaaaaaaaaaaccgaaaacagtgatcgcctgttttgcgacgaaggacagagatggggaaggcgtgtgacggaacttcatgggttgatggtaatgtgtcatatctttttttttttgttttttgttttttttttttttggagagatggggtctcaaactcctgggctcaagcaatcctcctgccttggcctcccaaagtgctggaattacaagcgtgagccaccatgcctggcattttcctatcttgataaggctgtgagttacacaggtgtgtgcatgttcctaaactcatcagatagtacgccaaagatctgtgtgcttcatcgaaggcaaattttgcctcaaaaaggaaaaacagaaccacaaacaacattgctctctggttaacatgtattctaaagtaggtgagggggaagtatgccga

SEQ ID NO: 32168 - DNA, 601 bp, Human
tgccactgcgctccagccctgggtgacagagcgagactctgtctaaaaaaaaaaaaaaaaaaaaaaaaaagcaataatctgatacgacaaggcagatagatctcaaaaaagccccaaaccaaaacagtccatactgtatgattccattcatttgaaaatctagggcagataaaactcatatacggtgaaaaaaaaaaccgaaaacagtgatcgcctgttttgcgacgaaggacagagatggggaaggcgtgtgacggaacttcatgggttgatggtaatgtgtcatatctttttttttttgttttttgttttttttttttttggagagatggggtctcaaactcctgggctcaagcaatcctcctgccttggcctcccaaagtgctggaattacaagcgtgagccaccatgcctggcattttcctatcttgataaggctgtgagttacacaggtgtgtgcatgttcctaaactcatcagatagtacgccaaagatctgtgtgcttcatcgaaggcaaattttgcctcaaaaaggaaaaacagaaccacaaacaacattgctctctggttaacatgtattctaaagtaggtgagggggaagt

SEQ ID NO: 32169 - DNA, 601 bp, Human
gtggcccacacttgtaatcctagcactttaggaggccaaggcaggaggattgcttgatccaggagttcaagactagcctgggcaacatagggagacctcatctctacaaaaaattaaaaaattagccaggcatggtggtgcatgcctgtagtcccagctcctcaggaggctgaggtgggaggatctcttgagcccgagaggatgaggcttcagtgagccatgactgtgccactgcattccagcctgggcaacagagtgagacctcatcacacaaacaaaaaaagaattagattaagatgarggtcaacatcaaggtcagggacaaagtcagcacagaggtcaaagataagatcaagaaccaggctgcagtgatagtcaagcttggtgtgcagatcaaggctgggccatgggtcagggttaaggactgggttaggctggaggtcaagattaaaaacagagaccaggtcaggggagaggctgaggtcagaagaataggtcagcaattaagaacaaaaactaggcccaaactaaatgtccatccaaagaggaatggttcaataaactgaaatattcacacagtggaatgctactcaacaataaa

SEQ ID NO: 32170 - DNA, 601 bp, Human
aggagtgaagtcaagtgacatgaagtctggagttgcaatcaaggtcaaactgaaggccaggccaggagcggtggctcacgcctgtaatcccagcactttgggaggccgaggtgggtggatgacctgaggtcaggagttcaagaccagcctgggcaacatgatgaaaccccatctctactgaaaatacaaaaattagctgggcgcagtggcgcgtgcctatgatctcagctacatgggaggctgaggcaggggagtcgcttgagcccgggaggcggaggttgcagtgagccgagactgcacygctgcactccagcctgggcaacagagtgagactccatctaaaaaaattgaaggccagatcaaagttgaggtcaacataaagcattacattgggggtggggcagtgtcaaggtcaacgttgagaataaggtcttggtccaggtcaagactggaattctttttttttggtgggggacagagtctcactctatcgcccaggctggagtgcaatggcacaatctcggctcactgcaacctcctcctcccaggttcaagcaattctcgtgcctcagcctcccaagtagctgagattataggcatg

SEQ ID NO: 32171 - DNA, 601 bp, Human
ggtccacatgaggagtgaagtcaagtgacatgaagtctggagttgcaatcaaggtcaaactgaaggccaggccaggagcggtggctcacgcctgtaatcccagcactttgggaggccgaggtgggtggatgacctgaggtcaggagttcaagaccagcctgggcaacatgatgaaaccccatctctactgaaaatacaaaaattagctgggcgcagtggcgcgtgcctatgatctcagctacatgggaggctgaggcaggggagtcgcttgagcccgggaggcggaggttgcagtgagccragactgcactgctgcactccagcctgggcaacagagtgagactccatctaaaaaaattgaaggccagatcaaagttgaggtcaacataaagcattacattgggggtggggcagtgtcaaggtcaacgttgagaataaggtcttggtccaggtcaagactggaattctttttttttggtgggggacagagtctcactctatcgcccaggctggagtgcaatggcacaatctcggctcactgcaacctcctcctcccaggttcaagcaattctcgtgcctcagcctcccaagtagctgagat

SEQ ID NO: 32172 - DNA, 601 bp, Human
catccgaggaacaggcgttttccccatctcaggggcacagagcggattgagagggctgagaggagggaaggcccggcctcaccagacgacctcgccaacattggaggagatgaggtagcggatgaattgcttcatgttgctgtagatggcccggccctcctccaccgcagccacgatggaggcaaagttgtcatctgacagcaccatctctgccgccgacttggccacggccgtgcctgagcccatggcgatgccgatctctgctttcttcagggctggtgcgtcgttcactccatcgccrgtctgtgggccaggtcaggtagggctgtgcctgagaaacttcccttccacctccccatctcttctcaactcagcccacccccaatcttaggggatgttccaaaggaagcagacagttagacagaacaaatggtgggttcaagaatgaactagaaattgggcagaggatgaggctgaggagaaggcaagggatgcagacaaggacaaagttggggagaatatcaagcatgaggttagggaagatgatgaggtggggatggggatgacggtgagtcagcgatgagggtagggatgaaattga

SEQ ID NO: 32173 - DNA, 601 bp, Human
gcctaaaggtggggcttttctctcatcttgctaatctgcaagtgggaagttcatggctggagggctgacaggcgactcttcaggcacctccgtgggtgctggggtgaccatgatccataggtcaccagggcctctggagaatgacaagaggtgctctcccctgtccactccaaggtgggaccctggaaagccccagccagggcagggcacaggcccctccatccctgcagcgcatccgaggaacaggcgttttccccatctcaggggcacagagcggattgagagggctgagaggagggaaggcccggcctcaccagacgacctcgccaacattggaggagatgaggtagcggatgaattgcttcatgttgctgtagatggcccggccctcctccaccgcagccacgatggaggcaaagttgtcatctgacagcaccatctctgccgccgacttggccacggccgtgcctgagcccatggcgatgccgatctctgctttcttcagggctggtgcgtcgttcactccatcgccagtctgtgggccaggtcaggtagggctgtgcctgagaaacttcccttccacctccccatctcttctcaa

SEQ ID NO: 32174 - DNA, 601 bp, Human
acacacgactgcctaaaggtggggcttttctctcatcttgctaatctgcaagtgggaagttcatggctggagggctgacaggcgactcttcaggcacctccgtgggtgctggggtgaccatgatccataggtcaccagggcctctggagaatgacaagaggtgctctcccctgtccactccaaggtgggaccctggaaagccccagccagggcagggcacaggcccctccatccctgcagcgcatccgaggaacaggcgttttccccatctcaggggcacagagcggattgagagggctgmgaggagggaaggcccggcctcaccagacgacctcgccaacattggaggagatgaggtagcggatgaattgcttcatgttgctgtagatggcccggccctcctccaccgcagccacgatggaggcaaagttgtcatctgacagcaccatctctgccgccgacttggccacggccgtgcctgagcccatggcgatgccgatctctgctttcttcagggctggtgcgtcgttcactccatcgccagtctgtgggccaggtcaggtagggctgtgcctgagaaacttcccttccacctccccat

SEQ ID NO: 32175 - DNA, 601 bp, Human
ctcactcaggcactcaggccatgtgcacacaaatacacattcgcacacggacacacacacgactgcctaaaggtggggcttttctctcatcttgctaatctgcaagtgggaagttcatggctggagggctgacaggcgactcttcaggcacctccgtgggtgctggggtgaccatgatccataggtcaccagggcctctggagaatgacaagaggtgctctcccctgtccactccaaggtgggaccctggaaagccccagccagggcagggcacaggcccctccatccctgcagcgcatcygaggaacaggcgttttccccatctcaggggcacagagcggattgagagggctgagaggagggaaggcccggcctcaccagacgacctcgccaacattggaggagatgaggtagcggatgaattgcttcatgttgctgtagatggcccggccctcctccaccgcagccacgatggaggcaaagttgtcatctgacagcaccatctctgccgccgacttggccacggccgtgcctgagcccatggcgatgccgatctctgctttcttcagggctggtgcgtcgttcactccatcgccagtct

SEQ ID NO: 32176 - DNA, 601 bp, Human
cggcacaaatccttctgcttgtactcacgctcaaaatgcaccagagcacacatgcaaaatatacacattacacacacctctcactcaggcactcaggccatgtgcacacaaatacacattcgcacacggacacacacacgactgcctaaaggtggggcttttctctcatcttgctaatctgcaagtgggaagttcatggctggagggctgacaggcgactcttcaggcacctccgtgggtgctggggtgaccatgatccataggtcaccagggcctctggagaatgacaagaggtgctctyccctgtccactccaaggtgggaccctggaaagccccagccagggcagggcacaggcccctccatccctgcagcgcatccgaggaacaggcgttttccccatctcaggggcacagagcggattgagagggctgagaggagggaaggcccggcctcaccagacgacctcgccaacattggaggagatgaggtagcggatgaattgcttcatgttgctgtagatggcccggccctcctccaccgcagccacgatggaggcaaagttgtcatctgacagcaccatctctgccgccgacttggcc

SEQ ID NO: 32177 - DNA, 601 bp, Human
cacagtcacacgccggcacaaatccttctgcttgtactcacgctcaaaatgcaccagagcacacatgcaaaatatacacattacacacacctctcactcaggcactcaggccatgtgcacacaaatacacattcgcacacggacacacacacgactgcctaaaggtggggcttttctctcatcttgctaatctgcaagtgggaagttcatggctggagggctgacaggcgactcttcaggcacctccgtgggtgctggggtgaccatgatccataggtcaccagggcctctggagaatgayaagaggtgctctcccctgtccactccaaggtgggaccctggaaagccccagccagggcagggcacaggcccctccatccctgcagcgcatccgaggaacaggcgttttccccatctcaggggcacagagcggattgagagggctgagaggagggaaggcccggcctcaccagacgacctcgccaacattggaggagatgaggtagcggatgaattgcttcatgttgctgtagatggcccggccctcctccaccgcagccacgatggaggcaaagttgtcatctgacagcaccatctctgc

SEQ ID NO: 32178 - DNA, 601 bp, Human
gcctcgggcctggccagtcctgccttccccagtcccagctctggatcctggacatacctgctctttaggcctagcagaggccaagtacacacacacacacacacacacacacacacacacgcacacgaagagggcatgcccaagaatcagacatgtgcaaaaacctagcacatgccacaccatccggcaaacacaagcaaacacctacatatctgccctgaggtgcagagatgcagaatccatccatgtccagcaacacacacgctcaccattccccacaggcatcctcacatgtgaataygagtgtgtgcacagtcacacgccggcacaaatccttctgcttgtactcacgctcaaaatgcaccagagcacacatgcaaaatatacacattacacacacctctcactcaggcactcaggccatgtgcacacaaatacacattcgcacacggacacacacacgactgcctaaaggtggggcttttctctcatcttgctaatctgcaagtgggaagttcatggctggagggctgacaggcgactcttcaggcacctccgtgggtgctggggtgaccatgatccataggtcaccagggcctct

SEQ ID NO: 32179 - DNA, 601 bp, Human
aggaagatgctggaacagagtcatgagctctagccccggtaggcctagcccccggcagatgcaggctccagctcctgctcagacccaaggctgggagctcacccacccactgtctccacagcagcccctcctccctccgccagctgtgatgtgaagggtgtgtgtacacagctctgcctcgggcctggccagtcctgccttccccagtcccagctctggatcctggacatacctgctctttaggcctagcagaggccaagtacacacacacacacacacacacacacacacacacgcacaygaagagggcatgcccaagaatcagacatgtgcaaaaacctagcacatgccacaccatccggcaaacacaagcaaacacctacatatctgccctgaggtgcagagatgcagaatccatccatgtccagcaacacacacgctcaccattccccacaggcatcctcacatgtgaatacgagtgtgtgcacagtcacacgccggcacaaatccttctgcttgtactcacgctcaaaatgcaccagagcacacatgcaaaatatacacattacacacacctctcactcaggcactcaggccatgt

SEQ ID NO: 32180 - DNA, 601 bp, Human
gtatcggaagaagagccagccactgatgagggcttctcgggggctccggggcagcttctccatgatgtccaggtctggcgggttgaagcccagagccgtggcaggtaggccgtctgtcaccaggttcacccagagcagctgcacagggatcagggcttcgggcaggcccagaattgccgtgaggaagatgctggaacagagtcatgagctctagccccggtaggcctagcccccggcagatgcaggctccagctcctgctcagacccaaggctgggagctcacccacccactgtctccacrgcagcccctcctccctccgccagctgtgatgtgaagggtgtgtgtacacagctctgcctcgggcctggccagtcctgccttccccagtcccagctctggatcctggacatacctgctctttaggcctagcagaggccaagtacacacacacacacacacacacacacacacacacgcacacgaagagggcatgcccaagaatcagacatgtgcaaaaacctagcacatgccacaccatccggcaaacacaagcaaacacctacatatctgccctgaggtgcagagatgcagaatccatcc

SEQ ID NO: 32181 - DNA, 601 bp, Human
ccaatgagaacaggcctgttgagacttttttttttttttttttttgagacggagtctcactctgtcgcccaggctggagtgcaatggtgccatctcggctcacagcaacctctgcctcctgggttcaagcgattctcctgcctcagtctcccgagtaggtgggattacaggcacctgccatcatgcccagctaatttttgtatttttagtagagatggggtttcaccacgttggccaggctggtctcaaactcctgacctcaggtgatctgcctgcctcggcctcccaaagtgctggggtyacaggtgtgagccacatgttggccaggctggtcaaactccagacctcaagtgatctgcccacctcggcctcccacaatgctggggttacaagtgtgagccaccatgcccagcccaggcctgagattcttatcatactaccgggagagcagcatgataaaagactctctcttctgctgaatttggggttgtaatggagtgagcagagggctggggctgcagcagccattctgccaccatgagggacgtgggcctgagaatgaagctgaggcagtgccaaaatatgccagtgatactgagac

SEQ ID NO: 32182 - DNA, 601 bp, Human
tgcttaagacgcttatgcgtctacacagagaagaaaataccaacaagatcatgtcaggatgtttcggccgggcacggtggctcacgcctgtattcccagcactttgggaggccaaggcgggcagatcacctgaggtcaggagttcgagaccagcctggccaacatggtgaaactccatctctacaaaaatacaaaaattagccaggcatgatggcgggtgcctgtaatcccagctactcgggaggctgaggcaggagaatcgcttgaacccgggaggcggaggttgcagtgagctgagatygcgccactgcactccagcctgggtgacagagcgagactctgtctcaaataaataaataaatatgtttcaatgggtctgttgctcttgctgtaaatgccctgcccagtgcagaccttctgggtttcaccagcaagcacctgccacacacacacagtattccccaggtcataggtctcggtgtggcctctggaattattcattagaaggtgcgctggggtccgggtgccgtggctcacgcctgtgatcccagcactttgggaggctgaggcgggcggatcatgaggtcaggagatcgagacc

SEQ ID NO: 32183 - DNA, 601 bp, Human
tgcctcagcctcctgagtagctgggactacaggcacccgccaccacccgtggctaatttttgtgtttgtagtagagacggggtttcatcatattggctaggctggtctcgatctcctgacctcaagtgatccacccgcctcggcctcccaaagtgctgggcttacaggcgtgagccactgtgcctggccttgttttgtttttgagacaaggtctcactcccatcacccaggctggagtgcagtggcacgatctcagctcactgtagcctcgacttcctgggctcaggtgattgtcccaccrcagcctcccaagtagctgagactccaggcctgagccgtcactgttggctaagttttgtcttttttgtagagacggggtttcgccatgttgtccaggctgctctcaaattcctgggctcaagtgatctgcccgccttggcatcccagagtgctgggattataggcgtgagcagccacacgtttctatttggtgctgatcatagagaagggaaaacctccagaactttgaacctgactctacccacccagtgaccgagaggaccaaatcctcctgccaattgtgccactgttgtcgggcctc

SEQ ID NO: 32184 - DNA, 601 bp, Human
tctcctctctcgtgcaggaagagaaataagcctggctagatattttaacaaagagatagagaatctgataatctcttaaatcgatagtggacgttttctccaaaactcaagctccagcatttgaggcaagtggatatgtcttgttttctttttattttgttttgttttgttttgttttgtttttgttttcgagactgagtctcactctgtcaccgaggctggagtgcagtggcgtgatcttggctcactgcaacctccatctcccaagttcgagcgattcttctgcctcagcctcctgagyagctgggactacaggcacccgccaccacccgtggctaatttttgtgtttgtagtagagacggggtttcatcatattggctaggctggtctcgatctcctgacctcaagtgatccacccgcctcggcctcccaaagtgctgggcttacaggcgtgagccactgtgcctggccttgttttgtttttgagacaaggtctcactcccatcacccaggctggagtgcagtggcacgatctcagctcactgtagcctcgacttcctgggctcaggtgattgtcccaccgcagcctcccaagtagct

SEQ ID NO: 32185 - DNA, 601 bp, Human
agcaagactctgtctcaaaaaaaaaaaaaaattccatttacacctcatacctcactccatttctgccactgaaactgaactctatcagatctgatgtgtgcttctgacagagactaatgaattgccaaggtgcagctgtaacaggtagcttctctgtaattaacatgaagcgctcagggctgataacccctatagcctcaggggagttttcttactgctcaaaaaccttgttcacagaatcgtgctaagaggctgaacggagggtattgggggaacttgtcttgttctcttccatattatrgggatgagggtgaatgtttccaaccgttaaccagcttagttcaccaaaaatatagatcctgctcttgggagtctaatctgaacatggagatcttttttcttttttttttttttttgaaacagagtctcgctctgtcacccgagctggagtgcagtggcatgatctcggctcactgcaagctccgcctcccgggttcacgccattctcctgcctcagcctcccaagtagctgggactacaggcgcccgccaccacgcccggctaattttttgtatttttagtggagacggggtttcaccgt

SEQ ID NO: 32186 - DNA, 601 bp, Human
gtggtgcgtgcctgtaatcccagctactcgggaggctgaggcaggacaatcacttgaacccgggggtcagaggttgtagtgagcagagatcgcgtcactgcactccagcctgggtgacagagcaagactctgtctcaaaaaaaaaaaaaaattccatttacacctcatacctcactccatttctgccactgaaactgaactctatcagatctgatgtgtgcttctgacagagactaatgaattgccaaggtgcagctgtaacaggtagcttctctgtaattaacatgaagcgctcagggcygataacccctatagcctcaggggagttttcttactgctcaaaaaccttgttcacagaatcgtgctaagaggctgaacggagggtattgggggaacttgtcttgttctcttccatattatagggatgagggtgaatgtttccaaccgttaaccagcttagttcaccaaaaatatagatcctgctcttgggagtctaatctgaacatggagatcttttttcttttttttttttttttgaaacagagtctcgctctgtcacccgagctggagtgcagtggcatgatctcggctcactgcaagc

SEQ ID NO: 32187 - DNA, 601 bp, Human
gggtgcggggtcggggcggcggtggggagagctgcaccgtgccagggagaagcaagggcacagcgtgggaaaggcagacgttctggagcaggagtgcagcggctcagaaggagaacagctggcattagcctggggaggctagcgggagcctggagatcactgaatagggaaatgcatgtgaaaatcaaccaacaaaaccatgcgggagtggaattcacctttgcggtatagaagatgaaggctacgcaggccctgttcactgttattaagattccatttacagctgggcgtggtggctcaygcctgtcatcccagggaggcggaggcgggtggatcacctgaggtcaggagtttgggaccagcctggctaacatggtgaaaccccgtctctactaaaaatacaaaaattagcctgcgtggtggtgcgtgcctgtaatcccagctactcgggaggctgaggcaggacaatcacttgaacccgggggtcagaggttgtagtgagcagagatcgcgtcactgcactccagcctgggtgacagagcaagactctgtctcaaaaaaaaaaaaaaattccatttacacctcatacctcactccattt

SEQ ID NO: 32188 - DNA, 601 bp, Human
ctcacagtcgatgccggcaaagagcgggttgtcttcggagcacttcaggaagttcctctgggggcaccgtggcaggtcagagagagcggcaggtcaggcgaggggctggtgggtgggaggagggaagcctcatcctgcccttggcccacgcctgggcacaaccagcacacaaaacactgccgtggggtgggctggggatcccgggaggggtgcggggtcggggcggcggtggggagagctgcaccgtgccagggagaagcaagggcacagcgtgggaaaggcagacgttctggagcaggartgcagcggctcagaaggagaacagctggcattagcctggggaggctagcgggagcctggagatcactgaatagggaaatgcatgtgaaaatcaaccaacaaaaccatgcgggagtggaattcacctttgcggtatagaagatgaaggctacgcaggccctgttcactgttattaagattccatttacagctgggcgtggtggctcatgcctgtcatcccagggaggcggaggcgggtggatcacctgaggtcaggagtttgggaccagcctggctaacatggtgaaaccccgtctctact

SEQ ID NO: 32189 - DNA, 601 bp, Human
gcgtgactcgaacacctcacagtcgatgccggcaaagagcgggttgtcttcggagcacttcaggaagttcctctgggggcaccgtggcaggtcagagagagcggcaggtcaggcgaggggctggtgggtgggaggagggaagcctcatcctgcccttggcccacgcctgggcacaaccagcacacaaaacactgccgtggggtgggctggggatcccgggaggggtgcggggtcggggcggcggtggggagagctgcaccgtgccagggagaagcaagggcacagcgtgggaaaggcagatgttctggagcaggagtgcagcggctcagaaggagaacagctggcattagcctggggaggctagcgggagcctggagatcactgaatagggaaatgcatgtgaaaatcaaccaacaaaaccatgcgggagtggaattcacctttgcggtatagaagatgaaggctacgcaggccctgttcactgttattaagattccatttacagctgggcgtggtggctcatgcctgtcatcccagggaggcggaggcgggtggatcacctgaggtcaggagtttgggaccagcctggctaacatggtga

SEQ ID NO: 32190 - DNA, 601 bp, Human
ctacctgttgagggcattgcacatttcaatggtcacgagcacggacaaggccatggtggtggggaagcgtgactcgaacacctcacagtcgatgccggcaaagagcgggttgtcttcggagcacttcaggaagttcctctgggggcaccgtggcaggtcagagagagcggcaggtcaggcgaggggctggtgggtgggaggagggaagcctcatcctgcccttggcccacgcctgggcacaaccagcacacaaaacactgccgtggggtgggctggggatcccgggaggggtgcggggtcrgggcggcggtggggagagctgcaccgtgccagggagaagcaagggcacagcgtgggaaaggcagacgttctggagcaggagtgcagcggctcagaaggagaacagctggcattagcctggggaggctagcgggagcctggagatcactgaatagggaaatgcatgtgaaaatcaaccaacaaaaccatgcgggagtggaattcacctttgcggtatagaagatgaaggctacgcaggccctgttcactgttattaagattccatttacagctgggcgtggtggctcatgcctgtcatccc

SEQ ID NO: 32191 - DNA, 601 bp, Human
tggaacccccagccctcagcccccactcctcggccccagctccaggccctgcgcccagcccacctggacccctgaccctcagacactgatactggaacccccagccctcagcccccactcctcggccccagctccaggccctgcgcccagcctacctgttgagggcattgcacatttcaatggtcacgagcacggacaaggccatggtggtggggaagcgtgactcgaacacctcacagtcgatgccggcaaagagcgggttgtcttcggagcacttcaggaagttcctctgggggcaccrtggcaggtcagagagagcggcaggtcaggcgaggggctggtgggtgggaggagggaagcctcatcctgcccttggcccacgcctgggcacaaccagcacacaaaacactgccgtggggtgggctggggatcccgggaggggtgcggggtcggggcggcggtggggagagctgcaccgtgccagggagaagcaagggcacagcgtgggaaaggcagacgttctggagcaggagtgcagcggctcagaaggagaacagctggcattagcctggggaggctagcgggagcctggagatcactg

SEQ ID NO: 32192 - DNA, 601 bp, Human
ccagcagccaggggttcatccagggcggcatccgcagcagcgactggttctccgagacgctgccagggcacagggtgctccccttaggccggggtgcagggaggccctgccaggcacccacccccatgggaggagcctcaccacttctctagcggtgcattgctgttgcccgctcggcctgccagggcctgtcccgggctgggacccctttctctgcccctcagacctaatcttggccgatttctttggaccccagtttcagccttctttgtctcctgggccccaattccggtccccatgractctcagaatcctctctgggcccctttgacccttaggccccaatccagatccccaaatctttggatcccaatcttggacccccactgacccccagaccctaatcctggaccccgcttggccccagacctttgttctggacccctctaactcccagacctcagtcctggactcccctgacccctggaacccaatcctggacccttgaccctctgatcccaatcctgaaccccccaaacatcagaccccaacctgaaccccttgaccccagaccccaatcctggacctctcttgaccccta

SEQ ID NO: 32193 - DNA, 601 bp, Human
acagcgtccactgcagcccaggagcagaggcgggcggggaggcaggctggaggcgggacggggcctcccactcaccgtgcatgtggttccgggacaggtacttgagggcctcatccagcaggatgacaggcagagatatctggagcaccaccacccactggcgcccgctcagtggggtcacctggaaaatgagctggcggggaggggaagggaggtttggttaaaggaaggactggctgtcccgtgccccagccatctgctggccttatccacctgggctctgatggactcttcatgagcrctcctaagaaccccctggatgcacccccgatctttgtccactcagctgcaccccccgatctttgtctgttcagctgcaccccccaatctttgtccgctcagcttcctctgcctcaagggcccacctctgcccttgcccactgggtcaactcccatccatcctgttgggaggcgggaggattctgccctgggaaagctcgtccttcctcccaccccagcctgggcacagtcccctcagcaaggggtttccccctcttccgtcccccaggtctgggagctcctgaaggtggggccacagctg

SEQ ID NO: 32194 - DNA, 601 bp, Human
aatcctccaccatccagcagccaatgctgaaaggcatctgagacacaggcttttccgtgctggctgagacattttagccatgggcataattttctcacttttaagttttctcaagaaaatctgctgagctcctaggcagttgtggccatttgggaactctcccgaggaagacaagccacctgagctgtcatgtccccagaggcctggctctgcaggtgagtgagtgtggtcaaggacggcccagaggcctggctgtgcaggtgagtgagtgtggtcaagggcggctggaggatttcctggyggaccggcccggtgctccggccagtgcagggatgccttgggcccccatggatgggagtttccagtgtctccccagggctgtcacagagcattggccagaaagaaccagacagggggcagaatggccttgctcagctccccccacccccacccattggccccagcaggcttgccttggctgagtgcccacctgcaccctcgagtgagcccctacatgtgtctggccactccctggacaggccagctcccttgctcagcccctagggaatgacagacgcgtgatctatttatagtccctcca

SEQ ID NO: 32195 - DNA, 601 bp, Human
caccctctctttttgggggagagtgggggaacagagttttgctctgtcacccaggctggagtgcagtagctcaatctcagctcactgcaacctccacctcccaggttcaagtgattctcctgcctcagcctcccgagtagctgggattataggcacctgccaccacgcccagctaatttttgtatctttagtagagatggggtttcaccatgttggccaggctggtctctaactcctgactcaggtgatctgcccacctcggcctcccaaagtgctgggatgacaggtgtgagccactgcrcccggcccgttagtctcaccccctcttgcctgtcctccatggttgacacagtccgcaccgtgcttacactcctcccgtgcttccccactgccctgaggacaatgtccagggtctctaccttggcactcaaggcccttgcccctgccgggcctcacccctctgccctgcatgctgagtgtcaacatctgtgctcacccagccctgttccaccaggttcaatcctgttctttccaaccactgctttaacctcaaagcctggagaaactccccctcactcctggcccagcaggaatctctccc

SEQ ID NO: 32196 - DNA, 601 bp, Human
tcaccctctctttttgggggagagtgggggaacagagttttgctctgtcacccaggctggagtgcagtagctcaatctcagctcactgcaacctccacctcccaggttcaagtgattctcctgcctcagcctcccgagtagctgggattataggcacctgccaccacgcccagctaatttttgtatctttagtagagatggggtttcaccatgttggccaggctggtctctaactcctgactcaggtgatctgcccacctcggcctcccaaagtgctgggatgacaggtgtgagccactgygcccggcccgttagtctcaccccctcttgcctgtcctccatggttgacacagtccgcaccgtgcttacactcctcccgtgcttccccactgccctgaggacaatgtccagggtctctaccttggcactcaaggcccttgcccctgccgggcctcacccctctgccctgcatgctgagtgtcaacatctgtgctcacccagccctgttccaccaggttcaatcctgttctttccaaccactgctttaacctcaaagcctggagaaactccccctcactcctggcccagcaggaatctctcc

SEQ ID NO: 32197 - DNA, 601 bp, Human
gtctcaccctctctttttgggggagagtgggggaacagagttttgctctgtcacccaggctggagtgcagtagctcaatctcagctcactgcaacctccacctcccaggttcaagtgattctcctgcctcagcctcccgagtagctgggattataggcacctgccaccacgcccagctaatttttgtatctttagtagagatggggtttcaccatgttggccaggctggtctctaactcctgactcaggtgatctgcccacctcggcctcccaaagtgctgggatgacaggtgtgagccaytgcgcccggcccgttagtctcaccccctcttgcctgtcctccatggttgacacagtccgcaccgtgcttacactcctcccgtgcttccccactgccctgaggacaatgtccagggtctctaccttggcactcaaggcccttgcccctgccgggcctcacccctctgccctgcatgctgagtgtcaacatctgtgctcacccagccctgttccaccaggttcaatcctgttctttccaaccactgctttaacctcaaagcctggagaaactccccctcactcctggcccagcaggaatctc

SEQ ID NO: 32198 - DNA, 601 bp, Human
gcccacctcctggtgttagtctcaccctctctttttgggggagagtgggggaacagagttttgctctgtcacccaggctggagtgcagtagctcaatctcagctcactgcaacctccacctcccaggttcaagtgattctcctgcctcagcctcccgagtagctgggattataggcacctgccaccacgcccagctaatttttgtatctttagtagagatggggtttcaccatgttggccaggctggtctctaactcctgactcaggtgatctgcccacctcggcctcccaaagtgctggkatgacaggtgtgagccactgcgcccggcccgttagtctcaccccctcttgcctgtcctccatggttgacacagtccgcaccgtgcttacactcctcccgtgcttccccactgccctgaggacaatgtccagggtctctaccttggcactcaaggcccttgcccctgccgggcctcacccctctgccctgcatgctgagtgtcaacatctgtgctcacccagccctgttccaccaggttcaatcctgttctttccaaccactgctttaacctcaaagcctggagaaactccccctcactcc

SEQ ID NO: 32199 - DNA, 601 bp, Human
actgccttccccaaccaggcctcaaggcctcaaggcctgccgccctgcccccagccccagtcttaccgtcccatcatacttctgcccctagcatcaagcaaaagccgaaatccagtcccaacaccccatttcatggttcctcactgtcctcagagtaaagtctaagcccgcctgtaacctcccagatctgtccccaatacaaccaccacagcccagcccccacgcctcccctgacaactgctcagccacacctgggcagagccaggaggtggggtgagaggaccgcccccagcccccaggrctgacccaggatccagaattctccccaggacacatccctcgtaaatgacataaatcacggggaagccacaagcatcaggcttcagaaaaacttccctaaaaggccacccagctggcttgggagcgcaaagggtccctctctcacccccgccccgtctggctttaggaggccccagggactgcagtagcgctgggcagggctgtctgggcttccagtgagcacattcctcggggtgcctccaccccacccctcagatggagccgcaggtacccagcctgtgtctgtcctccagcagccagg

SEQ ID NO: 32200 - DNA, 601 bp, Human
tcctccacttctcccaggacagccccaggctcccaaggcctcccttagtccagacctcagtctaccccagccccaccggaccccccaagctgcatccaggatccatccccgcaacgtcccccacgcctccttcactccactgttccatcagcacccccaaaccctccagtacatactctcctggttttcattttggggaatcaccacccattatcgtaaggttcagacaccaggctcatccttgcttctcttgcccatcacacacacccaggcctgatttcacccaaattgcgagagctcrtctctcccactgccttccccaaccaggcctcaaggcctcaaggcctgccgccctgcccccagccccagtcttaccgtcccatcatacttctgcccctagcatcaagcaaaagccgaaatccagtcccaacaccccatttcatggttcctcactgtcctcagagtaaagtctaagcccgcctgtaacctcccagatctgtccccaatacaaccaccacagcccagcccccacgcctcccctgacaactgctcagccacacctgggcagagccaggaggtggggtgagaggaccgcccccag

SEQ ID NO: 32201 - DNA, 601 bp, Human
gccagaaggaagtggggacagagaccccaggacggggcccggggatggccattctgacctcgggcctgtcatttatccggcgggacccggtgggcaagtgggcgagtgtggtggcaagggtggggggcggaggcgaacacatgggcaccatcagtctgaggtacacaccggagactccaccctgttcccagcgctcacttctggctcatttcttctggaagaaaaacccaagagcgcgttaagatgtatgtgtaagggcacacatccagacagcttccttccagccccttccatcctccayttctcccaggacagccccaggctcccaaggcctcccttagtccagacctcagtctaccccagccccaccggaccccccaagctgcatccaggatccatccccgcaacgtcccccacgcctccttcactccactgttccatcagcacccccaaaccctccagtacatactctcctggttttcattttggggaatcaccacccattatcgtaaggttcagacaccaggctcatccttgcttctcttgcccatcacacacacccaggcctgatttcacccaaattgcgagagctcatctctcc

SEQ ID NO: 32202 - DNA, 601 bp, Human
ggtatgctgccagctccggcttcttggctgccccctcccagcctgcagctcctgggccagagctgcagagcagggaacttcccaggagagtccaggagacaggaattacagacctcccaggccagaaggaagtggggacagagaccccaggacggggcccggggatggccattctgacctcgggcctgtcatttatccggcgggacccggtgggcaagtgggcgagtgtggtggcaagggtggggggcggaggcgaacacatgggcaccatcagtctgaggtacacaccggagactccacyctgttcccagcgctcacttctggctcatttcttctggaagaaaaacccaagagcgcgttaagatgtatgtgtaagggcacacatccagacagcttccttccagccccttccatcctccacttctcccaggacagccccaggctcccaaggcctcccttagtccagacctcagtctaccccagccccaccggaccccccaagctgcatccaggatccatccccgcaacgtcccccacgcctccttcactccactgttccatcagcacccccaaaccctccagtacatactctcctggtttt

SEQ ID NO: 32203 - DNA, 601 bp, Human
agggatcggccaatcgtaatccagatctcgtaggaaagccccgcctctatccgcatggaggcgggaattgccacgaagctcctgtggagggagaggaagcagctgcggaaagccaataagagtggggaatcgatgacgtcaaccaatggggacgcggggatattacggccaatgagaatggagaaggtccaggacacgtgggtgggggaagctgagcgctgagaccaagggctaaagctgggaggtgagtctgtcaccttgagccgggcgagcgctgtgggccaagcaggggttgcagggyagtaggagtgcaggtgacttggggccgggagccagcaataggcagggttgtgggctgggcagtgtggaggggtatttccccccagtgctgggagaggctatggcaatctagatatggccttatcaatgaatgttaattaccaacggtaatgaacgattgactgcctcggctggggcgggtcggggactgctgtgtaagatgggcaggatcctgcgcgacacctgcccagtatccgcctccagtcttcccgagagaccattccctttcgcaacatttccttcctggggcttgggcacattt

SEQ ID NO: 32204 - DNA, 601 bp, Human
gaccagtgttgtctcccgggacattgacacagcagccaagtttattggtgctggggcagccacagttggtgtggctggttcaggggctggcattggaaccgtgtttggcagcttgatcattggctatgccaggtaagtttgggtggtctacagcatctcccactgtaaattccaccccgtttggggaagcctcagctggaggagctcccttcaggagccttcaggttgatttcatctacatcatagtttctccagagaaaacatgcatccagcctggctcacttaaacttaccaggttggyccactctgcttgtccatccaaatccccaggatctgtgcaggctaggccctctcccaggagtaacagtccccattcacctcaccctcctgtgtcctcccctcccctcaccccttcctctccctcaactggcaatgatctctgtccctcccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactg

SEQ ID NO: 32205 - DNA, 601 bp, Human
tcggcacctgctgctgttttctcaggaaaacttaagaagccaaaaagggggagaagcaccagccggcagtagctctaaaaataggctgcatctcaggatgttccccagggagatgctgagcctctcggctgcagatggatcctctgggaggcaggtggtgggcgcctgtgggtgtgtatgcaggtgtgtgtgtgtgtgtgtgtgtgtgtgtgcatgggcatgtgttttgctgtggtcctttatgcaaacttgggtctccaacagaggggtttgtgtgtgagagagcatatgcgtgtgtcakatgtagtctgcagggctgtgtgtgtgtttgtacacatgaatgttctgggcctggctgctctgtgtgcacaatggaagatcatagaaagattaatgtgttcataggaagatctctatggacttgcaggcacacacattgggagggcagctgggggcagtgcatgcacatgctgtatttatattagtacatatgcatgcacacatgtgtgagtggccctcagttccctcatctgtgaaatggggatcttgctggtttctatttcacaaggtggttgtgagaggcaaatacatgtcacagagt

SEQ ID NO: 32206 - DNA, 601 bp, Human
cacaagccgctcatttattcttctcaataacccatctctcagatgggcaaatagaggcttgatgagctggggagggccagaagcagcctggtccagcctgaaggtctctctctctctctccagttcacctatgacttcaaggtccaaccatcttgggccagtaagaggccagtgggaattcgtggcagctccttccaaggcctctttgccctgggattagagtccagattctttcatgataaattcctagacaggagtgctgttcattgaagggattttcgtccttatgactgggccttaygactgggtagagtggtggaatggggcgaggaagaaacctactagagtttcttgtgtaaggaagtattaataactggttccttcctcctccttctcccctccccacaaatacaataaaagccctcaaaggaacttaagtttcaaatggaaaattaaaaggcaaagaggatgaaggaagccagacctttcatgagaagagtgatcttacttagttctgagttccctggtaggctaggaaaaaacagaaagaggattgattatagtttttgctgcaaaagaaagggagtctagcagatcctca

SEQ ID NO: 32207 - DNA, 601 bp, Human
ttggggagggggcgtggggctctagctgaccctagatgatagtttggcaaggaacagttttcatatgactgtcccttctaacagccttcagagggcactgggggctcaactaagaaatcagtagctcaatgaaggccactggggtgggagaagacacagggggacatgcctttggattactgatctggggtgttgccttcaggcctggctggggctccctcccccacccagaatgcccaggccggagggcgcaggaagccagtgaaaagaggaatgagatggtggggctctgccactcacycactgtgggtcactccagaggtcagacgggttgatgccagcagagtgccaaacacacattgagtgccccgtgaatggcagcacattctgtgtgtgaactgggggaggaggctaaggggtccaaggtcaaggggtgttacggagggagctccctctctaggagcccacactatagggtcccaggtgaggcatgctttggagggtggcatctgcagacctatccaattgcttagcctgcaggctcagccgctcctgcttccagggatggggcagcctgattagggccccacccacagctact

SEQ ID NO: 32208 - DNA, 601 bp, Human
gacatgcctttggattactgatctggggtgttgccttcaggcctggctggggctccctcccccacccagaatgcccaggccggagggcgcaggaagccagtgaaaagaggaatgagatggtggggctctgccactcacccactgtgggtcactccagaggtcagacgggttgatgccagcagagtgccaaacacacattgagtgccccgtgaatggcagcacattctgtgtgtgaactgggggaggaggctaaggggtccaaggtcaaggggtgttacggagggagctccctctctaggarcccacactatagggtcccaggtgaggcatgctttggagggtggcatctgcagacctatccaattgcttagcctgcaggctcagccgctcctgcttccagggatggggcagcctgattagggccccacccacagctactactcccagactcctagccagtgcccaggtcttgcctctttgataagaccgggcaagaaagagggacttctggactgtcctgtcctcctgcttaaggaggccacagggccaaagccctaccctggtcacccatcatggaagggaccagtggaactctgagcct

SEQ ID NO: 32209 - DNA, 601 bp, Human
gtgaactgggggaggaggctaaggggtccaaggtcaaggggtgttacggagggagctccctctctaggagcccacactatagggtcccaggtgaggcatgctttggagggtggcatctgcagacctatccaattgcttagcctgcaggctcagccgctcctgcttccagggatggggcagcctgattagggccccacccacagctactactcccagactcctagccagtgcccaggtcttgcctctttgataagaccgggcaagaaagagggacttctggactgtcctgtcctcctgcttraggaggccacagggccaaagccctaccctggtcacccatcatggaagggaccagtggaactctgagcctggggtgttatctgatccaggagctcacattcaagcctagctggggctccctccacctccagatccctttcagctggaaattctatcagtcccaggaggcctcgtgcatggccccagctcactgggtgtcaaggcaagaaagttacaaagccagcacaagtggggccctcagaagaggccatttctgggggaggcggcactggaggcacctgggcctgtccaggaaggtaga

SEQ ID NO: 32210 - DNA, 601 bp, Human
ctgggggaggaggctaaggggtccaaggtcaaggggtgttacggagggagctccctctctaggagcccacactatagggtcccaggtgaggcatgctttggagggtggcatctgcagacctatccaattgcttagcctgcaggctcagccgctcctgcttccagggatggggcagcctgattagggccccacccacagctactactcccagactcctagccagtgcccaggtcttgcctctttgataagaccgggcaagaaagagggacttctggactgtcctgtcctcctgcttaaggargccacagggccaaagccctaccctggtcacccatcatggaagggaccagtggaactctgagcctggggtgttatctgatccaggagctcacattcaagcctagctggggctccctccacctccagatccctttcagctggaaattctatcagtcccaggaggcctcgtgcatggccccagctcactgggtgtcaaggcaagaaagttacaaagccagcacaagtggggccctcagaagaggccatttctgggggaggcggcactggaggcacctgggcctgtccaggaaggtagagaccc

SEQ ID NO: 32211 - DNA, 601 bp, Human
cccacagctactactcccagactcctagccagtgcccaggtcttgcctctttgataagaccgggcaagaaagagggacttctggactgtcctgtcctcctgcttaaggaggccacagggccaaagccctaccctggtcacccatcatggaagggaccagtggaactctgagcctggggtgttatctgatccaggagctcacattcaagcctagctggggctccctccacctccagatccctttcagctggaaattctatcagtcccaggaggcctcgtgcatggccccagctcactgggtrtcaaggcaagaaagttacaaagccagcacaagtggggccctcagaagaggccatttctgggggaggcggcactggaggcacctgggcctgtccaggaaggtagagaccctcaggagctaccctcctcttctggaaaagcacaaagtttaaagaagtttcaaggttctagggaggcagtgttgcctggtgattagtggcttgggctttggacataagagatactagttcataccctagttcagtgccttgctgtgtgaccttgagcaaatgcctcgtcatcactgtgcctcagcttctctc

SEQ ID NO: 32212 - DNA, 601 bp, Human
cctcttctggaaaagcacaaagtttaaagaagtttcaaggttctagggaggcagtgttgcctggtgattagtggcttgggctttggacataagagatactagttcataccctagttcagtgccttgctgtgtgaccttgagcaaatgcctcgtcatcactgtgcctcagcttctctctttgtagaatatggataataataagttctgtccctcatgggctactatgcagactaaacaaaatagtctcttcaacctagccctggatcagggtttcagacatggtaggcctaactgtcagtgrtaatgggggtcctgggaggcagggtcccaccctccatgggaaatcgggcaggagcggggaggacagctagatagagagctgtcctctgtcagtcccagacccttctgccacctgccggctgtcaggatttctgccctggcccagctcaagggacaggggtctagggggcagtggggaccaacccaagcccagtcagcccagtgaattttccaaatgaaaaatgtatcccacactttggaaggctgaggtgggcagatcacctaaggttgggagttcgaggccagcctggccaacatggtg

SEQ ID NO: 32213 - DNA, 601 bp, Human
tgggaaatcgggcaggagcggggaggacagctagatagagagctgtcctctgtcagtcccagacccttctgccacctgccggctgtcaggatttctgccctggcccagctcaagggacaggggtctagggggcagtggggaccaacccaagcccagtcagcccagtgaattttccaaatgaaaaatgtatcccacactttggaaggctgaggtgggcagatcacctaaggttgggagttcgaggccagcctggccaacatggtgaaactccctttctactaaaaatacaaaaaattagccrgatgtggtggcaggtgcctgtaatcccagctacttgggaggctgaggcaggagaaatgcttgaacctgggaggtagaggttgcagtgagctgagattgtgccaccactgtactccagcctcggtgacagagcgagactccatctcaaaaaaaaaaaaaaaaaaaggaaaaatgtatctcagctggcacagtggctcgtgcctgtaatcccagcattttgggaggccaaggcaggaggattgcttgagcccatgagttcaagaccagcctggccaacatagagagaccccatctctacaaa

SEQ ID NO: 32214 - DNA, 601 bp, Human
tactaaacatacaaaaattagccaggtatggtggtgcatgcctacaatctcagctacttgggaggctgagagaggagaattgcttgaacccaagaggcagaggttgcagtgagccgagatcgtgccactgcactccagcctgggtgacagagtgagactccacctcaaaaaaaaagaaaaagaaaaagaaagaaagaaagagagagagaggggaaggaaggaaggaaggaagggaaaggaaggaaggaaggaagaaagaaagaaagaaagaaaaagaaagaaaagaaaagaaaaaaaaaagaaaagaaaagaaaaaagaaaagaaaaaagaaagaaagagatgggtggagaagttgctggtttggtcccagtgggaggtctatgctgattcctgggttcctccaccttgttccagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcaggtgagtcctctcagaggaccagatggaggg

SEQ ID NO: 32215 - DNA, 601 bp, Human
gggaggctgagagaggagaattgcttgaacccaagaggcagaggttgcagtgagccgagatcgtgccactgcactccagcctgggtgacagagtgagactccacctcaaaaaaaaagaaaaagaaaaagaaagaaagaaagagagagagaggggaaggaaggaaggaaggaagggaaaggaaggaaggaaggaagaaagaaagaaagaaagaaaaagaaagaaaagaaaagaaaaaaaaaagaaaagaaaagaaaaaagaaaagaaaaaagaaagaaagagatgggtggagaagttgctgrtttggtcccagtgggaggtctatgctgattcctgggttcctccaccttgttccagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcaggtgagtcctctcagaggaccagatggagggacatggcactcagggctcaccccaggcagtgtgactctccaactagcaccccacagccc

SEQ ID NO: 32216 - DNA, 601 bp, Human
gcttgaacccaagaggcagaggttgcagtgagccgagatcgtgccactgcactccagcctgggtgacagagtgagactccacctcaaaaaaaaagaaaaagaaaaagaaagaaagaaagagagagagaggggaaggaaggaaggaaggaagggaaaggaaggaaggaaggaagaaagaaagaaagaaagaaaaagaaagaaaagaaaagaaaaaaaaaagaaaagaaaagaaaaaagaaaagaaaaaagaaagaaagagatgggtggagaagttgctggtttggtcccagtgggaggtctrtgctgattcctgggttcctccaccttgttccagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcaggtgagtcctctcagaggaccagatggagggacatggcactcagggctcaccccaggcagtgtgactctccaactagcaccccacagcccgtgatcccaccttcaaggttcc

SEQ ID NO: 32217 - DNA, 601 bp, Human
atgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtccaagcctggggctgcctctgctctccaagacccaaagaccctgggaacctcctctggtcttccccactggcagtggcagcagccccaccccgagcgcacactgtgatggaggagactgagctccctggggcrggcagctgacactaccagagagactcaagcaataattagaggtgggcagagctgccctctcggcattacctcttctgcaggctctgccatgcacgcacctcactgccaggccattaaaatcagcacccagcatgctggaggtgacgtggccttctccctccagccacctgctgccacgggcaggccctggctatagcttatacagtatctccccttgtccccacccagtcaccaaagccacctacatgacagtccatccctgttgaattaataaattaatgtatccatgcaacaaatacc

SEQ ID NO: 32218 - DNA, 601 bp, Human
ccctgccacccacaacacccacagccccaccaggctgagcctgggaaccgtgtgcagccatcctccctggcaaggctggggagaacaggcagccgctgctgtgtatcagatctcatacttgctgacacagacctgatggctcctcttgccgctaccccattttcccccagcagaacctggctaaaaggggccctgaagcactagcaggccccctacctccagaataggacccaagctttggccacaactagtttctctttctgtttgtaatcagcaaggtagaggtgggacaagtcactgktaactggccttggactttggcctgagctctgtggctcctccttggcccgggtgaggggccctggccttggtttctgatctcatctaacactgctctctggcattggctgggggctggggcaaggcagagaaatcacaccctcttccctcccccacctcatggttttttttcttgtccagccccttgctggagcctaagatgagggataaggaagcaggagaccagctgagttattttggaaacagtttttgttgaaagtttagtcttcaggtctagaaagggaagaaaccttgagcaagg

SEQ ID NO: 32219 - DNA, 601 bp, Human
gctgatgcccagcacaccagtgcaggagaagccagtccccgcatctcctccccacccccaaaccccgcatgcagcaagggctgcctgccacccactggccagtccccagagtgcccaagctggaaagggttaaaaactgcagtgcaagccagcttcagtcctctgctgctgcccgctgcagccctctccctgacgtttgtcccttctgcccaaaagaaacaaaacagaatggccctgtgccctcactgtgcgcagggggtggagcgcctgcctccagcctgaccagagttctttaggtgcytgagcaactcgggccgccggttaggagaatttttgccacttgggtggactctgcctgagccaaccgcctccaaataggtgacacagaaactagcagagatagccccagacatcgtccctctgccctacccaaggactggcctgcttcagtttggagccttctagagcttcttgatgaggcctccagggcaatcgttcccttcactcggcctctggggctctcactgatgagatgcaaacctgtgccaggcctcaccagcgctgctggtttggggctggggcaggcttttctcccgcccct

SEQ ID NO: 32220 - DNA, 601 bp, Human
atcccttgtgtcacctaacactatgccttgtgcctagaatgctgataaatgtgtgtaagagcacaccagtgccccaatgacacgaagccccatggccctgagacaggcctttaccagacaccaaaggctgtgttcctctcctgggcctgggtcatctaggggcttgatatcagtggctgcaggacgagcccaactctctctcccagcttcagccaggttggcttagaaggtgagctccctgcctccctgtggggcctgcagagctcctgtcccactttaggagccgcccaggagctggctygtcactcccacctctgcgcttgcctgcgctttgcacttcctttcgcatgtgcctgcgcctgcctgttctgctggcggaagtgcctccccagtgctttgcatgggcagctccttcccgtcccttagctcagatgtcccctcggggaggccttccctgacccccatctcaagtacacagccttcctttactctccttcacatcactttattttcttcataacctttctcgctgtctgaaattattttcttatgtcttcacctgttgtatctcctgttactagatgtgagttccattgagttt

SEQ ID NO: 32221 - DNA, 601 bp, Human
ctcccaactctggccttgtgcaacataaacggtctgcttttcaccctgtccccattagcaaactgtccaccgcctcaccccagcccacaccctctgggaataggctgccggacatctgtttttggagggcttgggggtagaggagcaccaggtgccaaaatgggcccagtgggagggcaagagccatgtgcttttctccctgcccctgatgcggccccagctgtggccttcccactcagcactgctagctcctcatcctcctggcttggcagccgtcccctcgctttccatccccccatcmaccccacgcactgtccgtcagccatgttctgctgccgaccacccccacgctcaccacacgcagtggctcagctcctttggaagctggtagcacccacggcaaggaacagggctgccagtcagaagggagtggatgcctgcatttcctcttcaggccggccagaggcattctgcagcctcccctcctcgtcccagccagccaaccctggctaacacactcagacaaagaatcctttcggctctcattcactccatgactttggttcatttcatcatttcagggagaagtcaaagccaggga

SEQ ID NO: 32222 - DNA, 601 bp, Human
gcctgacctcctctctctctgcttcactccacagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccaygtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccaga

SEQ ID NO: 32223 - DNA, 601 bp, Human
tctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctycattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagt

SEQ ID NO: 32224 - DNA, 601 bp, Human
cccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcarattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcgg

SEQ ID NO: 32225 - DNA, 601 bp, Human
gtgggggaggtaggaacctgctctgagagcctctcggtcatggatagctgggggccagaagtgtaccgtcgccatcaacgtgctcctggcccagactgtcttcctcttccttgtggccaagaaggtgcctgaaacctcccaggcggtgccactcatcagcaagtaaggctggtcttcatgtccacccgcctatgccactctcccttcttgggagcatgatggcctcctgcattgccctcttgccctccatccaccccccccatcctcaattcaggaggcctgaggggggcagccactaagsgtgggggtggcatcatggtatgggctgccagctcctgcccaccccaccctgacaggtacctgaccttcctcctggtggtgaccatcctcattgtcgtgaatgctgtggttgtgctcaatgtctccttgcggtctccacacacacactccatggcccgaggggtccgcaaggcaaggaccctccctgcccacttcaacatcccgctgcccactcccctacgcctccctctcgcacgccccggcagtactcacctgtggcattccacagcacacccatcctgggcgtatctggacgcatgga

SEQ ID NO: 32226 - DNA, 601 bp, Human
tagctgggggccagaagtgtaccgtcgccatcaacgtgctcctggcccagactgtcttcctcttccttgtggccaagaaggtgcctgaaacctcccaggcggtgccactcatcagcaagtaaggctggtcttcatgtccacccgcctatgccactctcccttcttgggagcatgatggcctcctgcattgccctcttgccctccatccaccccccccatcctcaattcaggaggcctgaggggggcagccactaagggtgggggtggcatcatggtatgggctgccagctcctgcccaccycaccctgacaggtacctgaccttcctcctggtggtgaccatcctcattgtcgtgaatgctgtggttgtgctcaatgtctccttgcggtctccacacacacactccatggcccgaggggtccgcaaggcaaggaccctccctgcccacttcaacatcccgctgcccactcccctacgcctccctctcgcacgccccggcagtactcacctgtggcattccacagcacacccatcctgggcgtatctggacgcatggaccaaaatcgattacagtaatacaggaatgaaattgcttcctagg

SEQ ID NO: 32227 - DNA, 601 bp, Human
acacctgtaatcccagtactttgggaggccgaggcgagtggatcacctgaggtcaggagtttgagaccagcctggccaacatggcaaaaccctatctctaccaaaaataccaaaaataccaaaaattagctgggtgtggtggcgggcacctgtattcccagctactcaggaggctgaggcaggagaattgcttgaacctgggaggcggaggttgcagtgagccaagccaagatcgcaccactgcactctggcctgggtgaaagagtgagacgtgagactccgtctcaaaaaaaaaaaaaargaaagaaagaaagaaaaaggaacaggggcagggggggcacctcagggccagggggccatggaattagccaccagttgggacccggacataggtaagaagggccccaggaaatggagacatgggcctgctggaagcccaaggatgagaacaggacccagggaagacctggtgccgccgctggttatcccacacctgcctcccaccctcaggggaatgaggagtggttcctggtgggccgagtgctggaccgcgtctgcttcctggccatgctctcgctcttcatctgtggcacagctggca

SEQ ID NO: 32228 - DNA, 601 bp, Human
gggccagggggccatggaattagccaccagttgggacccggacataggtaagaagggccccaggaaatggagacatgggcctgctggaagcccaaggatgagaacaggacccagggaagacctggtgccgccgctggttatcccacacctgcctcccaccctcaggggaatgaggagtggttcctggtgggccgagtgctggaccgcgtctgcttcctggccatgctctcgctcttcatctgtggcacagctggcatcttcctcatggcccactacaaccgggtgccggccctgccattcyctggagatccacgcccctacctgccctcaccagactgagccaaccaaccactgtggggcatgtgggagtcacacacgtgggtcacactgagtcttatcagccacgttctcctactgaggtcctaagtgtgctctttgggaagtgcccttcaggactgtgtgagccaaacagccctgagaaaagctggggaaacagtctgagctggagtccgagagtggttgggggtgggccgtggctagtgtcctgctgcagtcagcacacacgtgggattggctagctcatcctggcaccagccacccc

SEQ ID NO: 32229 - DNA, 601 bp, Human
tcagttgagtgcttgaggttgtcttttcgacgtaacagctaaacccacggcttcctttctcgtaaaaccaaaacaaaaaggctttctattcaagtgccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctrccaggacctggccctgcactctcctgttttttcttctcttcatccctgtcttctgcaaaggtgagtgagacttttggagcatgaagatggaggaggtgtttctcctacctgggtttcatttgtttcagcagtcaagggcagtgatttatagcaaagccagaagttaaaggtaaaactccaatctggcttggctggctctgtattccagggccagcagggagcagttgggcggcagcaaataaggcaaagagatagctcagaacagagcgccaggtatttagtaggggcttcatgaatgca

SEQ ID NO: 32230 - DNA, 601 bp, Human
agtggcttggtggaagggactagtgtctctaatatagggtgatttataagcaggaaagtgtgtcctagaaattcagaccagagtgatagattggaattggatcatgggggactcattgaatgttatttattgtatttgtttttgcgatcagtgttagtaaagtgtcaaagggattgagcagatgagtgacatcatgcaacacaagttttgagtttcacttgtcagactgactggagaggggcctggttagttacaggaaggtaatttggcatgcagccactatttttgagttgatgcaagyctctctgtatggagagctggtctcctttatcctgtgggaaaagagaacaaaggagcatgggagtgttcaagggaaggagaaataaagggcagagaggcagcggtggtgtcaggggaagcccacaggagttaacagcagggttgcctcaacctagagaggaagcgacctggtgccctcggctctgtggcttccttcatctaacaacatcttccactctacaacaatgccagggaaggcggaggctggtacagtgcatcaagacacagctactcctgggtgacagaggttcagggccagctc

SEQ ID NO: 32231 - DNA, 601 bp, Human
aaacttggagtttcttgtttgattttctatttgacctttgattgctgctgttttcctactaagtgtttggccaaaagtgagagggccagtacagataaagcaaatagtgtttcatggggttaataattaataaactgaactgtcatcagaaaacccgcggatccagttcattataatgtcatgatgacaacattttgtgagagaagtctgtataaaaagcaattgctcttttgtttccaaaacaggtattacaagtggataaataatgtgcactgctctgagcccaaaggtacgcagtggrcctggcctctctgatatgcatcagtatagccaatggctagccagcagacatgaagctaatttgctaccaatgaaagaagatctggccttgtggttaaccaatctattaggtaaggttataagatctcattttgtgagcaaagacaacagtttttgttttatttttcctcctgtagtgtccttcacctaagcatgtgatagcaccttggaaagaaagacttttattatttgacatttgcatctgggaaacctgaagcaggtggaaaatttaagtgaatttcccaatgtctgtcatattaac

SEQ ID NO: 32232 - DNA, 601 bp, Human
cattataagttatgcatatgtaatgatccagggtctttttaaaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtaagtaaaatcagtcagacttcttaccaacggttagtctttcttgcactacaaaacatattctgtgcaatctcgtatcagtctaatctttacctatatcaattttcttgaaatktattttaagcccatatgaaaaactttgtagtcctacaattcattttgagattcaaaactgaactagttgttcaaaataaagtgtcatttaatgctgcagaccaatatctaaaactttagaataataagtcaactccctgaaaattgtatttgaaaacatgaaagtctctttgtcactggatcaccattccccctttcacagatgagaagtctgaaaacaagatcttgaggattgttaaagaagggaaagtaaatgtatgatagagaagttaagtgccttttatggactaccattgttttt

SEQ ID NO: 32233 - DNA, 601 bp, Human
gcatatgccctccacatatattttaagtgcaaatataaaaaaaattaataaaggagataaatcatgagtgactgggatgttgtttatgcaaagtttgtattgtgggagttgtagttgcttattaattttatagaaaatggcaatgccagaggcattagagtgacgtatgtctcacatacatggggagagtccttagaaactagcaccaaccacaatgccagctgtgaaaataggcagaactgaaaaggactggtggtccatagctgtgagtttcttcctccaggatatgagcagaaaagakctgggaaaatggttggacactacaggatgcagaaaaagagatttctctgacttttgcttttctccatgtgacacgatcaactatattgcagatttagatgagccgaaatataacagtttgtctgatagattaagaaccctcatttctgttaagggcagcaagcatattagctcttaaaggtatcttagctagtttaatttggtttcttctgggtaactgttcaatcactcaggaactaaagaagaacaggaaagacattttgatttaaagctactgaaaaggattttaaaatcacataac

SEQ ID NO: 32234 - DNA, 601 bp, Human
attcttgaaatgcatctctacaacatttctgctaccagaaggataaaactaaatgcactttggacttgattaaaattatatagggtgctctataacatttgggtgaaatccaagctcgttcatatgtcatatagtccatagccctccatgttctggcctactgtgtgttttctggctattttgtctgctgcattagtccctgaattttgatgtagccattgttgctttctcactatacttctgcctactcacctgttacactacttttaaacacctttccatcttttaaaattcaggttgygctaccccctatataaagatttttctggtatctctcatcccaggtataactggcaaatcattccttggtgctgccaagtatttgtatctatttaatgaagcatttacctttttgggtataaatgtcctttcatctcaaggtgcagactttgtactcaaagacaaagaccatattttatcgatctacatccagtactgtgttttttggatatattatcaatgtagctaattaaggttgaaacttctcccttattctgtttatccatgttggccacatgctctggaaatgcatgcacctttc

SEQ ID NO: 32235 - DNA, 601 bp, Human
tgttaagtagttttctcattttttgatgaaagctatttttaaggttctttgaatccatgattattttgttcctctaatttccccctgtgacctgtatagattcatgttcttatatatctatttagtcaatgtgtatttaatgaatatttatttgccattaagatgtgctttacatcaatgattttaaaatataatgaaataccatcttaactccaaaggaactcagtctagcaagaagacattaaggttaaccactaaatgagatacaatatgctatgataaaaataagtgccaaaagccrtaggtttatatgtcagcaaaattaaggatggcaaaaaggactaatggcaatgtatatattaaagttggttcttttgttcttttccccccaaaatagtgttggttctctttgtatacatcctcactgagtcataattgtacatgcgataaatttatgagataaatttaatttcagggtttttttcctttttttttggttattcttctattgtcttatgctttcaaactttctggaacatttcttattctaggaaaaacaagttgtttaattcctttacattaacattcaattgagttcatg

SEQ ID NO: 32236 - DNA, 601 bp, Human
cagataagtcaacagaaagtgcctgctttacactcatgagtaaaagcactccagacatttttataattgcaagatttttatgctttttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtayacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaa

SEQ ID NO: 32237 - DNA, 601 bp, Human
tacacttttcctaattttttcatcttctgggcacaccacagttagaggaattttctgtagacccagaagatttgttatttttttaagtatttttttaagtatgtttaaaaaaatgggaagggatttgggaacacccagcttttgcatagagtctgttaggaaatcaggaagtgactgggaccaagccagtattggggtgaagggtggggagcgagtgaccctaactttgcttgtcctcacaggtattctgaggccagcttcctagctagatttcctgtttcttagatttttttttttttttaaacaaaccgtttttggaggcagacactttaaacaccagagctaaaacctgagtgctgaacttgatcaacccgcacaatttggaggcttctggaaacccacactatgcacctctcgctgactgggtagatggggtgagcttactttggggtgagctcagagtcctcacactcctttatttcctgggtcctacaccctcctaagcgcctgcagaactgtgagtccctgtgtcttggtaccacacacagaaagacaggtggtggtgcccttctcccctgaatctatcactccccaagggcac

SEQ ID NO: 32238 - DNA, 601 bp, Human
tccctttaaggctgttatgggcataaagaaaacatggaaatgggagtgacagtggcagacaggtggccttttacctttcctggtaataccaattaaccctttgcatgaacgaaagttgagaataatactgatagggcaaatactgatattagtatcactgcatctaagacagtggcagcattaagattatgccataaaatttgctcgtatcctttgtaaaatagataaaacaaaaatgcaggcagcaggcaatcatgatggtaattatggaatgtattcaaatatatttcttttttttttwtaaaaaaaacttttacccctcttctgaaagccatttctaataatgtactttcaaagtttccattaacgtactttcaaagtttctggtttactcctttacatatatctgagaaatagacctggtgatctccggttttcaggggaagtggagactgcccagagccatttagcacattagcaagtggcttgtgattgcatttcacgacctaaatcttagacctgtgactatagtgcacggccaattgctgtccacggtggggggtgggcggcagggaggtggggcactttcatgttaatgtct

SEQ ID NO: 32239 - DNA, 601 bp, Human
ccctttaaggctgttatgggcataaagaaaacatggaaatgggagtgacagtggcagacaggtggccttttacctttcctggtaataccaattaaccctttgcatgaacgaaagttgagaataatactgatagggcaaatactgatattagtatcactgcatctaagacagtggcagcattaagattatgccataaaatttgctcgtatcctttgtaaaatagataaaacaaaaatgcaggcagcaggcaatcatgatggtaattatggaatgtattcaaatatatttctttttttttttwaaaaaaaacttttacccctcttctgaaagccatttctaataatgtactttcaaagtttccattaacgtactttcaaagtttctggtttactcctttacatatatctgagaaatagacctggtgatctccggttttcaggggaagtggagactgcccagagccatttagcacattagcaagtggcttgtgattgcatttcacgacctaaatcttagacctgtgactatagtgcacggccaattgctgtccacggtggggggtgggcggcagggaggtggggcactttcatgttaatgtcta

SEQ ID NO: 32240 - DNA, 601 bp, Human
aattatggaatgtattcaaatatatttcttttttttttttaaaaaaaacttttacccctcttctgaaagccatttctaataatgtactttcaaagtttccattaacgtactttcaaagtttctggtttactcctttacatatatctgagaaatagacctggtgatctccggttttcaggggaagtggagactgcccagagccatttagcacattagcaagtggcttgtgattgcatttcacgacctaaatcttagacctgtgactatagtgcacggccaattgctgtccacggtggggggygggcggcagggaggtggggcactttcatgttaatgtctacttgtgttgttacttctggtgtgttttgagtataactctatttggccaacttttagaaaatcttttaattcccctaaaaaagataccagtagtatctgggaaactctaaattggagaagaaaccagggatgaaactctccttgatatgatgctggtaaaagctttgcatgaagttattggccaactatatgactgctcccgggtattcttgaattcacggagacaggctagctggagaagtaaatcaaatctatagggtcc

SEQ ID NO: 32241 - DNA, 601 bp, Human
gattgtaaccgcttctcaccttctcgtctctcctctgtgtccccctcttctgccaggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcagtccrgacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatt

SEQ ID NO: 32242 - DNA, 601 bp, Human
acactcctctcccaccctcacccccacactccgtaccccaacatctcgccactaaccaggacgaccagccggttttttagtctcaaaagcagcacctcagttggcagacttacattcaaacaacaaatacataaagcatcattaagggctgccctctctgaccactcgatctgtagagggaggtgacccttctaccgaattgaactaaggaacctgctgatgagaagcgacatcctttgcacttgaagctctgacccctaccagaaaatcccagtgctgagcgcacgttccaggggttctyttctcaacttcgaaagttctgcgggctgggaaactcccactctctcccttctccgtctcgggccgtcccccttacttggctcggccggatcggcgtcggggcgtcagcgtatcgcgtgggtccgcgctgggatacccgggccaacgagcggggagtgctgcgctgtgcccgccgtccttgcccgccgcctgcagccgccgcggccgggcggtttataaccagcccagccgacccgccgcggggcttttccgtgacgtcagcgcccccgccgggagggggcggctctgcagcaaactcgga

SEQ ID NO: 32243 - DNA, 601 bp, Human
ttaaaaaaccacatccattctcaagagttctttaattcaactcagattccttttttgagtcagggtcttgctctgtcacccaggctggagtgcagtggcacgatcatagctcactgtagctagcctccaactgccaggctcaagagatcctccacttcagcctcccaagtagctgggactacagacctgcactaccacgtccactagtttttttatttttatttttattttttggtagagacagtggtctcactaggttgcccaggctggtctcgaactcctggggtcaagtgatcctcckgcctcggcttccgaaagtgctgagatcacaggcctgagccaccattctcagatccccttcttgaagcaaatcagaaggctgaagactcccctaaatgatattcaacaacttctctacaactttccctttgcagactgcctcccctagccgggaggtctgtttttccggctactggtgacaaagtataagtacttacgttgcaatcagcaagatgcacaaacactcctctcccaccctcacccccacactccgtaccccaacatctcgccactaaccaggacgaccagccggttttttagt

SEQ ID NO: 32244 - DNA, 601 bp, Human
gctcatgttcagacctatgaaatttgcagagaaagtgcctcattcttaaaaaaccacatccattctcaagagttctttaattcaactcagattccttttttgagtcagggtcttgctctgtcacccaggctggagtgcagtggcacgatcatagctcactgtagctagcctccaactgccaggctcaagagatcctccacttcagcctcccaagtagctgggactacagacctgcactaccacgtccactagtttttttatttttatttttattttttggtagagacagtggtctcactakgttgcccaggctggtctcgaactcctggggtcaagtgatcctccggcctcggcttccgaaagtgctgagatcacaggcctgagccaccattctcagatccccttcttgaagcaaatcagaaggctgaagactcccctaaatgatattcaacaacttctctacaactttccctttgcagactgcctcccctagccgggaggtctgtttttccggctactggtgacaaagtataagtacttacgttgcaatcagcaagatgcacaaacactcctctcccaccctcacccccacactccgtac

SEQ ID NO: 32245 - DNA, 601 bp, Human
aatgacctgctcatgttcagacctatgaaatttgcagagaaagtgcctcattcttaaaaaaccacatccattctcaagagttctttaattcaactcagattccttttttgagtcagggtcttgctctgtcacccaggctggagtgcagtggcacgatcatagctcactgtagctagcctccaactgccaggctcaagagatcctccacttcagcctcccaagtagctgggactacagacctgcactaccacgtccactagtttttttatttttatttttattttttggtagagacagtggyctcactaggttgcccaggctggtctcgaactcctggggtcaagtgatcctccggcctcggcttccgaaagtgctgagatcacaggcctgagccaccattctcagatccccttcttgaagcaaatcagaaggctgaagactcccctaaatgatattcaacaacttctctacaactttccctttgcagactgcctcccctagccgggaggtctgtttttccggctactggtgacaaagtataagtacttacgttgcaatcagcaagatgcacaaacactcctctcccaccctcacccccaca

SEQ ID NO: 32246 - DNA, 601 bp, Human
ctcctggtttaatgcttcatcatctaagaattggaatcaggagaggtttcccttccttagagaaggaaaacttggacaaataagaagagagttaaccaggcatggccctgtctttctgtgagtttccccacctcccacagcgtcattcttctaatcagtaagtgtttgcccttggggaattaaaactctgtctcgcccatcgtgtgcctgctcacaatatgcagaaggaatgagatcacagtgggactatttggattaccaggggtagaacctcacaacctcaacctgtaaattagacaaygcaagggagactgtcagagcctgagcagcacagaacggggatggcctgactgctgcttcccaccacagggttcttagctcttctctaaaacccctccctgcactcagacaactccttcaatgatggaggaactttctcagcccaccactcaggtacaggggactcgcttgagtgcccagtcattcaaatagaaacatactgtgttccaatcgctgacggaaaaggaaaacccaactttctcctggcttaagagatatcagaacaagtctagagaaaaagtggactaaggatcacagccat

SEQ ID NO: 32247 - DNA, 601 bp, Human
gagtaaaaggcatttgtttgcatcattcctggaccttttgtatggcaaaatcatttgtgaggataaacttactcaagagcttttgactcagattcaatggttaatgctatgaggaaacattaaccacccagtgaaactgtaagccacattttcataagtccattgtacctttcagtgggtagttactgaatactcactagcaatttcaggagctttgggctcagagacattgctcctcttcggacaagtgcaagaatgaatcttgagactctccctgttttggctgtttcttccttttttwaaaaaaaatgctgttccctaggaataagtgggcttgtttttccatcttgagtataatagaaatgcagcctccagctctacttggtaatggaaactttcctccctgcacttgagcccagatcttgtgtaggtgaagggtgaacacagtacagtacaatgggccaaagcagttccagcctggaaaatccatggggggcaggcgtagaaaaggggtacagtgggatttttgcaagtgggatttccctcatcccaataccattgagcccatccccactctattttcacaatgaggtttcctgtt

SEQ ID NO: 32248 - DNA, 601 bp, Human
ttttaaaataaaaataaaaataaagcaataatgagatatcttgggaaaaaattgagaattttacaaatgtgtaatacagttaaattatacaagcttttctgggacagtctcaatttcaagtatttcattgcattcaatgaccatgcatcaagttttggtttggaaaaaaaatgattactgtagacagttgtgtcctagtaggaagacattcccaaactagtgtgtacattgtctttatcaggtgtctttcctcctgagcagggcctggcaatgtagtattttagttttataattgtaccagggatcaaatctgaattaggccagtaaaatctcaagggctataaaagcacttggctgcccactcagcagatagagattttccctgagctaagtatgaagaagaatatgtgaccccatcagactgatgcctcaaatgaaatttcagaagccagggatggggagtaggagagtaggacagtgtttctagggctcacaggaaccagagtcagccagagtagaattctttttcctcaatgaaactctttctcacagttcccctaaatcagagttccctatcctccttgcatgaagatgctacttt

SEQ ID NO: 32249 - DNA, 601 bp, Human
tggaaataagaattctactgcttagctttcctctcttttaaaataaaaataaaaataaagcaataatgagatatcttgggaaaaaattgagaattttacaaatgtgtaatacagttaaattatacaagcttttctgggacagtctcaatttcaagtatttcattgcattcaatgaccatgcatcaagttttggtttggaaaaaaaatgattactgtagacagttgtgtcctagtaggaagacattcccaaactagtgtgtacattgtctttatcaggtgtctttcctcctgagcagggccyggcaatgtagtattttagttttataattgtaccagggatcaaatctgaattaggccagtaaaatctcaagggctataaaagcacttggctgcccactcagcagatagagattttccctgagctaagtatgaagaagaatatgtgaccccatcagactgatgcctcaaatgaaatttcagaagccagggatggggagtaggagagtaggacagtgtttctagggctcacaggaaccagagtcagccagagtagaattctttttcctcaatgaaactctttctcacagttcccctaaatcag

SEQ ID NO: 32250 - DNA, 601 bp, Human
attggaaataagaattctactgcttagctttcctctcttttaaaataaaaataaaaataaagcaataatgagatatcttgggaaaaaattgagaattttacaaatgtgtaatacagttaaattatacaagcttttctgggacagtctcaatttcaagtatttcattgcattcaatgaccatgcatcaagttttggtttggaaaaaaaatgattactgtagacagttgtgtcctagtaggaagacattcccaaactagtgtgtacattgtctttatcaggtgtctttcctcctgagcagggsctggcaatgtagtattttagttttataattgtaccagggatcaaatctgaattaggccagtaaaatctcaagggctataaaagcacttggctgcccactcagcagatagagattttccctgagctaagtatgaagaagaatatgtgaccccatcagactgatgcctcaaatgaaatttcagaagccagggatggggagtaggagagtaggacagtgtttctagggctcacaggaaccagagtcagccagagtagaattctttttcctcaatgaaactctttctcacagttcccctaaatc

SEQ ID NO: 32251 - DNA, 601 bp, Human
aaatgtctcactggagggtccctggaagtaagggagatgggctttagatctgatcccccataaattcactgtctgaaggtcccatttcatcaaatatagtgatattagttataacagtaaaagccatacccttaatttactgctgacttacaatgtgccaagaacaaggctaagttctttataaacactgttttcaatgtccacaacaatcttggaaaatacattattatccctgtcaaatacatgaagaaaccgaggggagtctcctctgcaggtgaagttcacacagcctgtaagtggyagtgaagccaggtctgctcagttctcaagcccatactcaactctttctcctgacccagtttccagaattggaaataagaattctactgcttagctttcctctcttttaaaataaaaataaaaataaagcaataatgagatatcttgggaaaaaattgagaattttacaaatgtgtaatacagttaaattatacaagcttttctgggacagtctcaatttcaagtatttcattgcattcaatgaccatgcatcaagttttggtttggaaaaaaaatgattactgtagacagttgtgtccta

SEQ ID NO: 32252 - DNA, 601 bp, Human
cttccttttctggtaggccagccgccgttcattcttctccttgctgtcccgccgaaggcgcacctgtcgcacaatgccctcaaacagctccttcacgttgtgctggacagctgcagaggtctcgatgaacttgcagtcaaacaccactgcacaggctctcccttctgggaaggaaagaaagaggtcagagggactgcagagcacagtcccacatagcacacagtcaagctggatggttcttcgaggtaacactaagtcagctgtatatgcagtggatagaggatgctgctgcggcacgggcctcccagggcatgaatagaaaatgtctcactggagggtccctggaagtaagggagatgggctttagatctgatcccccataaattcactgtctgaaggtcccatttcatcaaatatagtgatattagttataacagtaaaagccatacccttaatttactgctgacttacaatgtgccaagaacaaggctaagttctttataaacactgttttcaatgtccacaacaatcttggaaaatacattattatccctgtcaaatacatgaagaaaccgaggggagtctcctctgcaggtgaagt

SEQ ID NO: 32253 - DNA, 601 bp, Human
tctccttccttttctggtaggccagccgccgttcattcttctccttgctgtcccgccgaaggcgcacctgtcgcacaatgccctcaaacagctccttcacgttgtgctggacagctgcagaggtctcgatgaacttgcagtcaaacaccactgcacaggctctcccttctgggaaggaaagaaagaggtcagagggactgcagagcacagtcccacatagcacacagtcaagctggatggttcttcgaggtaacactaagtcagctgtatatgcagtggatagaggatgctgctgcggcaygggcctcccagggcatgaatagaaaatgtctcactggagggtccctggaagtaagggagatgggctttagatctgatcccccataaattcactgtctgaaggtcccatttcatcaaatatagtgatattagttataacagtaaaagccatacccttaatttactgctgacttacaatgtgccaagaacaaggctaagttctttataaacactgttttcaatgtccacaacaatcttggaaaatacattattatccctgtcaaatacatgaagaaaccgaggggagtctcctctgcaggtg

SEQ ID NO: 32254 - DNA, 601 bp, Human
ctcggtgggcattgaacaaaaattgtttgctaagcctttgtttccagcaaggtccacatcatttcttttcacagtttgatggagcaataatagtcacgattctgatgagcctagttctacaattctagctccatggatcttagattcgtagaaagttttccctcctttgaagaaactcattgacagctttcttatatttgtttatgactcattggcctcaaagtcacatatcagaacactgggaaaaatttttaatgatgaaaagttcttgttctaggcattctttgtaagctttacttcyctactatccaaaatagaagaaacacatgtgaacaccaaacacatcctctaaagagtcttgggtgttcaaatagcaaggtcaggcttttcctggaaataaatactgactttttacaaaaatctttcatttcccatgcatcatgttgcccacaaggctaatacgctagctccctgctacaatgggggaaaccacatctaacttaagtattcaatctaatatagattattggtcccaatggccttcaacaacggccatcaaagggacatctgggtgaccctgggttcctagagtacagagagg

SEQ ID NO: 32255 - DNA, 601 bp, Human
cctcagcttctcccacacaagcccacagatgggaggatgaacaaggagtcagagtggacctgtggctctcccctgagaggataccaggattcgaggctcagcgccctgggaggagtgaacccctcagtttcctgagcctcatcagaagcagtctggggaggctggggcccagccaatggcagtgcaggtcccagctcctcctcctcccaggctgggccagcacacccggcaggctctgtcctggaaacaggcttcaacgggcttccccgaaaaccttccccgcttctggatatgaaattcragctgcttgctgagtcctattgccggctgctgggagccaggagagccctgaggagtagtcactcaggtaagggcatctgtgtccgcatgtgccctgccccttggcatacgtggcaggaggacacttctctgctggggagtggtgggatgtggcctggacacatctgccaccctgggtcctgatggtggaggaataaggggctctgggttctttcaggtctccccagccgggcaaaggtaggagcaggggccaggccggaagctcagcaggcagggtagctctgcctgggcctgcaaagcc

SEQ ID NO: 32256 - DNA, 601 bp, Human
gacggccgagcgtgtgtggagtgatgaccacaaggacttcgactgcaatactcgccagcccggctgctccaacgtctgctttgatgagttcttccctgtgtcccatgtgcgcctctgggccctgcagcttatcctggtgacatgcccctcactgctcgtggtcatgcacgtggcctaccgggaggttcaggagaagaggcaccgagaagcccatggggagaacagtgggcgcctctacctgaaccccggcaagaagcggggtgggctctggtggacatatgtctgcagcctagtgttcaargcgagcgtggacatcgcctttctctatgtgttccactcattctaccccaaatatatcctccctcctgtggtcaagtgccacgcagatccatgtcccaatatagtggactgcttcatctccaagccctcagagaagaacattttcaccctcttcatggtggccacagctgccatctgcatcctgctcaacctcgtggagctcatctacctggtgagcaagagatgccacgagtgcctggcagcaaggaaagctcaagccatgtgcacaggtcatcacccccacggtaccacctcttcctgc

SEQ ID NO: 32257 - DNA, 601 bp, Human
tggcagcaaggaaagctcaagccatgtgcacaggtcatcacccccacggtaccacctcttcctgcaaacaagacgacctcctttcgggtgacctcatctttctgggctcagacagtcatcctcctctcttaccagaccgcccccgagaccatgtgaagaaaaccatcttgtgaggggctgcctggactggtctggcaggttgggcctggatggggaggctctagcatctctcataggtgcaacctgagagtgggggagctaagccatgaggtaggggcaggcaagagagaggattcagacrctctgggagccagttcctagtcctcaactccagccacctgccccagctcgacggcactgggccagttccccctctgctctgcagctcggtttccttttctagaatggaaatagtgagggccaatgcccagggttggagggaggagggcgttcatagaagaacacacatgcgggcaccttcatcgtgtgtggcccactgtcagaacttaataaaagtcaactcatttgctggttccaggtgccctctggttgtgcggccttcgtgaccctcacacgttcatggtgtcaatctctctgcccc

SEQ ID NO: 32258 - DNA, 601 bp, Human
tgcatccatcttgtttgggctccccacccttggtgagtgtgcccaaggggatgggagggtgggtatgcaggccctgtcttacgggtacctgggccctgttctgacctctctcctctccttccatctccagagaagtgcctcagataataccctggtggccatggacttctctggccatgctgggcgtgtcattgagaacccccgggaggctctgagtgtggccctggaggaggcccaggcctggagggtgaggcctgctgtgtgtgtgtgtgtttgtgctggggacccactctctgggtgkgatccctgaaataggagggaggaagagagggcggggggaggcccctggctgggaagaagtgctctaccttcctgaggtgctgggtaatgcccccaagcacgccccgactctcccgtatctcccactgctccacagaagaagacaaaccaccgcctcagcctgcccatgccagcctccggcacgagcctcagtgcaggtgggtgacggccccgagtcctggggcgggggctgcctcaacttctctttgtattcccagtggggagtagatggtataggggtcccctccccaaagtgaccgcc

SEQ ID NO: 32259 - DNA, 601 bp, Human
aagtgcctcagataataccctggtggccatggacttctctggccatgctgggcgtgtcattgagaacccccgggaggctctgagtgtggccctggaggaggcccaggcctggagggtgaggcctgctgtgtgtgtgtgtgtttgtgctggggacccactctctgggtgggatccctgaaataggagggaggaagagagggcggggggaggcccctggctgggaagaagtgctctaccttcctgaggtgctgggtaatgcccccaagcacgccccgactctcccgtatctcccactgctccrcagaagaagacaaaccaccgcctcagcctgcccatgccagcctccggcacgagcctcagtgcaggtgggtgacggccccgagtcctggggcgggggctgcctcaacttctctttgtattcccagtggggagtagatggtataggggtcccctccccaaagtgaccgcccatgtccttccccaccacagccatccaccgcacccaactctggttccacgggcgcatttcccgtgaggagagccagcggcttattggacagcagggcttggtagacgggtaaggggcagggccgggcaacag

SEQ ID NO: 32260 - DNA, 601 bp, Human
aggagggagcttcccaagcctcgggcccctccctgaacttccaccccctttactgtaccccagagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacagrggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacacct

SEQ ID NO: 32261 - DNA, 601 bp, Human
aagcctcgggcccctccctgaacttccaccccctttactgtaccccagagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggarcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacacctatgagttctgtctgg

SEQ ID NO: 32262 - DNA, 601 bp, Human
tcttcagtctgttggaaatttttaaacttccaacttttctatcgaaactggcttaaaaattttaaaacaattataaggatgtcttccttctccctggcctgttggaggaccttcatccttcaccaaaacgcgccagtgtaacgtaccttgttcagctcttggtcataaagtcgtcctcagcctgtctgtgtggtcccggagggtcggtggcgggcagtttccaaaattgaggtaataagagatcagatgaatttgagacgaccggccaaaaaaaataagaaatttaaaaacaacatttaaraaggataggggagtcttaaatgtttgattcttccccactttaaaaaataatttcactaatattctctttatgtttccgttgcacttcagtctaattcttaaaaaaattatgctttaaaaataaattaacttttcttttttcttttcttttctttttttttttttttttttttgggcttcagtctttctgcccccgataacagaaaatctctttttcgtcttaaaaaaaaaaaaaaaaaaaaaaaagcctgtggaagactcagcagaacccaggaagcgcagaattgggagaaaagtcttt

SEQ ID NO: 32263 - DNA, 601 bp, Human
gaccttcatccttcaccaaaacgcgccagtgtaacgtaccttgttcagctcttggtcataaagtcgtcctcagcctgtctgtgtggtcccggagggtcggtggcgggcagtttccaaaattgaggtaataagagatcagatgaatttgagacgaccggccaaaaaaaataagaaatttaaaaacaacatttaaaaaggataggggagtcttaaatgtttgattcttccccactttaaaaaataatttcactaatattctctttatgtttccgttgcacttcagtctaattcttaaaaaaawtatgctttaaaaataaattaacttttcttttttcttttcttttctttttttttttttttttttttgggcttcagtctttctgcccccgataacagaaaatctctttttcgtcttaaaaaaaaaaaaaaaaaaaaaaaagcctgtggaagactcagcagaacccaggaagcgcagaattgggagaaaagtctttggctggggctgtttcaagtctctggttcaatgggctgctcgaagccaggactgggtaattctttccagacgtcttgacttctccttccccgccgttgttgcccttct

SEQ ID NO: 32264 - DNA, 601 bp, Human
tcgaaggaggctgctgcggggcagggacgtggagtgatctccaagatacggcggatgagaaaggccaggtgtggcactgcgtgcgccaggctgccactgtttgtttttaaagggacctatggctaatgctcagatatgaagagcccctgcagggtggacaggaaaccacccacatggctgcctctgagaagcagaaccggagaaccgggaggagggaaggaggccctgcaccgtagaggcttttgcacttttggatgttgggccatttggatggagagctcattcaaaaaactcagaggcrgaacattgcttcagagagctctgcccactggatccttccagtggattccaaagggagccgggggcccagcttgctccccgcacaccccacacagctcttaggctgagaagggccagcctcctgcagcctcccacaggccactcggagcccgaggaggccatacccaggttgagacaagccagcgtgttggtacacttccactccttctcgtgtgtggccactttgacgtcatccatgacgagaggcacccagccaccaaacacgtacattctgggagtgaggagggaagagtgggaaagg

SEQ ID NO: 32265 - DNA, 601 bp, Human
gtgcgggggcagcctggggcaggagcgtgatgcctacttgggtcagcggctgcacagcaggtgcggctgctgctggggcagggctcttgggagggttggcaggcacagatgggaccggattgggtgtaggggaggtggcagtagcagccgtggcaggaatgtcatatttctggagctggagaaggtagctgtcggctgttgccactgccccccagctcacctccagggagttggtgttggcgcgtaccagttgtactcgggctgggggtggtggcttttctgtgggagaacgcagttggtsagaaggggcgggaggctatgggaggaggggagtcggctgggccgggcctacctgtctctaggtaccagaggtccttgcagcagacctggttgttccaggccttgcggtagccgtcacgcccactccaaatgtacaggcgggtgttgatggcgactgcgcagtggccagcccgagcacgggggatgttgtcctccagtgtatccatcaggatggtctcccaggccatggtatctgggggagggcagacaagggaggtcagcaaggaggatggaggaaacccgccacccctggttgcccttg

SEQ ID NO: 32266 - DNA, 601 bp, Human
cttgatggccacccccgtggggggctgtgtgcgcgccaaaggaagcagggagacgccgcacatgggaaaaaatctcagatggtgacagttcctcctgctgcacccggcttcctgggccttccctgtgcctgaagagctccacgaaggacactcaccctgcagccacctcacttgtgtggccgggccatagcccttctcattgcgggcggcgatgcggaagatgatggcgggcttggtggtgtagtcgatgtgggcgttggaaaggctggaggactgcaccaggcaggaggggctgggcccrcagtacacccgcatgaaggccagctgggccggggtggagctcttgagctcgcccccagcctgtgagctctggatggccaggtacacggagtactcgataatcttgccggaggtcacagagggtggctcccaggtgaggtgagcaccatccggactctagaagccagggggtcagaaggtcaacagaacaggctagaggcttccagaactgactaatcatggttcccataagccattttctaacacagtagagatattccatgtggtagttcaaggagcttcaaagagatcttcccccaag

SEQ ID NO: 32267 - DNA, 601 bp, Human
agagggcaggggccagcaacaggaagttgggctgggtggcaaacagcaggcccctcgtggcagatttcacacctctcctgccctggctggccccagcttttcctccagaaagatccctgccaagaattagccaagaagaaaaaagtaaaaaaacaaaaacaaaacaaaacaaaacaaaaaaaagagaaaagaaaaaagattacacattctgtacacagctaacaacaacaaaaaagggacaaaaccccacacgctaaaattacaatgaaagtgtgaacttcaccaattgcaacctaaaaarcacaacaaatgcagcagttggcagtgcggcctgcagggaggtctgcacaggcgctgcccaggccgccgcggggctccttgccccttttttctttttccttcttttcttttttaaaatgggaaagaagagggggagggtagaagaggtgggagcacaaaggcctctgagaaaatgtgtaagcttcctgtggggtcactgagcagggtgggccgggggagcctgaggaagggaagttaggtgactggaaacacaaggggaagaaaagaaaacagaaccagacacccaggccagggtgccagg

SEQ ID NO: 32268 - DNA, 601 bp, Human
gagtgagcagtggggagaggggcaggtggtgacattggagaggcaaagggggctcatatagggcctgggcagaggaatttggatttcattcccagtgcggggtggtgccactggtaggctgtgaggtggggagtaggatggtgcagggacttcctgaaagtcagagagaggatggatggggagaggaggcagctggaagacaggaacagggagatggccagagacagccccccaggcacagggacctgaggcagaaagacagtcagagagggagactgaggcctagacataggaccagccrgccaccacgggggcagggagagacagcgtctgacagagcagacaggcagttaaggaaagacagtggggtccaggtgcagtggctcatgcctgtaaacccagtactttgggaggccaaggtgggtggatcacttgaggtcaggagtttgagaccagcctggccaacatggtgaaaccccatctctactaaacaaaatacaaaaaaaaaaaaaaaaaaaaatacaatggggacacaggattagaggaaatggagccataggaggccaaggcaagggattggcgggttcttctgttcactctg

SEQ ID NO: 32269 - DNA, 601 bp, Human
atcatgacaaggaatgacgaatggtttggaaaaaaaaaaaggcagtaggtggagagggcaccagtgatgactaggggtcaggctacttagcgggtctcggaggagagatctgactgaagcgaggggagggtgttccctgcacagggaacagagagcatgaaggcttaaaggtgagctcataggaggctgaggcaggagaatcgcttgaacccaggaggcagaggttgcagtgagtggagatcacaccactgcactccagcctgggcgacagagcgagactctgtctctaaaaaaaaaaaaaggtgagctcatgcttggtgcttgacctgggtagcgacagtcagggggccagtgtggctggagcagagtgagcagtggggagaggggcaggtggtgacattggagaggcaaagggggctcatatagggcctgggcagaggaatttggatttcattcccagtgcggggtggtgccactggtaggctgtgaggtggggagtaggatggtgcagggacttcctgaaagtcagagagaggatggatggggagaggaggcagctggaagacaggaacagggagatggccagagacagccccccagg

SEQ ID NO: 32270 - DNA, 601 bp, Human
gctgtgtcacccaggctggagtacagaggctcagtcttggctcactgcaacctctgctacccaggttcaagcggttctcatgcttcagcctctctggtagctgggactacaggtgtactccaccataccctgctaatttatttttttgtagagaaggggttttgccatattggccaggctggtctcgaactcctgacctcaagtgatctgcccaccttggcctcccaaagtgctgggattacaggtgtgcaccaccacacctggctaatatttttgtacttttactagagacagggtttcrtcatgttgaccaggctgatcttgaacccctgacctcaagtgatctgcccacctcagcctcccaaagtgctgggattgcaggtctgaaccaccatgcccagcatcttccctgggacttttgctgtgctaggctgtccctcctgcccaccctggctgggcatgtgacgggagtgaatcactcacctgctatgggctccgacatcttctgggacttgcgcccacttaactccaggaaggagttgagccatgaggaggcacccaggcggaagtctcggaggagcagggctgtgtcccgccgcac

SEQ ID NO: 32271 - DNA, 601 bp, Human
gtggcttgaagggaggctctgttcacagggagctaacaagtctccagggtgtatcacatttctaggggtctggcacctgtagccacatggatctgcttccccacatttcctttgtgttcttcagttttatccgttcacgtgaccaggcaagcaagtgcccaaacgatgctaaagatacacttccagcccacctggcgtgcccagcttggcctcagctctgttcattttatcagacccacactgcctaccatgagggccaagatgctacagttttagttttttactttttttttttttttttgagatggagtcttgctctgttgcccaggctggagtgcagtggtgcgatctcggctcactgtaacctctgcctcccgggttcaagcaattctcccgccacagcctcctgagtagctgggattacaggcatgccaccatgtccagctactttttgtattttttttttttttgagacagtctcactctgttacccaggcttgagtgcagtggcgtgatctcggctcactgcaacctcgtctcttgggttcaagtgattctcctgcctcagcctcctgagtagctgggattacagatgcatgcc

SEQ ID NO: 32272 - DNA, 601 bp, Human
cattgttctcccctggggacacgcctgtccctttctccccactccggagctctttttcccaggtgtacccgtgcccggtccccctcctccccgggtgccctgctcttctctaaatgcacctgtaccggccccctctgtcgctcaccacgatgtgcacaggtggcaggctcttgagcatgctgtcgggtgccagcagcggcgacatgaaggggttcttgactatgggtgaggagtagaggggcatctgtgtggcaccctggctggagcgtcgggggtggaaaccctcggggaaggcggcackgacgcccaggcctctgtccatggggctcagctcatttttggcctcagcctcttcccctgcatcctcaggtggtaataagaagttgacatcggagggtgtggaggggctaagtgtctcagctgacagcgacatctcgggggtgtccgacgacgtctcggagtttcccctcaggctcaagtccctcagggtcaggttcttgagggaatccgtgcccagtgggccctggggctgggccagtgctgcttcagacacactgcggcgcatcggctctgagagagggagagcagataggcctggctc

SEQ ID NO: 32273 - DNA, 601 bp, Human
cagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggtaggaaccgcggctgcgcggccagcctgcgccagcgccagcgccgcgcgcccccgacacttgggctcgtgcccaggcgccctctccgccgcgctccctggtggccgctcgctagagcacgcgcgccgcagacctagggtatttgcggatcagcgtcctcgcccatctcatcctccacactccgcccccacccacctgccccagctgctaagggtcttgacctttttcagaaacgtgcatcttttccagttctaattttgcacgcttgcacgtttaaagcaggagggatgaattcggtagtggataaatcagcaactttaggatagcttatgcagaaacgcgtgtattctctacttttccggcagtgatcggaagagctctcaaaattggcttcagcccaaagggctcagatgggaatggccaggtcagccat

SEQ ID NO: 32274 - DNA, 601 bp, Human
aggttataggtctattaactgaagtgaccttgctgttgactaagcgcaaaggacaaaatcgttgattaaaatttttctgctaccaataaggtagttataatataacgagaataaattgcatttacagagctatctctcttttcaggaaagctgaataactacattaaatagacactttatgataaaaattatcaacaaatttataactcgatacacctgaaaatctaaacgtttaagaaagtgactactctcagaaaggctgtttggctttggagtttgggggcgttttgtttatggcttyttgtttttttgtttttgtttttgttttttgctatttggccactaacaagtttttcagcatattcatgttgtacctaatggatctctactgcagggccaagacttagtagctgggtgtggttagtggactattgggcaaggttagtcattgtagggggcaactgtctggcagtccaggagaatctttctctgtcactgagtataatgtaatatgccagtaagtgatagcaggtattatagtgaattcatagaatattctacttatgtaattctatttattcaaaggtagctaccacaatac

SEQ ID NO: 32275 - DNA, 601 bp, Human
ttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaaygaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatagtcaattgctgagtcttatgtcatttctctttttctaatttttatttatttatttttatttagagatggggtcttgctatgtggcctcaagcagtcctcccacctcagccacccaaa

SEQ ID NO: 32276 - DNA, 601 bp, Human
tgatgaggtcttccttcctcttggggtctgttctcccactccccctgcttaggccctgctgagtccctggtagggatggatctggccaaggaagatatcaaagcatgagggtctttgtaggtcatccatgttgaccatgctgtgaaacacctcccagtggaaaatggggagttgccctccttcccaacctgggccttggtcaggcctgtggctgctgggctggtcctctctgcctgcgatcctcaagctggagaacacctaggggatgtggctaaactcacccacacacagagcctccagstgcttgggtctctgcctccaagttagagcataaaggtggacaacagcatttatagcatgtgggctgccaggcttcttccccacccctgagagctctaccacaaaacctgttctccaagcaggaaataggcatagtgtttacacagcacatttccctgcagaacactcaggctggaggaatacttaggacccttgaggggagcacagaacctggtaaagaaaaataccaggtctgtaagaagagaaatgcctcactggctaaggtcacccactctgcactcagggagctccactgggttcc

SEQ ID NO: 32277 - DNA, 601 bp, Human
ctccagtgcagtctcctttctttcagtgcctcactatgttaccctgggaaactggcttcacctctctgatttcagctgaatcttccatgctctgcagaaaacctgccctgtccctcccaggctgttaggaggaaggatgaggtcactcactcactgactcactccatctgtccctcatatgcccagttaccttcttttcaggctccaagaaatcagcgacctgagaatgaaaagagatgaatagggcccacagcctggacccttcaaggtgatcatcggggggtgatgaccctctcacagycagtgatgaggtcttccttcctcttggggtctgttctcccactccccctgcttaggccctgctgagtccctggtagggatggatctggccaaggaagatatcaaagcatgagggtctttgtaggtcatccatgttgaccatgctgtgaaacacctcccagtggaaaatggggagttgccctccttcccaacctgggccttggtcaggcctgtggctgctgggctggtcctctctgcctgcgatcctcaagctggagaacacctaggggatgtggctaaactcacccacacacagagcctc

SEQ ID NO: 32278 - DNA, 601 bp, Human
ctgggatggtttgcaaggggagtgtcaaggctggtcagtgattatggggaagagtcagggcccatcaggggaatgaagtggctaagggtgcctccagctctaatagccacaagtgaattctgttgaaagggagttctagcatctcacagaccaagtggatcctggggatggaaactgaaggccagacaggatcctccctgtcccatggcctaaatgcctctcagaactcacagatggtcagtcgggagtacaggcagttcctgtcattccactgcccatctgtgtacatctccacacactkctcttttccccgacctgcaggctcccctcggtaccagttggtgtagtttacaggggtcccatctgagtagcggaagtctccagggctgggaccctcagtcaggcctacataggcatatgtgttgtacttcttcacgaagcttgcaatggcctcattttcctctggattccttgggacagcaatgcggccgcctgctctggcacatgcctcctgaatggcatcaaaagtgatggactgcccattgctggagaagaccttctctcctactgtcattatggagccctgcagactgagggctga

SEQ ID NO: 32279 - DNA, 601 bp, Human
ggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctrctgatggccggctcagtcagtgctatgtttggtaagttctttttatgttttgtcctcttcgtggtgggtgagcaaatttgtatcatgggtggttccatttttgtgcataacctttccgattaacctttctgaatgtgccacttacataatggaattttgatatttacttaataaaactttactatgtttcaggttctgctgtgtggcaactcgtggcttcgtttttgaagctccctatttctggaacccattgtattgttggtgcaactattggtttctccctcgtggcaaaggggcagg

SEQ ID NO: 32280 - DNA, 601 bp, Human
gaaactgggagcaaaaaaataaggaaatttattttgcgtggttttgtgtagctgtatacacattatttgtttaaaccactgttatattcaggctaatataatacgtaaacttggagttcaagacagtgtcccctgtggcttttttaactaagctgccagttaaatgggtctctgccgtgctgattatcataaccagtttataagcttctagatgaggactctgcctcccatagtgacttgactccaatttctcagaatagttgaaaagaaccagttaaaggtagtttttggcccgcccccmaaaaaaacttcaggcagccatttaatttcctgtccatttgaaaatcccttttaagtgacccagtttgcatttcttttatcaagaagtcttgctggctgcaaaataaatgttgacaagggattatgttggcataggactgagttacagtgaggataaatgcatttttctcaggaaacaaagttgtcctttttctaaggtgaatggctcttaacaatccattgtaagttcttaaaagtgttcctaaactgtagaaatctgagggagatagcataaatcccagcaggtaagaatgtattcaga

SEQ ID NO: 32281 - DNA, 601 bp, Human
caggtacgataagcatctaccttcccactccctacaactgtagtgtatgatactgggatgcttaaattagaggctcaccagtagtcatggaccagatttttttgttttttttagagttttcattagaactgtatatcttgctacttagcagagagtcagaagcattagtaggatctcctgttgtgaattcctgcttggtaaaggtttatgctggccctgtgttgattattgagtagcagatcattttgtttttggagagggtttgtgtgtttcacctccacaaaacacttattccccggarggggaatggtggtgctctgaggtgcaaagagggattctcaggtgcccagaacctctcatttgaggaatgcatacccccacggtgttattgagggctgaagttagatacggtaactgatttcttaattgtatatttcctatatgggtatgggaatgggcatgatcaaatgatgaagaatgattggcatagtgtttaaaacaatattgactttgaggatcttcccccactctgtgcacgtgcacacacacactcttgcaggccaatccctcagtaacaggagttttcagttgagtatgaata

SEQ ID NO: 32282 - DNA, 601 bp, Human
ctaaggtctttataaagtttttagccttcccatatatgtattcagatctttgctcccaatttttttttttttctgagatggagtcttactctgttgcccaggctggagtgaggtggcccagtctccactgactgcaacctctgtctcccaggttcaagtgattctcctgagtcagcctccagagtagctgggactacagatgcttgccaccacatccgggctaatttttttggtatttttagtagagacagggtttcaccgtattacccaggatggtctcgatctcctgacctcatgattstcctgcctcggcctcccaaagtgctgggattacaggtgtgagccaccgcgcccagcctcctcccattctttcggtgtttgacttgggtgttctcctatagaattaatacatactaggtatggtagaattcttatttttagtcactggccttactgttccttaaacatttcaagtttttgccttagggcctttgcatttgctgatatctctgtctggaacattcagcgcccaaataatcaggtggtttgccccttctgtacccatagttaatgtacacagcttgctagcttactacattta

SEQ ID NO: 32283 - DNA, 601 bp, Human
ttttatctcctagtgctgggctttgacaaacttcctctgtggggtaccatcctcatctcggtgggatgtgcagttttctgtgcccttatcgtctggttctttgtatgtcccaggatgaagagaaaaattgaacgtaagtaataactaaacagcagaaaagtttaactactaatgttgtgtttattttttatttggccacctgtaaaaatctattagaagagattggcaaaataagagattttaaagggaaatttgaggatatgggtttgttgtccaaactgtttttagaaatggacttacrtgacctaagacctgttcttaaaaatggacttacatgacctaagacctagtgataaagagtattcaacctatgctgtagagacaatctggggcattgaatttttttatgttccttgatcagttgccagtgacatgatagataaatagagaaatcatagcctacatttactgagaagtagaaggataccttaatgaaaaataaggggtagatacaagatattttcgtagaggaaatatttaccccaactgcttctgtgtataacttcagattcagacaagcaaagctaagtctaatgtgtac

SEQ ID NO: 32284 - DNA, 601 bp, Human
gtttattttttatttggccacctgtaaaaatctattagaagagattggcaaaataagagattttaaagggaaatttgaggatatgggtttgttgtccaaactgtttttagaaatggacttacatgacctaagacctgttcttaaaaatggacttacatgacctaagacctagtgataaagagtattcaacctatgctgtagagacaatctggggcattgaatttttttatgttccttgatcagttgccagtgacatgatagataaatagagaaatcatagcctacatttactgagaagtasaaggataccttaatgaaaaataaggggtagatacaagatattttcgtagaggaaatatttaccccaactgcttctgtgtataacttcagattcagacaagcaaagctaagtctaatgtgtacatgttgtatataggctagaatacatgtagacattgtattgcagtatacaatgcaaatacatatacaaacacacattgtgtgtctgctagaattgtagcacagattctagaagtaaacattttcaagtgtcaaggaatcatttaggccattaccacacactcatgtaattaaatactga

SEQ ID NO: 32285 - DNA, 601 bp, Human
tcagattcagacaagcaaagctaagtctaatgtgtacatgttgtatataggctagaatacatgtagacattgtattgcagtatacaatgcaaatacatatacaaacacacattgtgtgtctgctagaattgtagcacagattctagaagtaaacattttcaagtgtcaaggaatcatttaggccattaccacacactcatgtaattaaatactgagtaaattttggttagtatcggacttttttttccttaaaataatcattttctgcccttttcatcgatgtgaaggctgggttagcaakttgaagtttatcgtttcgaagctgagggatgcatagactgcagtggtgttaggaagaacgctgcgtcaccgcagctgaaccgaagagcctccgagaggttctgtgctagtctggctgtgccgagtgcacggtgggaaccaggctttcaggactctctggcctcattttccctctctgggaggagttgagacaagtcttgctttatgttagtcagtctgtagtttgactgaggtgcctggatggataggtcagcatactgagcactggcatgagagaggcagaagatactctggtctgcct

SEQ ID NO: 32286 - DNA, 601 bp, Human
ctagtctggctgtgccgagtgcacggtgggaaccaggctttcaggactctctggcctcattttccctctctgggaggagttgagacaagtcttgctttatgttagtcagtctgtagtttgactgaggtgcctggatggataggtcagcatactgagcactggcatgagagaggcagaagatactctggtctgcctgtgggatttacagccatgatgcacatctctttgttttatagaggtggaaattaaagttgtcgtctttagttccctgcattgagctgtgccactttgcttgaattgktggactgaaatttgagagaatcctcttttgaaaagaatagaattgggtacagttcagatttttagtttcagcttatcagccccatggttgagctactttcccctacagaatgagtcagcagggagctaagaagggttcttatatctgtaaagggttgtaaaaataaaaacaaaacaacaatgtgctacagaagcccgtaaaacctaaaatatttacagaaaaattttgggacccctgacatagggtgttctgcattgctggttgttcccaagtgagagttgctggcaaatgataaagcag

SEQ ID NO: 32287 - DNA, 601 bp, Human
tctctcctcttccagttcctgcagatccttacagcctgctttgggtcattcgcccatggtggcaatgacgtaaggtcagttgacattgatcttagtgttgctaaccctatttttaaaccatttatccttgtcacaggcctgtgcttgtggtagtggtactcctagcatttacaggaccccaaataatacaaataggatgaggtaatagcagttattgacataataagacagtacagttttattcttcagaggaattacaaagaatgtttatttttgtagatgataaatataaacagatacwcttcacagagaaggcttttgtccatcaagatgagattcagttctttggtagtgaattgtgggatgtaagatgtaagatgaaaaacttaaaagtttttcatatagaatgattttgtagtttggtttgtaaactgtttattggaacctgagagttgctttaagctgcctataggaggaaagaggccaccatttgcctggcattccctccatcagagctgtgttcatttttctgttgtgtatgttggggttccatttatgtctttagaaagaaaggcccttttgccagatgagcttgaaagct

SEQ ID NO: 32288 - DNA, 601 bp, Human
cctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctaggtaagtaggtggagcaggttctacaaatgtcagtactcatttttttcagagatataacactgtcgagtgctaacacaaatctctaaagtaaccaagtttgtataagttcatgatgttcttattgtcagtgttctttttagattttacttgtctggcccttaaacattttggtcagacattttacccatttagctctggtggtctctgaagaaaatgacttttctgagaaagctgtgtatgctaagagcggatagttatgtatacttgccttttatttgtcttgggagctaagactcaatgtttaccaaactcttcaaaataaaagtgcaaattttatttaatagtgggattccagaaaaacgtaaaactggaagcctttgaataaggaaactgggcatctgtggcctgatttaaataaagtagatctt

SEQ ID NO: 32289 - DNA, 601 bp, Human
ctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctaggtaagtaggtggagcaggttctacaaatgtcagtactcatttttttcagagatataacactgtcgagtgctaacacaaatctctaaagtaaccaagtttgtataagttcatgatgttcttattgtcatggttctttttagattttacttgtctggcccttaaacattttggtcagacattttacccatttagctctggtggtctctgaagaaaatgacttttctgagaaagctgtgtatgctaagagcggatagttatgtatacttgccttttatttgtcttgggagctaagactcaatgtttaccaaactcttcaaaataaaagtgcaaattttatttaatagtgggattccagaaaaacgtaaaactggaagcctttgaataaggaaactgggcatctgtggcctgatttaaataaagtagatctta

SEQ ID NO: 32290 - DNA, 601 bp, Human
gacaccgatcacaccctctaggtaagtaggtggagcaggttctacaaatgtcagtactcatttttttcagagatataacactgtcgagtgctaacacaaatctctaaagtaaccaagtttgtataagttcatgatgttcttattgtcattgttctttttagattttacttgtctggcccttaaacattttggtcagacattttacccatttagctctggtggtctctgaagaaaatgacttttctgagaaagctgtgtatgctaagagcggatagttatgtatacttgccttttatttgttttgggagctaagactcaatgtttaccaaactcttcaaaataaaagtgcaaattttatttaatagtgggattccagaaaaacgtaaaactggaagcctttgaataaggaaactgggcatctgtggcctgatttaaataaagtagatcttaggggttatagcaaataaagatgtcagtggaggttttgtgactgagtagaacaaagcaggactgtgttaacttgaggtgtagtgttagcttctcaaaaaagtcaaactcacttcctgacaagaatccttttgtgtctgtagtggcttcagta

SEQ ID NO: 32291 - DNA, 601 bp, Human
ttcttatttaagcaattaaatagatattctccccaaataatagaaacattgttttatatacagcttactgtagtttctggctactaacctcttcctttgttactttatcctccctcattgtagtctctttataataattttttttttaatctcaagagtcatttctacttggcaccattatgttttatttatttatgtatgagttggagtcttgctgtgtcacctgggctggagttcagtggcacaatctcggctcattgcaacctccgcctcctgggctcaagtgattcttgtgcttcakcctctcaagtagctgggattataggcacccgccaccatgcctggctaatttttgtatttttagtagacacaggatttcaccatgttggccaagctggtcatgaactcctaacctcaggtgatccacctggctcggcctcccaaagtgctaggattacatgcgtgagccaccgcgcccggccgacagcattatgttctttgcctttggggaagccattcagagcagggtaggtgtatgcttagaaactggcaggtgctttaattctggccaggtgggtttctgctgccatttgtggtggct

SEQ ID NO: 32292 - DNA, 601 bp, Human
gatcctgctgagtcatctgtttgctacccggatgtgtctccagacaattgtttattaggtttaatatcagccactctgtaaataatcttaggaagacttacaatgcaatttgttattaaaagcagtgtataggccaggtgcagtggctcatgcctgtaatcccagcactttgggaggccaaggcaggtggatcacaaggtcaggagtttgagaccagcctggccaacatagtgaaaccccatctctactaaaaatacaaaaaattagctaggcgtggtggtgggtgcctgtaatcccagctcttgggaggctgaggcaggagaatcacatgaaaccaggaggtggaggttgcagtgagccaagattgcgccactgtactccagcctgggcgacagtgcgagactccgtctcaaaaaataaataaataaaagcagtatatattcattaaattttagcagtagctgagaaggggaaaagaaatagttcttgtgtccttttactaccgttagtatagattatgattggattttcaaattgccttcattttcccagcttaacctgttgtaaaccagctttcttggactttgtcttgtccaggggt

SEQ ID NO: 32293 - DNA, 601 bp, Human
ttaatatcagccactctgtaaataatcttaggaagacttacaatgcaatttgttattaaaagcagtgtataggccaggtgcagtggctcatgcctgtaatcccagcactttgggaggccaaggcaggtggatcacaaggtcaggagtttgagaccagcctggccaacatagtgaaaccccatctctactaaaaatacaaaaaattagctaggcgtggtggtgggtgcctgtaatcccagcacttgggaggctgaggcaggagaatcacatgaaaccaggaggtggaggttgcagtgagccragattgcgccactgtactccagcctgggcgacagtgcgagactccgtctcaaaaaataaataaataaaagcagtatatattcattaaattttagcagtagctgagaaggggaaaagaaatagttcttgtgtccttttactaccgttagtatagattatgattggattttcaaattgccttcattttcccagcttaacctgttgtaaaccagctttcttggactttgtcttgtccaggggtctggggctccttgtccaaacagtctcaggtgtctgtttgccagaataccactggcacttc

SEQ ID NO: 32294 - DNA, 601 bp, Human
tctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttagaaaatttgttctcatggttttctttcatactcgaatcacctgggctcctgatcagttagcctaatatcattcttaggtgatgtgaatatcttaacaagtgagagctactgtccaacttaaagctcccaacccctccctgtatgcttcttgtgtgcccagaatatgcaagacattactccatag

SEQ ID NO: 32295 - DNA, 601 bp, Human
acaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaartgggacagccttccatgttcatttgtctacctcttaactgaataaaaaagcctacagtttttagaaaatttgttctcatggttttctttcatactcgaatcacctgggctcctgatcagttagcctaatatcattcttaggtgatgtgaatatcttaacaagtgagagctactgtccaacttaaagctcccaacccctccctgtatgcttcttgtgtgcccagaatatgcaagacattactccatagggactgtggtggcaacttggcattttcccttttagtagcacagcctgtacact

SEQ ID NO: 32296 - DNA, 601 bp, Human
gtggccaaaagttttcttttttttttttttctttttgaaacagtcttactctgtctcccaggctgctggagtgcagtggcacaatctcggcccgctgcagcctctgcctcttgggttcaagtgattcttccacctcagcctcccaggtagctgggattacaggcacccaccaccacgcctggctaatttttgtatttttaatagagacggggtttcaccatgttggccaggctggtctcgaactcctgacctcaagtgatccacccacctcggcctcccaaagtgctaggattacaggccygtgcccagccctaaagttttaaactctaggggaattaacagtatttctttacagaatggatttgttaaactagcacagtaaaagtaaagactattctgtttctaggctgttgaatcaaagtgattttagcaattaaactttgtattaatttaccaccaatatttcttcacaaaggaacttttaaaagattatctcagaaagtaaatctgagaggtaagaagtaataatgagtaaatggtaagtacttgagtaaatctaaagaaatattgatagtaaggcaatcctaagcaaaaagaacaa

SEQ ID NO: 32297 - DNA, 601 bp, Human
aggcccttctcactagcaagaaaaggccctgccacctcctcacctcaacctaactttctcagtggctgggcccagggctccctaaccttgctgttggctgaaagccttgggtgagaagcagcctgtgctgccagcgagtcctcctcttgtgccttcctcttgcaatgggggcagagatcagactggaagccccagtaaaggtacgggagccagcgtggcccagcccccatggggcagcttggagcctcctggctgggtagcaaaggccccgggctgagccaccgtgctgtccttcccttgmtaaaacagctccaccccccaaccccctaaacagctgccaagtgaagcccatttccccactgacctcaattataaaaccagatatgcttcccttggggggacaagctctggcggactgagccgaaaaacactgtcctcattttggatgagcaaaagttaaagctgtgagctaacgggcctcctgcatgaaccctgcccgcctctgctagggctgcggccaccagttctcctcccactacccccaaggcagactctccggaacacacaaggcgtggggacaggaggagggaagctcttggct

SEQ ID NO: 32298 - DNA, 601 bp, Human
cctcagccaggagccacaggccccagtgacactggagacggggaaggtgggaacagaaaaaaagacatgtggaggggccaggccagggagctgaaactcagattctcatctcagaggtgtctccctcctcctgctcttccctcacactgggagttccgatcctgtggggtgggagcagggggcggttcctgctgggggcccactggctggtggcctgtgctccctcttgggagggaccaatgtgcgggtgctccctgggtagacctaccttttcctggtactggcgccgggaggagtccarggactggatgagggcagtggcgtggccaatgaacatggcgtagcaggtggcacccacgatcatgctgagcatggtgagccagacgtcggacatgcccacgggcgcctgccgcccgtagccgatgcacagcatgtggctcatggccttgaagagcgcgtaggagtactgcttcccccaggagttgttctgtggacagacggatgggtggggacagtggatgagagggaaggcccttctcactagcaagaaaaggccctgccacctcctcacctcaacctaactttctcagtggctgggccc

SEQ ID NO: 32299 - DNA, 601 bp, Human
ggacctccacacctgggtggcccccacctgtcagtcaccccaccaaaggacagtgcctgggacaggcaggcaggcagtgaatccataaatgctgaccctactgtgtgccaggcatggggcataaaacagaaaacgacatactgggtcctcccctcatggagccgtggcctggagagggaaggtgggtttgttaaacagatggctgcctatggttaattacatcatcacagagtgctgagtgtggtgaaggaggagagggtgccatggggtcacatgacaggtgaggggctggccaggtcayagacggcttctctaagtggtgaggctggacgtggagagggtgtcaggtggacacctggggaggagagttgagggtgaaagcccgtgtctgggtcccatggcaggagcaggcatggggagagaagtctggccaggctgaaataaagggtgcaaggcccagggcaggagctgagcatgagggcagatccctggttatgctcctcaaatgccaggctgggaaaacatgctgaggagttaatctacatcttcagagcaacgtgaagtccctgaagagtttcaagcagaggatgaggctgacgtg

SEQ ID NO: 32300 - DNA, 601 bp, Human
tgagctctccttgcctcccagctctgtaggctctcctgagctctcttcttggcatcatgggacctggacctccacacctgggtggcccccacctgtcagtcaccccaccaaaggacagtgcctgggacaggcaggcaggcagtgaatccataaatgctgaccctactgtgtgccaggcatggggcataaaacagaaaacgacatactgggtcctcccctcatggagccgtggcctggagagggaaggtgggtttgttaaacagatggctgcctatggttaattacatcatcacagagtgcygagtgtggtgaaggaggagagggtgccatggggtcacatgacaggtgaggggctggccaggtcatagacggcttctctaagtggtgaggctggacgtggagagggtgtcaggtggacacctggggaggagagttgagggtgaaagcccgtgtctgggtcccatggcaggagcaggcatggggagagaagtctggccaggctgaaataaagggtgcaaggcccagggcaggagctgagcatgagggcagatccctggttatgctcctcaaatgccaggctgggaaaacatgctgaggagtt

SEQ ID NO: 32301 - DNA, 601 bp, Human
cttccccacagtgagctctccttgcctcccagctctgtaggctctcctgagctctcttcttggcatcatgggacctggacctccacacctgggtggcccccacctgtcagtcaccccaccaaaggacagtgcctgggacaggcaggcaggcagtgaatccataaatgctgaccctactgtgtgccaggcatggggcataaaacagaaaacgacatactgggtcctcccctcatggagccgtggcctggagagggaaggtgggtttgttaaacagatggctgcctatggttaattacatcaycacagagtgctgagtgtggtgaaggaggagagggtgccatggggtcacatgacaggtgaggggctggccaggtcatagacggcttctctaagtggtgaggctggacgtggagagggtgtcaggtggacacctggggaggagagttgagggtgaaagcccgtgtctgggtcccatggcaggagcaggcatggggagagaagtctggccaggctgaaataaagggtgcaaggcccagggcaggagctgagcatgagggcagatccctggttatgctcctcaaatgccaggctgggaaaacat

SEQ ID NO: 32302 - DNA, 601 bp, Human
attgcaggcatgagccatcatgcccagcctcccagacgctttttctttttcttttttttttttttttgagatggagtctccctctgttgcccaggctggggtgcagtggtgcaatcttagctcactgcaacctccgcctcctaggttcaagtgattctcctgcctcagcctccctgagtagctgggactacaggtgtgcaccaccacgcccagctaattttttttttacttttagtagggatgaagtttcaccatgttggccaggctggtcatgaactcttgacctcaggtgatctgcccrccttggcctcccaaagtgctgggattacaggcgtgagccacagcgcccggccccagatgctttttctaaactaatccctgatcttgaccccagactaaaacctagccttgatcacacactgagccctgaccccactcacatgctgagccccaccccagtcacaggctgggcactggtgctggctccagaaggatccctcacctggctgagccccaccccagtcacaggctgggtcctggtgctggctccagaatgatccctcatctgggcccggactaagccctgacctttgtagctcga

SEQ ID NO: 32303 - DNA, 601 bp, Human
aatgacctcactgtgctcaaaacaactgcccgggctcccagctgcttggcatggaggaggggcccccaccagcatctgctcctcgctgtgttcaatactaaggaggtgggtgagggcggcagggaatgtccaaagcccagtgacaggacatcaactgtatctccagggaggtcgatcacatttccttggaatgttacactggggacagggaggcctcaccgactctgcggggaaagaagctgtttcctcccagcagtgacaactggcacagtcaggaggcaagggtgcgatggatcagaaygctcagaggcagaagcaaggatgcctggctgctcgatgctatgaatccaaacgtggcctcagctgagacctcgggtcatttcgttgagagcaactccaggtaagggaaaagcagggtagactaatttgaggggaccttcaaatagaggctcgggtacaaaagatttgtgagcctcagaccctggggctcaaacaaataagaaacgatcctgcccgccctcactgagaggagtggacattgctcccaccatcctagattgtgggtggacagtgggattcccaagagcaggatgagggatgg

SEQ ID NO: 32304 - DNA, 601 bp, Human
gaccccatctgcctttctctggcttttgcatttgggacctgcctgctccctcctccctccccctccctccctctagtgctgagtattaaaatagtctataaaagcaagtgaccaaaaatctatagctctaagaatacctggttattttctgctgtcttttgtttttctggtgtgtgtggttttttaaataattattactgttattggtatatctcctaatcacagttaaacctgaaggaagaaggaagggagagaaaagaagaaagaagagggaaggaagggcccagctcatagattggayggcagtttggagcgcactggctcaggcctggccccaggttccctctggggtccagcagtcagagggggccccccagaagaggtggctcttgccccaaacaaagacagagggggtggcaaagaacctgaggatgtcttccgaggcagagtgacgtgctggccggggatggcaccatagggcctcccagggggaccgaggcccccgctgctcccactgcccccgctgccacccccagccctggggaagagcgggaaggcagccatggactcccctgaggagtgcggggaggctctgcggaga

SEQ ID NO: 32305 - DNA, 601 bp, Human
agcctgcgggccaaggcgggttgctgggtgtaaggtgacctgggcatcctgtcaacatgggattaaactagaccgcacacgtgtgcgcacatgtgagtggctatctacatggctctacagagcgctacatagctatacatatacacatcttacatacatatacatatacatattcatatacagatcttgctacgtttacagtagaaaaaatgctaggccctcagggccctggcccttttctcccaaggtcgcaggcttctgaggctccccagggcacaccccagggcagcccctttctggkggcagagtggagctccaagttacagctaacgggctgatggcagctgtttctctaaatgaacacaatgacacatctgctctaagaaccgccaacactggccactcccacccctgcccagccccggagaccccatctgcctttctctggcttttgcatttgggacctgcctgctccctcctccctccccctccctccctctagtgctgagtattaaaatagtctataaaagcaagtgaccaaaaatctatagctctaagaatacctggttattttctgctgtcttttgtttttctggtgtgt

SEQ ID NO: 32306 - DNA, 601 bp, Human
aatgaggatcctgcactcttcctccctcaggttagttagctttcaaacttttacccttaatattctgcttttgagatgatgggaatgggtctgtttctgttagagagcagcttaatttgctgtttaggggcagagattgtgggagtggagaagagaatgcctgtgtcctgagataattctggtaagtgagaagggatgttgcattaagagccctggaactacagggaattaattcaagagaatgaaattttctaaaagtatagctgaacagagacagacagacagacacacacacatacayacacacacacacacacacacacacacacacagaggaagaaagagagagaggaagagacagaaactaaatgatatatttggattgtttttgtgaaatacattaatttttttaagcattgatcaaatccacagtgagacaataaatgccaatactgaattctcagagaggaagattttcatcatgcctaaaaaattaatgaaaaccaaacggttctggtttggttccagcgaatttatgggaaagcaaaataaatgaaatctaatatggctttgggaagtagttaatgatgaagagtttagg

SEQ ID NO: 32307 - DNA, 601 bp, Human
ttaattcaagagaatgaaattttctaaaagtatagctgaacagagacagacagacagacacacacacatacacacacacacacacacacacacacacacacacagaggaagaaagagagagaggaagagacagaaactaaatgatatatttggattgtttttgtgaaatacattaatttttttaagcattgatcaaatccacagtgagacaataaatgccaatactgaattctcagagaggaagattttcatcatgcctaaaaaattaatgaaaaccaaacggttctggtttggttccagygaatttatgggaaagcaaaataaatgaaatctaatatggctttgggaagtagttaatgatgaagagtttagggcagaggactttatttgcaaactgtgaataagagccatgggctgtttctcataaggaggaaaaatgttcagtgctgagaccacctaagatgacatttgagctgttaatagctctgcccagcaccttaaggaaaagtctcattctacagtggactgataactagcagaggaacagggtgcatatgaatccaaaaagaacagacacaagcagtcttggcaagaaaaactg

SEQ ID NO: 32308 - DNA, 601 bp, Human
aagagaatgaaattttctaaaagtatagctgaacagagacagacagacagacacacacacatacacacacacacacacacacacacacacacacacagaggaagaaagagagagaggaagagacagaaactaaatgatatatttggattgtttttgtgaaatacattaatttttttaagcattgatcaaatccacagtgagacaataaatgccaatactgaattctcagagaggaagattttcatcatgcctaaaaaattaatgaaaaccaaacggttctggtttggttccagcgaatttrtgggaaagcaaaataaatgaaatctaatatggctttgggaagtagttaatgatgaagagtttagggcagaggactttatttgcaaactgtgaataagagccatgggctgtttctcataaggaggaaaaatgttcagtgctgagaccacctaagatgacatttgagctgttaatagctctgcccagcaccttaaggaaaagtctcattctacagtggactgataactagcagaggaacagggtgcatatgaatccaaaaagaacagacacaagcagtcttggcaagaaaaactgatgagaa

SEQ ID NO: 32309 - DNA, 601 bp, Human
acacacacacacacacacacacacacacagaggaagaaagagagagaggaagagacagaaactaaatgatatatttggattgtttttgtgaaatacattaatttttttaagcattgatcaaatccacagtgagacaataaatgccaatactgaattctcagagaggaagattttcatcatgcctaaaaaattaatgaaaaccaaacggttctggtttggttccagcgaatttatgggaaagcaaaataaatgaaatctaatatggctttgggaagtagttaatgatgaagagtttagggcrgaggactttatttgcaaactgtgaataagagccatgggctgtttctcataaggaggaaaaatgttcagtgctgagaccacctaagatgacatttgagctgttaatagctctgcccagcaccttaaggaaaagtctcattctacagtggactgataactagcagaggaacagggtgcatatgaatccaaaaagaacagacacaagcagtcttggcaagaaaaactgatgagaaattgatataagaatggctggctccatttctttgctgttttttcctcatttacctggtttcaaaataaa

SEQ ID NO: 32310 - DNA, 601 bp, Human
ggttctggtttggttccagcgaatttatgggaaagcaaaataaatgaaatctaatatggctttgggaagtagttaatgatgaagagtttagggcagaggactttatttgcaaactgtgaataagagccatgggctgtttctcataaggaggaaaaatgttcagtgctgagaccacctaagatgacatttgagctgttaatagctctgcccagcaccttaaggaaaagtctcattctacagtggactgataactagcagaggaacagggtgcatatgaatccaaaaagaacagacacaagcagtcttggcaagaaaaactgatgagaaattgatataagaatggctggctccatttctttgctgttttttcctcatttacctggtttcaaaataaatagataaggctgatgactcacacatttatatttctacaaaggcccttctgttcttagctatggactcacagacacaaaacttacctgtcaatcttcccttctgggtctaacaggagtctcaaccccaagtgtccaaaataaagttcttgcttttcctctggaacctgttgccctccctgctcatttcgccaacttctttgagtgca

SEQ ID NO: 32311 - DNA, 601 bp, Human
ggaacagggtgcatatgaatccaaaaagaacagacacaagcagtcttggcaagaaaaactgatgagaaattgatataagaatggctggctccatttctttgctgttttttcctcatttacctggtttcaaaataaatagataaggctgatgactcacacatttatatttctacaaaggcccttctgttcttagctatggactcacagacacaaaacttacctgtcaatcttcccttctgggtctaacaggagtctcaaccccaagtgtccaaaataaagttcttgcttttcctctggaacytgttgccctccctgctcatttcgccaacttctttgagtgcaacactattcactcatttgctcaagccgtaagtctagaagtctctgatgattcttccctttctctcattcccatatacacctcattagcaagtcttagtggcatatctccaaaacaggtcctgaatgtggtctttttcaccacaactagcctagcccatccaccatcaacacttgtacaggtgaagaaacaacttcttgttcagtctcttggttctcaatcttgtcctttacagcccatgtgccacacagtggccatagt

SEQ ID NO: 32312 - DNA, 601 bp, Human
ccagtgaaaaccagaaaattccaaacttgatctaaaagtataccttctttcccctgccccccaacccgctgctccagtttgggcctggggagggaagggatcatttggttggtttcttgatccctttctctgtcagcaactcctctcacccctcttgctagctgtggcttctgatctttccagggctggtgggtagggagttagaagcaagaagcaggaagtgtctttcttagctggagctcttgtgacctggcattggtggtctctgggttggatgaatgttcaatgctgaatcctttaytgtaccccactgggggcatccaccagtcctcccatgtcaggggtgatatgtgttcactaactcagcagttagggttcctttctcaggtgttgggcatcaggcagtccgccctgtcttttggggtcgtgtggcttctccagacagttgtcatttaagagattgtaaactggatttttcctgagtcatctgtatctggttcacaagggacctgctggtctccacctgtgcttcttcacctctgctgccgtgggacgtatcacagcctccagtgtggtgtagacctttgctgtgctctgcagc

SEQ ID NO: 32313 - DNA, 601 bp, Human
gtgggtagggagttagaagcaagaagcaggaagtgtctttcttagctggagctcttgtgacctggcattggtggtctctgggttggatgaatgttcaatgctgaatcctttattgtaccccactgggggcatccaccagtcctcccatgtcaggggtgatatgtgttcactaactcagcagttagggttcctttctcaggtgttgggcatcaggcagtccgccctgtcttttggggtcgtgtggcttctccagacagttgtcatttaagagattgtaaactggatttttcctgagtcatcygtatctggttcacaagggacctgctggtctccacctgtgcttcttcacctctgctgccgtgggacgtatcacagcctccagtgtggtgtagacctttgctgtgctctgcagcctcagaccaagagtcaccacctcatgcccttagattctgaggcatgtgtcactcacctttatgcacacacatgcacacacacataggggacatatgtcaagctccctgaatgacctccttgcaggcagctcctataatttgacttgaagtgacggggcagtgccctcctcctttctttcctggagtga

SEQ ID NO: 32314 - DNA, 601 bp, Human
ttagctggagctcttgtgacctggcattggtggtctctgggttggatgaatgttcaatgctgaatcctttattgtaccccactgggggcatccaccagtcctcccatgtcaggggtgatatgtgttcactaactcagcagttagggttcctttctcaggtgttgggcatcaggcagtccgccctgtcttttggggtcgtgtggcttctccagacagttgtcatttaagagattgtaaactggatttttcctgagtcatctgtatctggttcacaagggacctgctggtctccacctgtgcwtcttcacctctgctgccgtgggacgtatcacagcctccagtgtggtgtagacctttgctgtgctctgcagcctcagaccaagagtcaccacctcatgcccttagattctgaggcatgtgtcactcacctttatgcacacacatgcacacacacataggggacatatgtcaagctccctgaatgacctccttgcaggcagctcctataatttgacttgaagtgacggggcagtgccctcctcctttctttcctggagtgagagtgaatacctgacagagaataccagcaactgtctctaaa

SEQ ID NO: 32315 - DNA, 601 bp, Human
cctgcatggccgttcctaccctccccattcctttgcagagagagtttctatttcttcctggtttaatctaggagggttttatatttccaggaatttatccatctcctctaggttttctagtttacacacgtaaaggtgtttatagtagtcttgaatgatattttgtatttctctggtatcaattttaatatctcccgttttgtttcaaattgagcttatttggatcttctctcttttttccttggttagtgtcgctgatggtctggcaattttatttatcttttcaaagaaccagctttttgtttcatttatcttttgtattttttgtttgtttgtttcaatttccacttagttttgctctgatcttggttatttcttttcttctgctggttttgggtttggtttgttcttgtttctctagttccttgaggtgtaaacttagattgtctatttgtgctctttcagactttttgatgtaggcatttaatggtatgaactttcctcttagcaccgcttttgctgtatcccagaggttttgataggttatgtcacggttgtcgttcagttcaaagaattttttaattttcatcttgatttcatt

SEQ ID NO: 32316 - DNA, 601 bp, Human
gaatttatccatctcctctaggttttctagtttacacacgtaaaggtgtttatagtagtcttgaatgatattttgtatttctctggtatcaattttaatatctcccgttttgtttcaaattgagcttatttggatcttctctcttttttccttggttagtgtcgctgatggtctggcaattttatttatcttttcaaagaaccagctttttgtttcatttatcttttgtattttttgtttgtttgtttcaatttccacttagttttgctctgatcttggttatttcttttcttctgctggktttgggtttggtttgttcttgtttctctagttccttgaggtgtaaacttagattgtctatttgtgctctttcagactttttgatgtaggcatttaatggtatgaactttcctcttagcaccgcttttgctgtatcccagaggttttgataggttatgtcacggttgtcgttcagttcaaagaattttttaattttcatcttgatttcattgttgagccaatgatcatttaggagcagcttatttaatttccatgtatttgcacagctttgagagttccttttggagttgatttccaattt

SEQ ID NO: 32317 - DNA, 601 bp, Human
ttccccacatttttgcctaagcttggtgatcatagttttttaaaatgtttatgaaaactgataggtaagaaataataggatctggttcttttaatatccatgtccttgatagcaaagcgaagcacattttcccatgtttgttcttaatctatattcatatattattccaatagtttcctactttttaccaatttactgtattttatttttttattagcttgaagaagttgagcaaatgctactccatatctgatagaatgctgtaattaatttctccccttctgtaagtgatcttctatgktatctattattataaataagttttgctctttttgtgtcctgcagtatccttaaatatgtttaggtgtaaatttcatttcatttctctagcttgagactcattttgattcctgaatctgagaaatcttgtggtttcatctcttctgaaaaattcctatccgttatttcctaaagtattgccttttctcagttctctttattttgtcctcctagaagtcctattcaacatacattggaccttttcactccattttccaggttcttaactttgctgtcatccctcatcatctcactgagcttt

SEQ ID NO: 32318 - DNA, 601 bp, Human
attctgtacaatttacatagctcattaccgttgattttgctaattctttcattagctatgtctagtcacttagtttcaaattttaatgcctaattttttttgtatttcaagtagtatctttcttaaatctgcctattctttttggtatctttttatgttctagggtccatattttatttcttcaattatttaaagcatacttacataatgtctttgtcagtttattctatttttggaagttcgcagtagtttaattttgctacacattgagtctgaaaacttgttttggatggatcacttytttgagtgtttataattttttattttgagctcataatatatagagcttcatctgcagtaattctgtgtaatctgttttgagtgaatcagactgggcttgattctttggtcagttttttagctggggatgagttctcagacaatgaagacagtatgaattccaaccctcaattctccataacctagatatgaactttcacaattttcaggtgaagtactttattttcaaaccataactcaggacaaagagggttgtcactgttattgttgaaaggggaagagcctctgtaaccaagttttg

SEQ ID NO: 32319 - DNA, 601 bp, Human
tactaaataaaactaggatctgtggcatcttttgttgatacacatcattttccttgctaccaccaattgccaataattctatacggttatacattgttattgataattatttcatttctcataagaaactttgaaggtatataagacaggcaggtatcatgacattatttagagatgaaggaaaaaaatcagaacaggttctaagtaggaaatatagaaaccaaccttggcttgtctgattctaagtccaagacatgtcctattagatctctctgctcatgttaaatccagacctgacccygaaccccaaaatgggctttttgcttctaccatgtcatagaagtcacctttctccctttctcttatctatattacaacatcatgctttttataatatgcattaagggaaactgtagaacatcttattttaccctaaatgcttaatgagttataactatgttatccattaattcttttaaggatatagtcatttcataagataatgacttcaaaaggcaaaaccctaaccaagatggaatgctttgtaatactcaacattttagccagtttgtctgttaagaattatgcatatcttcaagaa

SEQ ID NO: 32320 - DNA, 601 bp, Human
atctatattacaacatcatgctttttataatatgcattaagggaaactgtagaacatcttattttaccctaaatgcttaatgagttataactatgttatccattaattcttttaaggatatagtcatttcataagataatgacttcaaaaggcaaaaccctaaccaagatggaatgctttgtaatactcaacattttagccagtttgtctgttaagaattatgcatatcttcaagaaaagagatttctcctaatctcaaccatcacagaagaaatcaggaaatgtgcatgttagtactcawcctacaactagtcaccatttgacccagaatgaatactattccagtagtctcggctgaaggtctcatctgtttctaaggatttcagagtctactagactataccattggccaaattcttttatcctatcattctgtctctcccttaaaattaataatacgaagaacttatgtgtaaaattttaccaaggtgcagtatggcatactgggtaaaagcacgggtcagaaatcagaatgcttgagtttccaatcctgattttgccatttatgagctcattattaccactcacatagtgtcccttc

SEQ ID NO: 32321 - DNA, 601 bp, Human
aatactcaacattttagccagtttgtctgttaagaattatgcatatcttcaagaaaagagatttctcctaatctcaaccatcacagaagaaatcaggaaatgtgcatgttagtactcaacctacaactagtcaccatttgacccagaatgaatactattccagtagtctcggctgaaggtctcatctgtttctaaggatttcagagtctactagactataccattggccaaattcttttatcctatcattctgtctctcccttaaaattaataatacgaagaacttatgtgtaaaattttrccaaggtgcagtatggcatactgggtaaaagcacgggtcagaaatcagaatgcttgagtttccaatcctgattttgccatttatgagctcattattaccactcacatagtgtcccttcctcagcccacctttgggcagtcattggaaagttcatttataatttgtctaaagtggaacttctatggtctttctggttccttctatagtctcctacaacatctggcctaccatgccacccagtcctctggtgaccactccaggctatagctgtatcagacaacaactttgtaacccacttta

SEQ ID NO: 32322 - DNA, 601 bp, Human
gaaaatatgagtaactgcagaaatcaacttggaaatttggaaggctttctctcaaattatacaatgttattgcagaattaaaatggtacagtagttagcttcccttgaattggtgaaagaattccctacctcctcctccccacccctgccaccagcccacccacatacaccaccacattatagctgggcctcaaaccagcatgggtggccctgtgcaggggtttcaaaatgtgagaacaaagtcacacacaactggcttttatggtccaaggctgtaggggtggactacaaggaacctacrtaaatatgtttgtgcaaaggaaagaataagataaggcatgtgttagataaaaaaagaaattgacaggtacacttatgaaagataacagttcattatatagctgtcacataatgagtgcatgccctgtgttagacactgttctaagcagtctttatgtattaattcattgaattctcacaacaatccttcaggaaaagtgctactagcatcatccccattttgtaggagcctgctcaggcacagagggatgaagtaacacatcttaatcatccaggcacaaagaggtagcagctggattta

SEQ ID NO: 32323 - DNA, 601 bp, Human
actgcagaaatcaacttggaaatttggaaggctttctctcaaattatacaatgttattgcagaattaaaatggtacagtagttagcttcccttgaattggtgaaagaattccctacctcctcctccccacccctgccaccagcccacccacatacaccaccacattatagctgggcctcaaaccagcatgggtggccctgtgcaggggtttcaaaatgtgagaacaaagtcacacacaactggcttttatggtccaaggctgtaggggtggactacaaggaacctacgtaaatatgtttgygcaaaggaaagaataagataaggcatgtgttagataaaaaaagaaattgacaggtacacttatgaaagataacagttcattatatagctgtcacataatgagtgcatgccctgtgttagacactgttctaagcagtctttatgtattaattcattgaattctcacaacaatccttcaggaaaagtgctactagcatcatccccattttgtaggagcctgctcaggcacagagggatgaagtaacacatcttaatcatccaggcacaaagaggtagcagctggatttaaaccagctgttgt

SEQ ID NO: 32324 - DNA, 601 bp, Human
accacattatagctgggcctcaaaccagcatgggtggccctgtgcaggggtttcaaaatgtgagaacaaagtcacacacaactggcttttatggtccaaggctgtaggggtggactacaaggaacctacgtaaatatgtttgtgcaaaggaaagaataagataaggcatgtgttagataaaaaaagaaattgacaggtacacttatgaaagataacagttcattatatagctgtcacataatgagtgcatgccctgtgttagacactgttctaagcagtctttatgtattaattcattgaattctcacaacaatccttcaggaaaagtgctactagcatcatccccattttgtaggagcctgctcaggcacagagggatgaagtaacacatcttaatcatccaggcacaaagaggtagcagctggatttaaaccagctgttgttagcttttacatcacactgctgtgcttacgttattacggggaaattgaggaatattttcatcttcaatttcttaaagttctcaataatgacaataacaataataataaaatcatagagtgtaggaagtaaatcaacagaagaatatggaagaagtccc

SEQ ID NO: 32325 - DNA, 601 bp, Human
ttctggaacagaaaaaggacattagttaaaaactaagagatctgaataaactgtggactttagtagttaataatatatcactgcaggtttattaattgcaacaaatgcaccataagatgttaataacaggaaattttgtgtgagatatagaggaactcaacaattctatatatctaaaactgtcctaaaattaaaaatttattaagaaaaatggctatgtacctaaaacatttcagatcacagattgagatggaagcttataacttttaaaaaagaacaaagctagtatagcaaaaaatarcacatacatatgtacataaacaacattttaagctcaactatatatactaaataaaattccagctaaaatgctagcaaaatacatcatgtttttaaattttgtaatagcctattaagaataagaagagatcatcccaataatacgaaggtggtaggctattataattataataaacttacataaacttattcagttgttatcacagtgccttgaggtagactctgttattaatctcatttttcaggcaaaatttgggggccacagagagctcagtaccttgccccagaatacacagctata

SEQ ID NO: 32326 - DNA, 601 bp, Human
aaaacatttcagatcacagattgagatggaagcttataacttttaaaaaagaacaaagctagtatagcaaaaaatagcacatacatatgtacataaacaacattttaagctcaactatatatactaaataaaattccagctaaaatgctagcaaaatacatcatgtttttaaattttgtaatagcctattaagaataagaagagatcatcccaataatacgaaggtggtaggctattataattataataaacttacataaacttattcagttgttatcacagtgccttgaggtagactctrttattaatctcatttttcaggcaaaatttgggggccacagagagctcagtaccttgccccagaatacacagctataagtagaccacacaagctggaattggaatgcaggtgtctgattctaggattaaaatacattttataaaacttatgtatccccataaaaatatttaaaagtaggaacagagtagtttaatataattaaaggacatgtcacaccaacaactagcagcatacctagtggtgtaatgtgagaagcagtctcagtaaatgcaaatatagctgaggtgcccattcttacca

SEQ ID NO: 32327 - DNA, 601 bp, Human
attaaaatacattttataaaacttatgtatccccataaaaatatttaaaagtaggaacagagtagtttaatataattaaaggacatgtcacaccaacaactagcagcatacctagtggtgtaatgtgagaagcagtctcagtaaatgcaaatatagctgaggtgcccattcttaccattcctgctttgtccatttttttgaaaatgctggtgaattaaattacccaggagaatgaaatacgtgttgcaaacggtaaacataatcaactatatttttcattatttgtccataatttgtcttyctttattgaatcaaaactcagtgggggaaaagctgatgaatatgataggaaaaagaacagttacacaacaataaaaagtaatttacaaaatttgtgaaggccttaactgaagataactataaaattccacctcggactgagtaaaagaccaatactggtacatgggtaggtatctcttcttgactagaagacaatcctacaaatgtggcaatccttcttaatttaatctgtcatatcaatatgactgatcaaaattccaatgtagattttcatgggtggtgcattggctgggttggggat

SEQ ID NO: 32328 - DNA, 601 bp, Human
cttatgtatccccataaaaatatttaaaagtaggaacagagtagtttaatataattaaaggacatgtcacaccaacaactagcagcatacctagtggtgtaatgtgagaagcagtctcagtaaatgcaaatatagctgaggtgcccattcttaccattcctgctttgtccatttttttgaaaatgctggtgaattaaattacccaggagaatgaaatacgtgttgcaaacggtaaacataatcaactatatttttcattatttgtccataatttgtctttctttattgaatcaaaactcartgggggaaaagctgatgaatatgataggaaaaagaacagttacacaacaataaaaagtaatttacaaaatttgtgaaggccttaactgaagataactataaaattccacctcggactgagtaaaagaccaatactggtacatgggtaggtatctcttcttgactagaagacaatcctacaaatgtggcaatccttcttaatttaatctgtcatatcaatatgactgatcaaaattccaatgtagattttcatgggtggtgcattggctgggttggggatggggaactaaatgctctcaga

SEQ ID NO: 32329 - DNA, 601 bp, Human
agtttaaatacttctatgatctaaccatagcctatctttcaagtttcatctctccccagccccagacaagctaatcttccatgtttcctggttataaatggcacttccagctatcccagctgcccaagcagggaacttgggagtcatctccagcagtttcctctctctcactgtccatacccaatcggtcactgctcccagccaattctttctctaaatccacttcttcccattcctattctaatcttctcatcccagagccctgcctaaaaagctctcccctaatgcttgttctgaccarctccacacattcttcaagtctctgagaaatgcttctgagggagccacctcccccattacctcccaggggaacaaaattccactacacacctacagaggaatgtctgctctccctatatttctgcatctcagacagataccaatcttctccttcttccagacttagggagagtgggagaaaagcattctgattgtgatttttcatgcccttttcctctcaggtttttgttcagtccgacatgggctggccctcatcttgcagctctgtaatttttcaatttacacccaacaaatgaacttg

SEQ ID NO: 32330 - DNA, 601 bp, Human
tatctttcaagtttcatctctccccagccccagacaagctaatcttccatgtttcctggttataaatggcacttccagctatcccagctgcccaagcagggaacttgggagtcatctccagcagtttcctctctctcactgtccatacccaatcggtcactgctcccagccaattctttctctaaatccacttcttcccattcctattctaatcttctcatcccagagccctgcctaaaaagctctcccctaatgcttgttctgaccaactccacacattcttcaagtctctgagaaatgyttctgagggagccacctcccccattacctcccaggggaacaaaattccactacacacctacagaggaatgtctgctctccctatatttctgcatctcagacagataccaatcttctccttcttccagacttagggagagtgggagaaaagcattctgattgtgatttttcatgcccttttcctctcaggtttttgttcagtccgacatgggctggccctcatcttgcagctctgtaatttttcaatttacacccaacaaatgaacttgagcattgccatcccagctatggtgaacaacac

SEQ ID NO: 32331 - DNA, 601 bp, Human
tacctcccaggggaacaaaattccactacacacctacagaggaatgtctgctctccctatatttctgcatctcagacagataccaatcttctccttcttccagacttagggagagtgggagaaaagcattctgattgtgatttttcatgcccttttcctctcaggtttttgttcagtccgacatgggctggccctcatcttgcagctctgtaatttttcaatttacacccaacaaatgaacttgagcattgccatcccagctatggtgaacaacacagccccacctagccagcccaatgcytccacagaacggccctccactgactcccagggctactggaatgaaactctaaaagaatttaaagcaatggtaagtttaatgagactctggactctttctttgactcaaataatttgacttaaagagttataaaagagtgagattcatttaaccactaagtatttactgaacatgtactatgtgccaggaatggcacaagtacctaagtatcaggccgagcatggtggctcacacctttagtcccagcactttgggagggtgaggcatctttactaaaaatatgaaaatcagccaggcatg

SEQ ID NO: 32332 - DNA, 601 bp, Human
gctatggtgaacaacacagccccacctagccagcccaatgcctccacagaacggccctccactgactcccagggctactggaatgaaactctaaaagaatttaaagcaatggtaagtttaatgagactctggactctttctttgactcaaataatttgacttaaagagttataaaagagtgagattcatttaaccactaagtatttactgaacatgtactatgtgccaggaatggcacaagtacctaagtatcaggccgagcatggtggctcacacctttagtcccagcactttgggaggstgaggcatctttactaaaaatatgaaaatcagccaggcatggtcataggcacctgtaatcccagctactctggaggctgagacagaagaatctcttgaactggggaggcagaagttgcagtgagcggagatcgtgccactgcactccggtctgggtgacagagtgagattctgtcttaaaaaaaaaaaaaagaaagaaagaaagaaaagaaaggaataaagaacataataagtatctaaggggattgcatccctacttagtgcatatgagtgtaaccagggactaagttagaataaatga

SEQ ID NO: 32333 - DNA, 601 bp, Human
agattcatttaaccactaagtatttactgaacatgtactatgtgccaggaatggcacaagtacctaagtatcaggccgagcatggtggctcacacctttagtcccagcactttgggagggtgaggcatctttactaaaaatatgaaaatcagccaggcatggtcataggcacctgtaatcccagctactctggaggctgagacagaagaatctcttgaactggggaggcagaagttgcagtgagcggagatcgtgccactgcactccggtctgggtgacagagtgagattctgtcttaaamaaaaaaaaaagaaagaaagaaagaaaagaaaggaataaagaacataataagtatctaaggggattgcatccctacttagtgcatatgagtgtaaccagggactaagttagaataaatgaaacattttaccatttagtggacataaattcttcccctacaatgatgaaaatcactacaaaatatgtttcacagatttgtctgctttttcttccttccacgtattttttttttactaccttgcttatgatgctttcttctttatagtctttgtttctttacgaactctcttatattttaatt

SEQ ID NO: 32334 - DNA, 601 bp, Human
ttcccctacaatgatgaaaatcactacaaaatatgtttcacagatttgtctgctttttcttccttccacgtattttttttttactaccttgcttatgatgctttcttctttatagtctttgtttctttacgaactctcttatattttaatttttggttagttgtgtcagggtgagcggaaagagtatattgggcatatatttagggtttttaaatacatgatactggtatattggaggaactggagaaatgtaaacagaaagataactgccaattaatttttgcctctcaagtcctcacartgaaaactgtcaatccttcaactaaagacaaacagtaactctctttgtcatctaggcccctgcatatgactggagtcctgaaatccagggaatcatcctcagctccctcaactatggctcattcttggctccaatccccagtggctatgtggctggaatatttggagccaagtatgtggttggtgctggcttgtttatttcctcattcctgaccctcttcattccactggcagctaatgcgggagtggccttgctcattgtcctccggattgtacaaggcatagcccaggtaccaagatg

SEQ ID NO: 32335 - DNA, 601 bp, Human
ccaagtatgtggttggtgctggcttgtttatttcctcattcctgaccctcttcattccactggcagctaatgcgggagtggccttgctcattgtcctccggattgtacaaggcatagcccaggtaccaagatgttttccaggtataagtggaatataggttccagaatgacctcagatctccaagaatggaatttttccccccaggttatggtattaactggtcagtattcaatttgggtcaaatgggctcccccactggaaaggagtcaactcaccaccattgctggatcaggtaactgrtaccctaaacctcactttacatgcactgtccaggagaactcagcaaagtcctgccaacagaaccaagatcttatatatcaatctctgtgtcttcatagtcctttccttaaagcactaccccatactgccttacttgattgtaactgaataaactgaatgcttactatgtgccaaacattcttgtgttttgcacatattttcatcttatcctcaaaataattttataagtcagctatatataattacttccatttcacacatatggaatttcagacacaaacagactaataacttctccaa

SEQ ID NO: 32336 - DNA, 601 bp, Human
ttccagaatgacctcagatctccaagaatggaatttttccccccaggttatggtattaactggtcagtattcaatttgggtcaaatgggctcccccactggaaaggagtcaactcaccaccattgctggatcaggtaactggtaccctaaacctcactttacatgcactgtccaggagaactcagcaaagtcctgccaacagaaccaagatcttatatatcaatctctgtgtcttcatagtcctttccttaaagcactaccccatactgccttacttgattgtaactgaataaactgaatrcttactatgtgccaaacattcttgtgttttgcacatattttcatcttatcctcaaaataattttataagtcagctatatataattacttccatttcacacatatggaatttcagacacaaacagactaataacttctccaagatcacatagttaccaagtgaaggaacctagatagtttggcttgaaactcataccttcactcactgtgcaactcagcattgtagaaagcacatagagccccaagacgagtcctctcacccagaacatcctcgcctcttctgttcagggtcaatgctggg

SEQ ID NO: 32337 - DNA, 601 bp, Human
ttaggctaggcgtggtagctcatgcctgtaatcccagcactttgggaggctgaggcaggtggatcacatgagtccaggagtttgaaaccagcctggccaacatggttaaaccccgtctctactaaaattataaaaattagccgagtgtgatggtgcatgcctgtaatcccagctactcgggaggctgaggtgggagaatcacttgaacccaggaggtggagggtgcagtgagccaagatcacactactgcactccagcctgtgtgacagagtgagaccctgtctcaagagaaaaaaaaaaagaaaatgttattttagtcagattacattttagtcatgctttttaatttaatatattctttaaaatttctccagttattattatggcaaaaaccacaattgcttttgcaccaatctaatatcatagctagaaaattgtgtgactgtgacctaatcataggtaaaatactaattagagtagagaatcaactagtggagactgcaggacagggcagattatgtgaggttcagaagtggacataatacacagagagatgctgcagaaaggttccaaagacacttggaaagttccagaggcagta

SEQ ID NO: 32338 - DNA, 601 bp, Human
agccaagatcacactactgcactccagcctgtgtgacagagtgagaccctgtctcaagagaaaaaaaaaaagaaaatgttattttagtcagattacattttagtcatgctttttaatttaatatattctttaaaatttctccagttattattatggcaaaaaccacaattgcttttgcaccaatctaatatcatagctagaaaattgtgtgactgtgacctaatcataggtaaaatactaattagagtagagaatcaactagtggagactgcaggacagggcagattatgtgaggttcagragtggacataatacacagagagatgctgcagaaaggttccaaagacacttggaaagttccagaggcagtattttactacgttacagttttaccttcatggagctgtggttggaatctgcctagctgctgttacctttagtttgtttaatatttgaaacattctccaaaatcgcacccctaaattgtttatggtaataccttatagtcccactagtgtgttcattagaggacaggcctgttagatcaagggtttctgtaaaatcaggtgaatatattcaccaaaaataaaatatgtaatga

SEQ ID NO: 32339 - DNA, 601 bp, Human
atgtaatgattccatagcatatcaacctttaaagtttttatcatgaaaactttgaaagggcaggttacaaaaattattcaaacaacaagaaaatcttactgtgcttatggtttcaagaaacagtaaggagcatatacacaatagaaactcactaaatatttgttgaataaatattaacatcctccaaccccaatgtgcaacattgctaattttcatatctatccctccgcacttgattatgttccttgatggcaaaattgtgtcttcgccattttatattctcaaaatttagcaaaaagcstggtgtatagtggctgctgtatgatgtttgtgaaggaatttgtaaatgacatgctagccaaacaaagagagctcataagatttcttaagattctaaaaagggaatttgaagatgggccatatttccactcaatactgataatgttaaattcccaactctgtaataatgtatatattagaaaaaatgtctttgctgaggattcatttcatttcatatctacaaattgggtaattaatttcacataatgtactgctgctcactcttatgtgctttgaggaagataagagatagatatggaaa

SEQ ID NO: 32340 - DNA, 601 bp, Human
ttggctgtgcttgttgtcctctctggtttcctctcatttatgatgatcctgtgaatcatccctttatcagtgctggtgagaagagatacattgtgtgttcattggctcagcaggtacattgaggaactcctctgacatttctctatgtccctctagacgtctgagagatgaagaatgtgatagagagagctgccttctgacggaggggacattgatgtgtgctttcttccaggactgttcaccaggctggtctcttcccattagggctatgatcaaatccttaccactctgggccattttrgtctcttatttctgtgaatactggcttttttataccattatggcgtacacaccaacgtacatcagctcggtacttcaagccaacctcagagatgtaagtacagagaaagctcattctgatcttctgtttaaatgcttaaataatgagagctcatatataatcctctgtctgtcccatagtcacaaaatcgggggattaggaccaggcaggacctccatataggaaatgcaatctagttaatttggattctgattgatctcaatgtggttcactacttactgcaggaggatgatacatatg

SEQ ID NO: 32341 - DNA, 601 bp, Human
ctggcttttttataccattatggcgtacacaccaacgtacatcagctcggtacttcaagccaacctcagagatgtaagtacagagaaagctcattctgatcttctgtttaaatgcttaaataatgagagctcatatataatcctctgtctgtcccatagtcacaaaatcgggggattaggaccaggcaggacctccatataggaaatgcaatctagttaatttggattctgattgatctcaatgtggttcactacttactgcaggaggatgatacatatggttctagtttgattttcatayactatcatattttattatactattttcatatatactattcatatttatcatattttaagggccctgtgcaaaaattttatactcaatcccatcaaaatttgcaaacaagatgctctgctggcagcataaataataaagattaaccaaacaaattctgcctttgagaaaattgtgacagagaaacataaacaacatatgctgaaaataagacattaataggacataaagtcccaaataagacttacatagacatttgcggagtaatgtttgttttaaaaaatcatttttattcaagtataa

SEQ ID NO: 32342 - DNA, 601 bp, Human
agagtgggtcaggtgtggtggctcatgcctataatcccaacactttgggaggatgaggcaggtggatcatctgaggtcaggtgtttgagaccagcctggccaacatggtgaaccccctgtctctactaaaactacaaaaaattagccaggtgttgtggcatctgcctgtagtcccagctacttaggaggctgaggcatgagaatcgcttgagctggtgaggtggaggtttcagtgagccgagattatgacattgcactccagcctgggcaacaagagctaaactctgtctaaaaaaaaaawagaaagactgaaaaatctttctttcattactgttcctaatctgccctgtcctcccagcccattccaatgataattctttctatgtcttttttctttttctttctttcttttgagacaacgtctcactgtgttgcccaggctggagtgcagtgtttcactcatggctcactaaagcttcgacctcccaggctcaagcaatcctcctacctcagcctcctgagtagctgggaccacaggcgtgtaccaccatgcctggctaattttttgtggagatgaggtcttgttatattggctaggctg

SEQ ID NO: 32343 - DNA, 601 bp, Human
gagtgggtcaggtgtggtggctcatgcctataatcccaacactttgggaggatgaggcaggtggatcatctgaggtcaggtgtttgagaccagcctggccaacatggtgaaccccctgtctctactaaaactacaaaaaattagccaggtgttgtggcatctgcctgtagtcccagctacttaggaggctgaggcatgagaatcgcttgagctggtgaggtggaggtttcagtgagccgagattatgacattgcactccagcctgggcaacaagagctaaactctgtctaaaaaaaaaatagaaagactgaaaaatctttctttcattactgttcctaatctgccctgtcctcccagcccattccaatgataattctttctatgtcttttttctttttctttctttcttttgagacaacgtctcactgtgttgcccaggctggagtgcagtgtttcactcatggctcactaaagcttcgacctcccaggctcaagcaatcctcctacctcagcctcctgagtagctgggaccacaggcgtgtaccaccatgcctggctaattttttgtggagatgaggtcttgttatattggctaggctgg

SEQ ID NO: 32344 - DNA, 601 bp, Human
tatgagaatgcaagcatacatgaatgtgtattcttattttcccaacttttaaaatacaaaacagtatacttagtaatatgccgctatgcttatatactaggtttttgccaattaatatgtcatggaaatcttcatatcagtacatgagaaccttgctgagcagtatttggattgtttcccatctttgagcaatgctgcagtgaaaaccttgttcatttctcatacctttgtgcaaccctctgtggagtaaatttctgcatatgagattattgagtcaaagggtaaatgcactataaacttytatatttgttgtcaaattgccctcaatagagcaccagtaatatttgtgagaacctgattctccacagtgttagcacagagcatgccaaaaaaaaatgggtgtttttgccaatttgatccatgaaaaataatatctcaccatagttttactttgtatttctttcattatgagtaaagttggataccttttaacatgtttaggagccacttatttttctttttttcttcttttcttttttaaattgtctgttattaccctttgcctatttttgtactgggttttggtcttttaaatatttat

SEQ ID NO: 32345 - DNA, 601 bp, Human
actaggtttttgccaattaatatgtcatggaaatcttcatatcagtacatgagaaccttgctgagcagtatttggattgtttcccatctttgagcaatgctgcagtgaaaaccttgttcatttctcatacctttgtgcaaccctctgtggagtaaatttctgcatatgagattattgagtcaaagggtaaatgcactataaacttttatatttgttgtcaaattgccctcaatagagcaccagtaatatttgtgagaacctgattctccacagtgttagcacagagcatgccaaaaaaaaatgggtgtttttgccaatttgatccatgaaaaataatatctcaccatagttttactttgtatttctttcattatgagtaaagttggataccttttaacatgtttaggagccacttatttttctttttttcttcttttcttttttaaattgtctgttattaccctttgcctatttttgtactgggttttggtcttttaaatatttatttccaggtgatttttatatataaagagagccttgttcttttttttttgcaagcagagctatgaacatatacatactaaaagtatattggctcatt

SEQ ID NO: 32346 - DNA, 601 bp, Human
acggagggtataaaagttacaagatcagactcaacagcagaagccaaaacaacaacaacaacaacaacaacaacaacaacaaaaaccttacaaaccaggtgcagaccatcaatctgaccatcttgcataaacaatgttgacaagttaatagaggttacccccttgggagtaccagtccctagcacaggattatactaatcattggtcagtacatttcattcaggtttcaccaaggcttacacaattccagtcatctccagaggtaagcacagagttgcagcagaccagctgatattaaccytttgtttgcacaggaatatttgcctccctctcccgggtattgagactttcaaacgtaggtatacttggttataatagagtaccatctctctctctcaggtacactggctttctcaaaggactattgcaagtctttgcacacatagctggagccatctctcctactgctgctggatttttcatcagtcaggtgaggtcaaatgttctgatgaatattcataaaagaaacctatagaggcatggttttttcacatatgcacggccttgtatcctagaagatgcttttaaagtagtcaaaaat

SEQ ID NO: 32347 - DNA, 601 bp, Human
cttctttctggccatcttgacttctgccccacatctgctttttggctttgtgcagatctttaacatgttagtgaacagacattgcccagtgtctcttctagcccctccaacagttcttcatgtagcactgcttttggacagtgacccatgatatctgccttcgtttgcccctctgactgttggaatcccacgcaccattcagtaggattcaattcaatgtggaaccattcaacattcacctcattaacctaaaatgtctcccaaagatgtatgtaagacacacactgccctaacctcactycaaatgtctggagaaatgtgtgtagtgcttttgttaaagcccctatatgggcagcatggaggatcataagatagcaaaaccatttcaacactaaatgaatattaatgtacacacaccttgtgtggatggcagaaatcaaatcatacacagtattaaggagttcagtgtctcgggagggcagataactttaatcaaagtatcacacaagtgaatatgtaataacaactgtagaaataatgagtggttacatgggttatgagagtggatgataagtgcactaatctgagtgtaaggaagggc

SEQ ID NO: 32348 - DNA, 601 bp, Human; identical to SEQ ID NO: 24331

SEQ ID NO: 32349 - DNA, 601 bp, Human; identical to SEQ ID NO: 24332

SEQ ID NO: 32350 - DNA, 601 bp, Human; identical to SEQ ID NO: 24333

SEQ ID NO: 32351 - DNA, 601 bp, Human; identical to SEQ ID NO: 24334

SEQ ID NO: 32352 - DNA, 601 bp, Human; identical to SEQ ID NO: 24335

SEQ ID NO: 32353 - DNA, 601 bp, Human; identical to SEQ ID NO: 24336

SEQ ID NO: 32354 - DNA, 601 bp, Human; identical to SEQ ID NO: 24337

SEQ ID NO: 32355 - DNA, 601 bp, Human; identical to SEQ ID NO: 24338

SEQ ID NO: 32356 - DNA, 601 bp, Human; identical to SEQ ID NO: 24339

SEQ ID NO: 32357 - DNA, 601 bp, Human; identical to SEQ ID NO: 24340

SEQ ID NO: 32358 - DNA, 601 bp, Human; identical to SEQ ID NO: 24341

SEQ ID NO: 32359 - DNA, 601 bp, Human; identical to SEQ ID NO: 24342

SEQ ID NO: 32360 - DNA, 601 bp, Human; identical to SEQ ID NO: 24343

SEQ ID NO: 32361 - DNA, 601 bp, Human; identical to SEQ ID NO: 24344

SEQ ID NO: 32362 - DNA, 601 bp, Human; identical to SEQ ID NO: 24345

SEQ ID NO: 32363 - DNA, 601 bp, Human; identical to SEQ ID NO: 24346

SEQ ID NO: 32364 - DNA, 601 bp, Human; identical to SEQ ID NO: 24347

SEQ ID NO: 32365 - DNA, 601 bp, Human; identical to SEQ ID NO: 24348

SEQ ID NO: 32366 - DNA, 601 bp, Human; identical to SEQ ID NO: 24349

SEQ ID NO: 32367 - DNA, 601 bp, Human; identical to SEQ ID NO: 24350

SEQ ID NO: 32368 - DNA, 601 bp, Human
ctttatcctaaggaaagacattgggttttatgagtgaattaaaaataagtatttatatgattaagcatttctaaatgctaagcattgtatactggcgtgagacactgtttttatctttgaaaaaactcacaacttagtgggagagttaggcatgagattaatttcagcaaatgtaagtgcggtaatgaaaacccagaggctgcagggacatactctgtatgtgctgggagtgggaaagggacatactctgtacgtgctgggtggcaggggcaggggaggccccaccctctgcgtgggactstaacaggacaacaccctcttatgtggtctgtccagaactccctgtgaacctgctctttctttggaaagagctgttgaacaatctttgttaacagtcaaccgcagggaccagcaagatgtaaagcccaacaaaggcactgaggaagagttcaggcagacagcatttcctcagaagaccctggtataggatcctctaatatccctggccaattggagatgagggcggcggtatcctctcagaaaatgtcctgacagcaaaaacatactccttgagggaggggagcccattgcccgtgctatt

SEQ ID NO: 32369 - DNA, 601 bp, Human
ggcaggggaggccccaccctctgcgtgggactctaacaggacaacaccctcttatgtggtctgtccagaactccctgtgaacctgctctttctttggaaagagctgttgaacaatctttgttaacagtcaaccgcagggaccagcaagatgtaaagcccaacaaaggcactgaggaagagttcaggcagacagcatttcctcagaagaccctggtataggatcctctaatatccctggccaattggagatgagggcggcggtatcctctcagaaaatgtcctgacagcaaaaacatactcyttgagggaggggagcccattgcccgtgctattagttagggtatcgtttcagcttgtgtataatcactcaacagactctttaaaatatacttttatgtctcgtgtaaaaattcaagagtaaagagttcaaggcctgttcgttttcttcttgctggttactcccttgggatgtcacttttgtccccatggctgaagatgttgtgccatcacctccacatcttgccaacagaaagcaggaggtgaaggagaggctaggaccgttcctttcaaggggcacacgtcacttctgcttattgctcca

SEQ ID NO: 32370 - DNA, 601 bp, Human
agtctgggggctgacacacccaccgagcatagccctctagtgtgctgacatctagtgggaaggaggaggagttgatgaatctgaacaagactccaatattggaggaaatacttgaggaaagccttgggttagaaagttagggatagaattcctgctcatacggctgtccacaacaggttagtaggggaggactttaatctctgccatagaactccatttgtaactctagcatggggttatgacattgccttgtaattggctatttactttttgcctcttcgacccctccgctttcccctaygtatgaaccacaacagagaatatttctaactcatcttcatatctccagtgcctagcacagtgcctggcacatggtagtcactcaattgtgttgcattaggacttggtcccattgtctgccattgagttgcttggagactagaattcaacttctccaagattcactagctctattttacacccagacatgttggaaatctgtgatgtaacacaatgtatatccatttttatttaatacatattttcttctatattttgatttcattatatatttgtatatcaaaaacaaaatgtttagtct

SEQ ID NO: 32371 - DNA, 601 bp, Human
gagttgatgaatctgaacaagactccaatattggaggaaatacttgaggaaagccttgggttagaaagttagggatagaattcctgctcatacggctgtccacaacaggttagtaggggaggactttaatctctgccatagaactccatttgtaactctagcatggggttatgacattgccttgtaattggctatttactttttgcctcttcgacccctccgctttcccctacgtatgaaccacaacagagaatatttctaactcatcttcatatctccagtgcctagcacagtgcctggyacatggtagtcactcaattgtgttgcattaggacttggtcccattgtctgccattgagttgcttggagactagaattcaacttctccaagattcactagctctattttacacccagacatgttggaaatctgtgatgtaacacaatgtatatccatttttatttaatacatattttcttctatattttgatttcattatatatttgtatatcaaaaacaaaatgtttagtctttcaagaagtaaagctatacaaactcaatatgttggtactcatttcctaactataattattagtttga

SEQ ID NO: 32372 - DNA, 601 bp, Human
gctttttgtagcaacaggaagtgggaaatgatttgtaataaactgaacagtggtttttatattaaccagttttacatcttcacttggaagttcaaggacaaaatacttttgattcttggagaatttcatggcccttgctctcagctcagtttacactcatgtgtcagggcactgtgtttttcaatgcatggtcagtggtcacctgcactggaatactttggggttcttgctaaaaggcagattctgggatcatctctggtggtgggattcaggaatctatattttaaaatgtacacccagktttaatgtaaatacagagaactggcagtgaaccggtagagtggatcatactcttaacctatggtgagtgagaggcttaaaaaaaaaagaaaaagaaaaaaatggtaattgacaagggcagttttatttttttttcccaatcagtacaccttttatatccttttccagtttattgcattagttatttgcaacttccagtatgatgctgaaaaggagtggtgagacaggacatccttgccttgttcctgatcttagcagaaaagcttcaagtatgatgttaactgttgattttttgtaccta

SEQ ID NO: 32373 - DNA, 601 bp, Human
acagtggtttttatattaaccagttttacatcttcacttggaagttcaaggacaaaatacttttgattcttggagaatttcatggcccttgctctcagctcagtttacactcatgtgtcagggcactgtgtttttcaatgcatggtcagtggtcacctgcactggaatactttggggttcttgctaaaaggcagattctgggatcatctctggtggtgggattcaggaatctatattttaaaatgtacacccagttttaatgtaaatacagagaactggcagtgaaccggtagagtggatyatactcttaacctatggtgagtgagaggcttaaaaaaaaaagaaaaagaaaaaaatggtaattgacaagggcagttttatttttttttcccaatcagtacaccttttatatccttttccagtttattgcattagttatttgcaacttccagtatgatgctgaaaaggagtggtgagacaggacatccttgccttgttcctgatcttagcagaaaagcttcaagtatgatgttaactgttgattttttgtacctagatattcttcagcaaacttgagtaagtttccctttatccctcgttt

SEQ ID NO: 32374 - DNA, 601 bp, Human
atgttgcccaggctggtctcaaactcctgagcacaagcaatccacctgcctcagcctcccaaagtgctgggattacaggcgtgagccaccacgcctggcctgatttctcaatattgaaccaggtttgcatacctgggataaatcctattttgtcatggtatgtaattccttttatacattgttagtttgacttgctaatattttgttgagattttttgcatctgtattcatgagtgatattgagctgtagttttctctttttgcaatatctgtctggtattagggtaatgctggcctcatagcaatgagttacaaagtattccctttgcttctatcttctgaaagaggttatagagaattggtataatatctttcttaaatgtttggtagaactcaccactgaactcatctgggtctggtgctttctgttttggaaagttattattgattcaatttttataatagatataaatctcttcagatggtctagttcttcttgcgtggattttgacagattgtgtctttcaaagaattgttacattcacctaggttttcaaatttgtgagcatagttcatagtattccttgcttatccttttcat

SEQ ID NO: 32375 - DNA, 601 bp, Human
aggttttcaaatttgtgagcatagttcatagtattccttgcttatccttttcatgtccattattatttctgataatagtagtttgtgcctttttatttcttagcctagctaaaggcttatcaattttattgatcttttcccagaatcagcatttggtttcattgatttactctactgacttttttttctttctttctttccttttttttttctagagacagggtctcattctgtcatccagactggagtgcagtggcacaatcatagctcactgttaccttgaactcctgggctcaagcamtccaatcctcctggctcagcctcctgagtagctaggactacagctagctaccatagtagctaggattatagcatgtgcctccaggtctgattaattttcttttttttttttttaatttgtagagacagagtctcactatgttgctctggttggtctcaaactcctggcttcaagcagtcctcctgccttgccctcccaaagtactggcattataggcatgagccattgtgctctgctgatttcttgttttcaatttcattgatttctgctctaatttttatttttccgcttactttggat

SEQ ID NO: 32376 - DNA, 601 bp, Human
ctggttaatgttctgagcttgagaagaaagtgtattctgttgtcgttggatgaagtagcctacagatgtctattatatctagttaatcgaagattttgttgagttccactctgtcacagtatataattccttttatatattgttaggtttgatttgctaatatgttgttgagtttttttgcatctatatttatgagagataacgaattgtcattttcttttcttgtaatatctttgtttttgatattagggtaatgttggcctcatacaatgagttagtccttactgattttttacctgcyggctttgtgttatttctgatagagagatgttgaagcctccaactgtaactccaacttcatagtggatgcaactatttttccttgcagttctatcagtttttatctcatgtattttgatgctgtgttcttaggtacatgcaatgttaggtgttcttatgtcttcttggagaatgaacacctttatcgttatgtaatatccctctttatccctgataactttccttgaaatctccttctgaaactaatataggaactcctactttcttttcattagtgttagcatggtatatctttttctat

SEQ ID NO: 32377 - DNA, 601 bp, Human
ctctttaaaatattttgcagtttttttctttctgttaacattcctttcccttgtatcattgctgttattaatttcaagtatatataagcatacctaattaaatacattgttgctattattcatttttgaacaaactattatctgttaaatcaactaagaataagacaaatatgttgggtgcagtggtgcatgcctatagtctcagctactcagaggctgaggcaggaggattgcttgagctcaggagtttaagaccagcctaggcaacttagcaagatcatgtctcttaaaaaaaaaaaaagaaagaaagaaaaacaaagttttaggaggctgaggcaggagtatcacttgaacccaggacgcagaggttgcagtgagccgagatcgtgccattatactccagcctgggcaacagagtgagactctgtctcaaaaaaaaaaaaagaaaagaaaagaaaagaaaaaaaaagtttttattttaccttcacttattccttcttggatgttcttcctttatgtaggtacaaggttctgacctatgttattttctttttctctaaagaacttcaaaagtttcctgcaaggcaggtctactggcaat

SEQ ID NO: 32378 - DNA, 601 bp, Human
gttaaatcaactaagaataagacaaatatgttgggtgcagtggtgcatgcctatagtctcagctactcagaggctgaggcaggaggattgcttgagctcaggagtttaagaccagcctaggcaacttagcaagatcatgtctcttaaaaaaaaaaaaagaaagaaagaaaaacaaagttttaggaggctgaggcaggagtatcacttgaacccaggacgcagaggttgcagtgagccgagatcgtgccattatactccagcctgggcaacagagtgagactctgtctcaaaaaaaaaaaaagaaaagaaaagaaaagaaaaaaaaagtttttattttaccttcacttattccttcttggatgttcttcctttatgtaggtacaaggttctgacctatgttattttctttttctctaaagaacttcaaaagtttcctgcaaggcaggtctactggcaatgaattccctcaatttttgcttgacaaagtctttatttctgcttcactattgatggataatttcacaagagtgttccttttgtagattcactcttcttatccttcccttcagaaatattctttgaccaactattgggtcccagg

SEQ ID NO: 32379 - DNA, 601 bp, Human
cactccagcctgggagacaagagcaaaactccatctcaaaaataaataaataaaataaaattacataagtggcttgtaccatatttctattggacagcactagtacatatacaacacagcataatggttgagagcactgactctggagccaaattactgtgtttgattcttagctccacaacttactagttgtgtgaccatgggcaagcgagttaacctctctgtgccccagtttcccattctgtaacatgaaaataataaaaacactcccagaattgttgtgagcattaaatgaagcccygacacatttgttctggatacaatatcctcttgttttatatttggtagtatcaatgtgcctttagacacaattacaacgatctctgtggtaaagatgcaatgtatatggtgtctataaatagcattcaatgattcgttagttagggcttgagacttttactgtcatggaaaatctaggtatagctaagcttttgagattttgggaactccttaaccctatttttctctactcttgcccccaacaatcagcctatatacttgtgaaatttaacaattacttcactgggcagaaattatatgg

SEQ ID NO: 32380 - DNA, 601 bp, Human
agtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggktaagacaaagggttgactggcctatttatctgatcaagaacatgtcagcaatgtctctttgtgctctaaaattctattatactacaataatatattgtaaagatcctatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtt

SEQ ID NO: 32381 - DNA, 601 bp, Human
gtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggttaagacaaagggttgactggcctatttatctgatcaagaacatgtcagcaatgtctctttgtgctctaaaattctattatactacaataatatattgtaaagatccyatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtttctccatgttggtcaggctggtctcaaactcctgacctcaggtgatctgcccgcctcagcctcccaaagtgctggaattacaggcgtgagccaccacgcctggctgg

SEQ ID NO: 32382 - DNA, 601 bp, Human
gagagagagagtgagagagaaagagcaggggtacggggggcaatgactactaccacaataagcccacccctacatttaaggatgttagtcttctaagcacttgacctatatcatctcatttaattctcacaatcacctattgaggaaattactgtaattcccattttacggatgagaaaacagtttccggaaagtgaagtgacttacccccagagttacccagctcataagggctttggagctgggatttatccagttctacatgacctgaatactgtgttttctccagcacatgctgagycgactgcccccaatagaactgtcttttttttgcccatgaagaaaaggaggctcagagaagtgacttacccaaagtcacacaaggagaaaatagcagggtcacgatcagaatccagttcatctgtctccaaagcaaatgttcccactataccaaatcaaggtctccttccctaagccctgccaacgacccctcacacgcaggagcagggcagactagctcacagtctggcctctgaggtcctctctccctcctctcggcctcagctgacttactggcagagtggggtcctgggagagctgc

SEQ ID NO: 32383 - DNA, 601 bp, Human
gtctgcagggtaggcagctgggttccagttctgccactggccaaccccaactattgtgatgatcaggcaaagaatggtggcgaaggtgccctgcatcctcactgtccttcccagctgacacagtgaccctcgcagggctgagcatcccaggtgaggtgtgctcagtggggaggccccaagcctgcagacaagtggcctgggcaagaggaggcaggagagtcggactctcaggagtccaactcagaaaagtgccaaagaatgtgtgtgtgtgtgtgtgtgtgtgtgtgtgtgtgtgtgtgtgagagagagagagagagtgagagagaaagagcaggggtacggggggcaatgactactaccacaataagcccacccctacatttaaggatgttagtcttctaagcacttgacctatatcatctcatttaattctcacaatcacctattgaggaaattactgtaattcccattttacggatgagaaaacagtttccggaaagtgaagtgacttacccccagagttacccagctcataagggctttggagctgggatttatccagttctacatgacctgaatactgtgttttctccagcacatg

SEQ ID NO: 32384 - DNA, 601 bp, Human
ccgcccccagcttctgtctccgccaacccgttctgacccactcactgctaaatgcctgacaactgctcaaaagctctactctgacaatgaggcagcttggcttaaacttctccacggtgaagtccaggatccccagcagggccttcgaggctgtttgtagcccctgccaacctgtcccccacctcccaccccagcccacatgcagtgaccacagctgaccactgcccatcatgcgctcccacacccactgctggggcctgctccctgagctggttatgccatccccaaccagatccacacrtgaactcttcacactgagcttcagggcctcctccaccagggagccctccctgactgtgcttcctctcagagctttgccccgctgaattgtggctgtgtgtgtgaggacctgctagacagcgagctcagagcaaacagggactggtttggtggatgtgcatgccttggacctgactagcaagtcaatttttcctaatgaatgagtcccagacatcatcagtttagtaaaggtctgaggcactgaatcaatcacttctctaggaggaaagaaaatgcataattgatattttcaaaatatagt

SEQ ID NO: 32385 - DNA, 601 bp, Human
tcttgttcttccacagatgtgccttctgggaccaaaattcttcctgtgcaaatgcaggtctccctcttctcttccaggcctccaggaaccccagcctttcccagaaaaaggtctgacttccacaatcaccgggctcaggctcaccgcccccagcttctgtctccgccaacccgttctgacccactcactgctaaatgcctgacaactgctcaaaagctctactctgacaatgaggcagcttggcttaaacttctccacggtgaagtccaggatccccagcagggccttcgaggctgtttgyagcccctgccaacctgtcccccacctcccaccccagcccacatgcagtgaccacagctgaccactgcccatcatgcgctcccacacccactgctggggcctgctccctgagctggttatgccatccccaaccagatccacacatgaactcttcacactgagcttcagggcctcctccaccagggagccctccctgactgtgcttcctctcagagctttgccccgctgaattgtggctgtgtgtgtgaggacctgctagacagcgagctcagagcaaacagggactggtttggtggatgtg

SEQ ID NO: 32386 - DNA, 601 bp, Human
gtggcagggggcccaggccaccagcactcagcgcagtggccatcgccagccggttgtgagccaggctgaggtgctccaggtgggtcagggcctggaaggctcctggctggaggaagctgatctcattggtgctcaggtccaggtgacgaagtgccgtgtagaagcccaggggtgaggccaggatactccgcagctggttcccagatagatcaagggtctcagtgtctggcgggagcaccgaggggacctggagcaggcccagaacctggcacgagaccttcttgtccacctggggaggggyagggtggggagacagctggcataagtgggcacggtaggggatgaaaccagacatgtttatccaggaaccctgcctggctggggaacccttctcccatggactcccagaatgctcaactttcccccaccgcagcctgatcaccccatgcctggatgacccatccggctccctgccccatctcgggcacccagcgcagtaatgggcattaaggaaggaactcgatgaaggttccatgggtggacagatggagagatgatagacagatagaaggacaaataaactaacaaagagaaaccctgt

SEQ ID NO: 32387 - DNA, 601 bp, Human
aggcatgtcccggaaggtgtggcgggtgaggcgagtcagactgttctccgccagtgagagggtatgcaggctgggtgcctcccccagcagccgctccagcaggccgctgtacaggctgttcccagacaggtccagggaggtcacgcgtggcagggggcccaggccaccagcactcagcgcagtggccatcgccagccggttgtgagccaggctgaggtgctccaggtgggtcagggcctggaaggctcctggctggaggaagctgatctcattggtgctcaggtccaggtgacgaagtgcygtgtagaagcccaggggtgaggccaggatactccgcagctggttcccagatagatcaagggtctcagtgtctggcgggagcaccgaggggacctggagcaggcccagaacctggcacgagaccttcttgtccacctggggaggggtagggtggggagacagctggcataagtgggcacggtaggggatgaaaccagacatgtttatccaggaaccctgcctggctggggaacccttctcccatggactcccagaatgctcaactttcccccaccgcagcctgatcaccccatgcctggat

SEQ ID NO: 32388 - DNA, 601 bp, Human
caacatgagagtgccaggaagggagagggcaagtccagagcaggagacggaatggtccagtgctgggctggaccccttaaccagaccctgctggagccgccgtggcccacctaacaacaccagatccgagacacactcgtacagctccaattctctcttccggtcctaagcttttcattttcagagagactgaaagtcattctcagaagacgtgacaaacagtctgcttggaaatgtctcagacaaatcctcctgggcttggccctccctcaccctggcacagccggggcaggactcaccrcaccaaaccagcggggcctgccgagctctggagccctgggctttcacacctcaggccctaagcacactgcgtggcggccacgtggctctgcagcactctctcctaccagactgggagattcttgagggcgggaatgtatctcatttcccagcattcccagtgcccagagcagggtgtggcacaaaatacatgctcagtgaagatttgttgatctgacaggtcaacattattctcggctgtccctgaaaccgcccaacttctggcttccacagctggacccaaagtgcagcccgggaaggg

SEQ ID NO: 32389 - DNA, 601 bp, Human
gcaggtgtgcacagcacaggatgcttccagaccctgctcgggctatgtggggccacttcctgtccacttaacggcctgcagcccctgcagtggtaaagatcaggccctggagacagaaggatgaaggtttgaatctcacctatggcattagttagctggggccctggaaggagattttcagaacttcagtttcctcttttataaaacggggataaaatatagagctgtcacataggggcagacacaaggcttggattcaaatccacatctgccaagctgggtgcaaaacagaaccagatakctaaggttttagctcctggctcagcagccaaggtggggctgcgatggagaagtggggctgggcagggacggtgcttagagcagcactggggtcagggtatgcaacatgagagtgccaggaagggagagggcaagtccagagcaggagacggaatggtccagtgctgggctggaccccttaaccagaccctgctggagccgccgtggcccacctaacaacaccagatccgagacacactcgtacagctccaattctctcttccggtcctaagcttttcattttcagagagactgaaagtca

SEQ ID NO: 32390 - DNA, 601 bp, Human
ggaaaggaagagaggagggaaacaggcagagaaggaggagagcgcctgcagctgcctgcctgggagagaggagagagcaggtgtgcacagcacaggatgcttccagaccctgctcgggctatgtggggccacttcctgtccacttaacggcctgcagcccctgcagtggtaaagatcaggccctggagacagaaggatgaaggtttgaatctcacctatggcattagttagctggggccctggaaggagattttcagaacttcagtttcctcttttataaaacggggataaaatatagagmtgtcacataggggcagacacaaggcttggattcaaatccacatctgccaagctgggtgcaaaacagaaccagatatctaaggttttagctcctggctcagcagccaaggtggggctgcgatggagaagtggggctgggcagggacggtgcttagagcagcactggggtcagggtatgcaacatgagagtgccaggaagggagagggcaagtccagagcaggagacggaatggtccagtgctgggctggaccccttaaccagaccctgctggagccgccgtggcccacctaacaacaccag

SEQ ID NO: 32391 - DNA, 601 bp, Human
gcacagaaaggaagtttggagccagcattatcttgtgatgtgatagctgagagaggacatcactctggtccaacccccaatctcaccccacaaataagggctcttttttcccccagaggctctgtataagctctccacaagtttcattctcttcctaagcctcagtttccccatctgtgcaatggggaggttggattccatagtctcaaactccaggctctgctcaatagaggaaaagggaatgagagaatgcaagagcacagagagaacaggagaacccacaccagggtggaaaggaagrgaggagggaaacaggcagagaaggaggagagcgcctgcagctgcctgcctgggagagaggagagagcaggtgtgcacagcacaggatgcttccagaccctgctcgggctatgtggggccacttcctgtccacttaacggcctgcagcccctgcagtggtaaagatcaggccctggagacagaaggatgaaggtttgaatctcacctatggcattagttagctggggccctggaaggagattttcagaacttcagtttcctcttttataaaacggggataaaatatagagctgtcacatag

SEQ ID NO: 32392 - DNA, 601 bp, Human
tgagggatgggggtcatctgggtgaggccttttacctgtttttgtaagagggaaaaaagatccttgcatgatgaggcacagaaaggaagtttggagccagcattatcttgtgatgtgatagctgagagaggacatcactctggtccaacccccaatctcaccccacaaataagggctcttttttcccccagaggctctgtataagctctccacaagtttcattctcttcctaagcctcagtttccccatctgtgcaatggggaggttggattccatagtctcaaactccaggctctgctcmatagaggaaaagggaatgagagaatgcaagagcacagagagaacaggagaacccacaccagggtggaaaggaagagaggagggaaacaggcagagaaggaggagagcgcctgcagctgcctgcctgggagagaggagagagcaggtgtgcacagcacaggatgcttccagaccctgctcgggctatgtggggccacttcctgtccacttaacggcctgcagcccctgcagtggtaaagatcaggccctggagacagaaggatgaaggtttgaatctcacctatggcattagttagctggg

SEQ ID NO: 32393 - DNA, 601 bp, Human
cgggggcgaaggactcggggagccgcgccgggaggagggtcgggccgatctcagcccctcctcgcccccaggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaayctgcggacgctgcgcggctactacaatcagagcgaggccggtgagtgaccccggccaggggagcaggtcacgacccctccccatcccccacggacggcgcgggtcccctcgaatcttcgggtcccagattcaccccaaggctgcggaacccgcccagaccctagaccggggagagtctcaggcgcctttacccggttctttttcagtttaggccaaaatgcccacagggtggtggcgacgggggcggggcttggtgggcgggactgactaaggggcggggccagggtctcacaccctgca

SEQ ID NO: 32394 - DNA, 601 bp, Human
gacgattgtggtgatggggacctgatcccagcagtcacaggtcacaggggaaggtccctgctgaagacagacctcagaagggcagttgatccaggacccacacctgctttcttcacgtttcctgatcctgccctgggtctgcagtcacagttcaggaaacttctctgggatccaaaactaggaggttcctctaggaccttatggccctgcctcctccctggcccctcacaggacattttcttccaacaggtggaaaaggagggagctactctaaggctgagtgtaagtgcggggcgggagygtggaggagctcgcccaccctataattcctcctgcaccacatctcctgtgggctctgaccaggtcttgtttttgttctaccccagggagcgacagtgcccaggggtctgagtctcacagcttgtaaaggtgagattctgggggtctgaagtgggtggagggtggggcagaggggacaggactgggttgtggggattttttgattcagaatttttgagtgtgtggtgggctgttcagagtgtcatcacttaccgtgactgacctgaatttgttcatgactattttcttctgtagcctgaga

SEQ ID NO: 32395 - DNA, 601 bp, Human
cctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattraaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggat

SEQ ID NO: 32396 - DNA, 601 bp, Human
gtcaggctcggcctcttactctgagcctgaaggcctggggctgactgaggggaggggagcgtgaccattagctcgccttagactgcccctggaggagaggcggcagggaggtggttgggctcgcgggagcccggggccagggaggcctccgtggtagcggcgacggcggcgtcggactggcgggcaggaggaggccgtttcccgccgtgggcttgtcgctgagggctaacgggaggatctcggccctgctcgtgggggttcagctgctgcgctcgctgactcgcggggtgttgggcctggracgcttcctgacgctctgctgcttgcctctgccgtctgtctgtctcccgctccagtggccctctcacccttcactgtaacacgccgtataggtcacccctatcagaaccggacgccccccaagaagaagaagccgcgcacgtccttcacacgcctgcagatctgcgagctggagaagcgcttccaccgccagaagtacctggcctcggccgagcgcgccgccctggccaaggcgctcaaaatgaccgatgcgcaggtcaaaacctggttccagaaccggcggacaaagtggaggtgagca

SEQ ID NO: 32397 - DNA, 601 bp, Human
agggtggaggggcggcagtaaatggaataagtgagtcatcgcctccctgaactgcctcagaggaagccagtgggtccagcaggagccccggtagggcacagggctccacacagaaggcccaagtcctagaagacattcgcagagagagggaggaaagagacgtcccgcagagcagatcgtacccgctggtccttgcctctctgccctggacttgtgggtagggtgagggccctctggcttggaatggcacctggtctccctcagggccggggagggggaggcgagatgccatcctaccccrgctgccccttgtgaggcctccggggtgtgggcgctgcgcgtggatgcgagtcccagctgtttgggcctcgcagactttcccatcgctcctcctctgggataccttggctccatccgctttggggtttccagtctttgttggagtcaggactctcaaaagaagggaacgcgttataggggcccaaactggatttggggactgcaaaggcgagcagcgctcgttcagtttatctcctgggaacgcaccaggagttgggcacacgcgggagctgggtcggtgctcctggcaggtaacggcttg

SEQ ID NO: 32398 - DNA, 601 bp, Human
ggctgtcatctgaatttgccctgggaaaccccttctctgtgacccacttctcatcacacacatggaaacccataggcccacacacaggtggtgtcactgtccctcctggtgtcaccccagagccacacatgggcatctatgggagagtgtcaaccagacagagggtcacagtgtttacactttggaccttacgatcaggcacaggtcaggggtgacacagactcatcctgaacagcatggcactccctccagcacaaacacaaggtcatggccacactgtgacacactacaccacacacarcagccaacagctacaacagcctcacttggtctgccaggcccccaccacacatcccagcccaatccaggtacgcacagacaggttttcacataaatgcagcccatttctccagaacccatttgaggggtgggggggtgttaatttatgcacttataaggtgttttctgtgtaaccattttataaagtgcttgtgtaatttatgtgaaaaaaataaataaaagcctccggatccggagtcagggctgcctgctccttgcggaccctagcgtccttcagctacttgggtttggtgtgtgagct

SEQ ID NO: 32399 - DNA, 601 bp, Human
atgtggcacccgccagagatgctggtctactcctgggaatttgaagcacacccccactggctcaaagttcctgctccccctccccacctcaggggtacgggtacctctttggacttggagaagaaagctcgtttaacttcctcagtgctggcaccaggatgcacccccaacagttcataataagtactgggtctggacctgtggacagagtcccaaaccttgcaggggctgaaggaacccagaagctagctctgccctgccttctgggccacacccttcaactcagccaccaggagctgasagggctgaaacaggtcccaggacagatctgtctccagatcagcaccccctttggagtgtttcaggcatagtgcaggtcaggatttctcaaagtggagtccaaaaacttgttggaaaaaactgattcctggacaggcgcggtggctcacgcctgtaatccagcattttgggaggccgaggagggcggatcacctgaggtcgggagttcaagaccagcctgactaacatggagaaaccctgtctctcctaaaaatacaaaattagccgggcgtggtggtgcatgcccgtaatcccagctact

SEQ ID NO: 32400 - DNA, 601 bp, Human
aagctaaaaacactggtgggaggagtctccacattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgrggtgagtactgttcctgattttgtaaatatgatcttgttccttccttgaagtccccagaatcacaaggggacaatcagtattggttattcagggtcatgggatgatgggagtagggctgagtattcagaaaagtgaaaactgagttgcttgatatgaatccttcatttacttaggaagataacaggcatcttctattccaccacaactgaggactgaacaagagaaaatgcattttgaccgttgcagattttaaaattaattatccgagtgtatattggcataagttggtacttagaaga

SEQ ID NO: 32401 - DNA, 601 bp, Human
ttggccgggcacagaggttcatgcctgtaatcccagtacttttgggggagaccaaggcgagcggatcacttgacgtcaggagttccagaccagcctggccagcatggcgaaaccctgtctctattaaaaatacaataattagccgggtatggtcatgtgtgcctgtaatcccagctactcaggagactgaggcaggagaatcgcttgaaccaggaggcagaggttgcagtgagccgagactgtgccactacactccagcctgggtgacagagcaaggctctgtctcaaaaaaaaaaaaaawtttttttctttgtagtgctctcacaatcacatacatgttatgtgtatatataatatacattcacacacaaatatatgtatatataatcatgtatacaaacaggtacacacatatatgtgtgtagtgatgtctgtacatgtgtgtatatgaagagaaatatatactaattatagtaccatgaagcactataaaataataaataatatcattagataaattagataaattcataactaaaacataattttctaggagttgaaacttttatcattatgtggtatctgaagttacttttgggct

SEQ ID NO: 32402 - DNA, 601 bp, Human
aatctgctgtctttacttcaatttatgacacttctatatcatctcactatctaagacaattgctttagtgaattgtcatgttctttttcttccctccctttaccatgctgttgtaatttctgtttctcttatctttgatcagggttttctttgtaagacattaggaacacctaaaaaagtttatttttcactcttcttatcttttggctggcagaatttttaattttattcattgttttcctattaaatattattttcaatagatgttttcttgtggtatgagtctttgtcttgcaaaaakactgaggccctgagtatcacaaaatagtttttgagactcttctatttaaatatcattttgcctaaattaaaactctaaaatgtaaaattatattttcccttaagacaagatgaaagcacctcttctgtgctgtggagctagatacattttgaagttaagaatctggaggcttcagaaaggctatttagtgtatatattctaaatagtgtcttactagaaactccattgggatataaataattactccaaaatcaaaagcactaatattgcaaaacaaaacatgtgagtgttcacatttca

SEQ ID NO: 32403 - DNA, 601 bp, Human
tcattcctaaaattaaaaaattcattaatttaaaagttttggaatccataccttgcactgtcatcatggaagtgtacaggtgttaagaggtcaagagcagtgacactctgtccatagggagactctgaaatctaccaggagacaaagcctcagttgagtcttaaggttgtatgggaagtagtcaaagaaagaaatgtgggaatggctttccaggcagtaagaaggaactagcaaagtcatgaggcatgaagacacaaggtgtccggcatctttgtgaagcatagatacaaggagtacaaargtactagaagtaaaaaagatgcagcttattcaacactttctgagacagtataggaagcaaggaattttggggaagaaaaaggagaaatattgaaggatttcagtggaatataaatgtggcttatcgagagaaaactgattgtgcgaaaagaaataattagacaaatcaagtctgaaagaagaaaaataaaacaaccaataaaatcatttcagtgaataaatactgtgatgctgcactagaaagcatgcagattttcagcaaagttatggttttatgggtacagagaacagaagccatggt

SEQ ID NO: 32404 - DNA, 601 bp, Human
ctttccaggcagtaagaaggaactagcaaagtcatgaggcatgaagacacaaggtgtccggcatctttgtgaagcatagatacaaggagtacaaaggtactagaagtaaaaaagatgcagcttattcaacactttctgagacagtataggaagcaaggaattttggggaagaaaaaggagaaatattgaaggatttcagtggaatataaatgtggcttatcgagagaaaactgattgtgcgaaaagaaataattagacaaatcaagtctgaaagaagaaaaataaaacaaccaataaaatmatttcagtgaataaatactgtgatgctgcactagaaagcatgcagattttcagcaaagttatggttttatgggtacagagaacagaagccatggtctagcaccaaagaagggaggatgctaatgaaagccaactagggaagagtcaaggagaatagggtcagtgccacagcatgaaactgtagcgctgtagcagaaagttattcatataaggtgggaggctgcagcccatttacacctaggccgctccagtcatactgggtgtgggaagatttaagaaacaacaggcaggatttggggaa

SEQ ID NO: 32405 - DNA, 601 bp, Human
gcatgcagattttcagcaaagttatggttttatgggtacagagaacagaagccatggtctagcaccaaagaagggaggatgctaatgaaagccaactagggaagagtcaaggagaatagggtcagtgccacagcatgaaactgtagcgctgtagcagaaagttattcatataaggtgggaggctgcagcccatttacacctaggccgctccagtcatactgggtgtgggaagatttaagaaacaacaggcaggatttggggaataggcttcagccccagtaaaggataagaagaggaaccwagggctttgacactgcagagctcatactcttaacactgaggcaattgcttgttctcagacctccctctaacaactggacccaactcaactattctcattcaatgggaataatttcttagacattcctaacccagcagttcttcactcaatttctacagtaacacatttggtcgttgagtccttctttatcacacatattcatgaacaactctttcatatgggccactcactcacataggcatacatcttttaaattgtctgtatacatgtgtaacactgtatataccattttctcttgta

SEQ ID NO: 32406 - DNA, 601 bp, Human
agagaacagaagccatggtctagcaccaaagaagggaggatgctaatgaaagccaactagggaagagtcaaggagaatagggtcagtgccacagcatgaaactgtagcgctgtagcagaaagttattcatataaggtgggaggctgcagcccatttacacctaggccgctccagtcatactgggtgtgggaagatttaagaaacaacaggcaggatttggggaataggcttcagccccagtaaaggataagaagaggaaccaagggctttgacactgcagagctcatactcttaacactgcggcaattgcttgttctcagacctccctctaacaactggacccaactcaactattctcattcaatgggaataatttcttagacattcctaacccagcagttcttcactcaatttctacagtaacacatttggtcgttgagtccttctttatcacacatattcatgaacaactctttcatatgggccactcactcacataggcatacatcttttaaattgtctgtatacatgtgtaacactgtatataccattttctcttgtaggctcacttatgtctgtaaagatgggaaaaaaatacaag

SEQ ID NO: 32407 - DNA, 601 bp, Human
ggtgggaggctgcagcccatttacacctaggccgctccagtcatactgggtgtgggaagatttaagaaacaacaggcaggatttggggaataggcttcagccccagtaaaggataagaagaggaaccaagggctttgacactgcagagctcatactcttaacactgaggcaattgcttgttctcagacctccctctaacaactggacccaactcaactattctcattcaatgggaataatttcttagacattcctaacccagcagttcttcactcaatttctacagtaacacatttggtcrttgagtccttctttatcacacatattcatgaacaactctttcatatgggccactcactcacataggcatacatcttttaaattgtctgtatacatgtgtaacactgtatataccattttctcttgtaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgactt

SEQ ID NO: 32408 - DNA, 601 bp, Human
cccaacattgattagagccccacctcggacatacttgagatgtgttttccccagtttgtgactcaacagctgagacaatgttggtacttcagaggccaacaagttgacaacttagtgcattccattactggtgtagattgaagtatttcagaatgtatatttgggatcagtgaaagaacaaaagtgagagggagttgaagggggactgagacttccagtacattagaaagattatataataataaaatcataaaaactgtttaaattcaagatatgtacatttagccaatgaatgtatctkttctattgagaccatttaacccatcactaccctttataatttaaaaaaatgcaatacttacatgtgagcctgcctctcagaagtgtgatctcctctcttgttatatcaagttaaaaaaaaggatttgaaaaagtctaagtccaaaatcagtatatccttcctcatggaaacctttggctggtttctataatttgaatatctttacctggggaatgtgacctagcagtctccatcatgaaaacattagtttttaaaacaaaatgatcggagaaccgcattgggaaagggttaactgaagca

SEQ ID NO: 32409 - DNA, 601 bp, Human
cccagtttgtgactcaacagctgagacaatgttggtacttcagaggccaacaagttgacaacttagtgcattccattactggtgtagattgaagtatttcagaatgtatatttgggatcagtgaaagaacaaaagtgagagggagttgaagggggactgagacttccagtacattagaaagattatataataataaaatcataaaaactgtttaaattcaagatatgtacatttagccaatgaatgtatctgttctattgagaccatttaacccatcactaccctttataatttaaaaaartgcaatacttacatgtgagcctgcctctcagaagtgtgatctcctctcttgttatatcaagttaaaaaaaaggatttgaaaaagtctaagtccaaaatcagtatatccttcctcatggaaacctttggctggtttctataatttgaatatctttacctggggaatgtgacctagcagtctccatcatgaaaacattagtttttaaaacaaaatgatcggagaaccgcattgggaaagggttaactgaagcacatggagttcagagaacaggaagcatgtgctcagtgcacaggggaggag

SEQ ID NO: 32410 - DNA, 601 bp, Human
attatataataataaaatcataaaaactgtttaaattcaagatatgtacatttagccaatgaatgtatctgttctattgagaccatttaacccatcactaccctttataatttaaaaaaatgcaatacttacatgtgagcctgcctctcagaagtgtgatctcctctcttgttatatcaagttaaaaaaaaggatttgaaaaagtctaagtccaaaatcagtatatccttcctcatggaaacctttggctggtttctataatttgaatatctttacctggggaatgtgacctagcagtctscatcatgaaaacattagtttttaaaacaaaatgatcggagaaccgcattgggaaagggttaactgaagcacatggagttcagagaacaggaagcatgtgctcagtgcacaggggaggagtgaggaaagtgctgaggagcatgagtcagtgcttgttcctgtcttgtgactgctggtctccttaaggccaggctgggctaatgcagtagagctagactaaagcacagctgaaccctcaagcaggaactgagagcaaattgtattgaaactgcttcagctgtcggagatcgtttatatgtct

SEQ ID NO: 32411 - DNA, 601 bp, Human
cggagaaccgcattgggaaagggttaactgaagcacatggagttcagagaacaggaagcatgtgctcagtgcacaggggaggagtgaggaaagtgctgaggagcatgagtcagtgcttgttcctgtcttgtgactgctggtctccttaaggccaggctgggctaatgcagtagagctagactaaagcacagctgaaccctcaagcaggaactgagagcaaattgtattgaaactgcttcagctgtcggagatcgtttatatgtcttccttttttctgcattggttgggaataaaattgaayctattccagtaaaaggaccagccctatcaagaaagaggaagaaggaagtggatgctacttcacctgcaccctccacaagcagcactgtcaaaactgaaggagcagaggcaactcctggagctcaggtaagcttcaggaagaggagcaggcttcaagtcccacagaggaagctctgctacggctcttccactcaatctctccagcaggcagttatttcttcatgtttcccatcaagtttcagatttaccaaattgtatgataattgatcatcttattgatgctcaaagcaatgcaccaaac

SEQ ID NO: 32412 - DNA, 601 bp, Human
gcagtagagctagactaaagcacagctgaaccctcaagcaggaactgagagcaaattgtattgaaactgcttcagctgtcggagatcgtttatatgtcttccttttttctgcattggttgggaataaaattgaatctattccagtaaaaggaccagccctatcaagaaagaggaagaaggaagtggatgctacttcacctgcaccctccacaagcagcactgtcaaaactgaaggagcagaggcaactcctggagctcaggtaagcttcaggaagaggagcaggcttcaagtcccacagargaagctctgctacggctcttccactcaatctctccagcaggcagttatttcttcatgtttcccatcaagtttcagatttaccaaattgtatgataattgatcatcttattgatgctcaaagcaatgcaccaaacacatgagtaaacataatgtaaatatatataacataaatgtgataccttcattctagtagagtggagtgtcaacgtgagaatcaggtaagtactttgtccatgtgtataaaaacctagtttctctaatcccaagtcagcacatcccataacagaaataattagagaa

SEQ ID NO: 32413 - DNA, 601 bp, Human
actaaagcacagctgaaccctcaagcaggaactgagagcaaattgtattgaaactgcttcagctgtcggagatcgtttatatgtcttccttttttctgcattggttgggaataaaattgaatctattccagtaaaaggaccagccctatcaagaaagaggaagaaggaagtggatgctacttcacctgcaccctccacaagcagcactgtcaaaactgaaggagcagaggcaactcctggagctcaggtaagcttcaggaagaggagcaggcttcaagtcccacagaggaagctctgctayggctcttccactcaatctctccagcaggcagttatttcttcatgtttcccatcaagtttcagatttaccaaattgtatgataattgatcatcttattgatgctcaaagcaatgcaccaaacacatgagtaaacataatgtaaatatatataacataaatgtgataccttcattctagtagagtggagtgtcaacgtgagaatcaggtaagtactttgtccatgtgtataaaaacctagtttctctaatcccaagtcagcacatcccataacagaaataattagagaaataatgtgtataa

SEQ ID NO: 32414 - DNA, 601 bp, Human
cttaaggatgattctgtttacagaaaggtcatcttttcactatatggtctcctctgttacttcatcttgctattgtaccagtttaagatatcttctgccctggctcgcaatccctctctatcctgactccagctctaaacatctgtgcaagttttggggccctgtgttgtactgaggtcactgaatagcagttctgtatttctcaattagacatttttctttgttctcctgtgctatcatacacagaacccgaaaacagtggccaaatgtcaggtaactcccagaagaaatgttctccaaraacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactc

SEQ ID NO: 32415 - DNA, 601 bp, Human
gtctctcagatcttctttcattaccctcagagtagctttataattatttccttaggtcctgtgcaccttgtgtcagggtactaatgtcatggctattgtaaggtgatttgatactgattaacttcattgggaacgggtttcctaatgttatggaaaattggccacattgatgagttttgtgtgtgatatgcgttattcctggttttgatttgaaaaccagaaggataacatttttatatttgatatcttctaccatgtctccctttaaataaacaacatacaatgatttgagatatgaacaggaataattgctattttttcctgaataacaattccaccagtattattattaccaatatgttcatcctctacattccagtttctttgcaatcctttctcttttgctctctcaccatacatcagaggttagtttcactatccatgctcttaaccacatcaagggttttgatacttcctttgatatcaaatttttccgtctcaattctgtccccaaataagttcaaccacgaggtaccagtctcatctattccttgagcaagttctcactaataccctcctcccagaatagatcatattttct

SEQ ID NO: 32416 - DNA, 601 bp, Human
gccaaggtgagtggatcatttgagcccaggagttcgagaccagcctgggcaacacagcgagacgctgtctctgtaaaaagtatacaccaaaaaaattaaccaggcatggtagtgtgcacctgcagtcccagctactcaaggggctaaggcaggaggatcacttgagcccaggtggtcaaggctgcaatgagttatgattaggccactgcactccagcctgggacacagagtgagaccctacctcagtaaataaataaataaataaataaataaataaataaataaataagtaaagtatacrgaaggatgtgcataggttatatgcaaatactttaccattttatatcaggaacttgagcatctttggattttggtatctgcagagggtcctggaaccattgccccgtaaatatggaaatgactgtatacattatattatgtatgtctatctattgtaaactacatacataagatactatactatgtatacctattagatacatacttgctttttattccttccttagttttttttctcattgaactccgggaggtggaaaaaatttagtgcatttcacagaagagaaaatctagaccagag

SEQ ID NO: 32417 - DNA, 601 bp, Human
taaatgaaataaatgttctaataatttatcaggttggggggggggcttcaaaatgcttaacaggtactttctcccatgtaccgaccaatctgaacggacacagacaccagccctgagaccatgctagggaagtgataatgttcagagaggcggctggctactccagggcaacttgaacctggtaagaatgggccagcaggtggtggggtggggactcccaagaccacaggcagggctgggtctttggcctggtggtggaggccatgggaggggccgctgtggatggggtcaggcagagccmtacataatcctcagccaacaatgaggaactgccccgaacctgagtctgcatccggatatggcgggtcctgaaaacagcactcactggttctgcaggcagctgcaaaggcaatgaagacataatgacattcctggccttgcactgtgtggggagaagggctcagccttggggtctacacccaagtgatcatcagccctcccacccacccactttcccatctatgcaccctcctaccaccacccatccatccatctgcccatgtatttatctgcccatctacccatccatccatgtatttat

SEQ ID NO: 32418 - DNA, 601 bp, Human
ccagttgcctatgtctagaactgtgtccgcacatagaagatgctcagtaaatcgttatcaaacaaaagaatggacagcgtgtctgcttagtgttcagacccttttcagggtgcattaggagcataaatgttccgacaatatggccgggcgcggtggctcattcctggaatcccagcactttgggaggctgaggcaggtggctcaccatcacctgagctcaggagttcaagaccagcctgggcgacatggtgaaacctggtctctactaaaaatacaaaaattagccgcgtgtggtggctarcacctgtaatcccagctacttggaaggctgaggctggagaatagcttgaacctggaaggtggaggtggcagtgagctgtgatcaggccactgcactccaacctgggcagcagaacaagactccgtctcaaaaataaataaatgaaataaatgttctaataatttatcaggttggggggggggcttcaaaatgcttaacaggtactttctcccatgtaccgaccaatctgaacggacacagacaccagccctgagaccatgctagggaagtgataatgttcagagaggcggctggctactc

SEQ ID NO: 32419 - DNA, 601 bp, Human
gccagttgcctatgtctagaactgtgtccgcacatagaagatgctcagtaaatcgttatcaaacaaaagaatggacagcgtgtctgcttagtgttcagacccttttcagggtgcattaggagcataaatgttccgacaatatggccgggcgcggtggctcattcctggaatcccagcactttgggaggctgaggcaggtggctcaccatcacctgagctcaggagttcaagaccagcctgggcgacatggtgaaacctggtctctactaaaaatacaaaaattagccgcgtgtggtggctracacctgtaatcccagctacttggaaggctgaggctggagaatagcttgaacctggaaggtggaggtggcagtgagctgtgatcaggccactgcactccaacctgggcagcagaacaagactccgtctcaaaaataaataaatgaaataaatgttctaataatttatcaggttggggggggggcttcaaaatgcttaacaggtactttctcccatgtaccgaccaatctgaacggacacagacaccagccctgagaccatgctagggaagtgataatgttcagagaggcggctggctact

SEQ ID NO: 32420 - DNA, 601 bp, Human
agccagttgcctatgtctagaactgtgtccgcacatagaagatgctcagtaaatcgttatcaaacaaaagaatggacagcgtgtctgcttagtgttcagacccttttcagggtgcattaggagcataaatgttccgacaatatggccgggcgcggtggctcattcctggaatcccagcactttgggaggctgaggcaggtggctcaccatcacctgagctcaggagttcaagaccagcctgggcgacatggtgaaacctggtctctactaaaaatacaaaaattagccgcgtgtggtggckaacacctgtaatcccagctacttggaaggctgaggctggagaatagcttgaacctggaaggtggaggtggcagtgagctgtgatcaggccactgcactccaacctgggcagcagaacaagactccgtctcaaaaataaataaatgaaataaatgttctaataatttatcaggttggggggggggcttcaaaatgcttaacaggtactttctcccatgtaccgaccaatctgaacggacacagacaccagccctgagaccatgctagggaagtgataatgttcagagaggcggctggctac

SEQ ID NO: 32421 - DNA, 601 bp, Human
gttgagctcatagccagttgcctatgtctagaactgtgtccgcacatagaagatgctcagtaaatcgttatcaaacaaaagaatggacagcgtgtctgcttagtgttcagacccttttcagggtgcattaggagcataaatgttccgacaatatggccgggcgcggtggctcattcctggaatcccagcactttgggaggctgaggcaggtggctcaccatcacctgagctcaggagttcaagaccagcctgggcgacatggtgaaacctggtctctactaaaaatacaaaaattagccgsgtgtggtggctaacacctgtaatcccagctacttggaaggctgaggctggagaatagcttgaacctggaaggtggaggtggcagtgagctgtgatcaggccactgcactccaacctgggcagcagaacaagactccgtctcaaaaataaataaatgaaataaatgttctaataatttatcaggttggggggggggcttcaaaatgcttaacaggtactttctcccatgtaccgaccaatctgaacggacacagacaccagccctgagaccatgctagggaagtgataatgttcagagagg

SEQ ID NO: 32422 - DNA, 601 bp, Human
caggtccctagggcccgaggccgagcctggaagagatcctgtaggcttgggaacagaccagagtctggaggggtcttcgtgcctaagacaaatctttgtgatgcttacatctttcagcgtcacctcagcctaaaccctccccgcgtccttcctacctcatcccctgccgtctctcacctcaacctattccgaatcctcagcctcctaacttgtcctcacagaggccagatgtcctgccacctctctctctatccctcaccctcctctggtgtttttttttggggggtccccagggccccarctttcctcctctggttcttcaaaacacatcatcacatttgtgatagacatttgtttgcctgttgtctatctcttccactaggctgtggtcttgggaagttagttgagctcatagccagttgcctatgtctagaactgtgtccgcacatagaagatgctcagtaaatcgttatcaaacaaaagaatggacagcgtgtctgcttagtgttcagacccttttcagggtgcattaggagcataaatgttccgacaatatggccgggcgcggtggctcattcctggaatcccagcactttgggag

SEQ ID NO: 32423 - DNA, 601 bp, Human
tcatgagaacagataataagaacccaaccaggtcttggcagcattatggctagcagagagaaaccagaagcaatctaagtgcccacgaataggggattggtaaggggaccatgaaagactgctttgtcacaatagtgtttgcgtgacactacgtgaagtgacaatggctagtagtatcaagtcccttgccaagggccaggaatcctctctagctccagccttgcagcctgatggcctctctgggtaaaaaacggacggggggagaacaaggtgctaacctgagttgtagagctgcagggtsacctcaggagacttctctgtctggttcctggcccaggattccacccagagtgtgacagtgtacagcacagacaccccagcctggtcggagaactgcagcctggtggctgagccggcggcgaagtagcagcagcgcccggagctaaggctgcagcaggaaggagggtgtcagtgccgagtctggggtcctagtggaccccacagccgactttgtgcatcacatcccagcatcgtttttttggtgtttgtttgtttgtttggagatggagtttcattctgtcacccaggctggagtgcagtc

SEQ ID NO: 32424 - DNA, 601 bp, Human
acaggcgtgatccaccgcacccggcaaaatacatgatgtcgagtcatgagaacagataataagaacccaaccaggtcttggcagcattatggctagcagagagaaaccagaagcaatctaagtgcccacgaataggggattggtaaggggaccatgaaagactgctttgtcacaatagtgtttgcgtgacactacgtgaagtgacaatggctagtagtatcaagtcccttgccaagggccaggaatcctctctagctccagccttgcagcctgatggcctctctgggtaaaaaacggacgkggggagaacaaggtgctaacctgagttgtagagctgcagggtcacctcaggagacttctctgtctggttcctggcccaggattccacccagagtgtgacagtgtacagcacagacaccccagcctggtcggagaactgcagcctggtggctgagccggcggcgaagtagcagcagcgcccggagctaaggctgcagcaggaaggagggtgtcagtgccgagtctggggtcctagtggaccccacagccgactttgtgcatcacatcccagcatcgtttttttggtgtttgtttgtttgtt

SEQ ID NO: 32425 - DNA, 601 bp, Human
ccggcctgggtgacagagcaagactctgtctcaaaacaaattaaaattaaattaaaatttaaaaataaataatttttaataaagatttatacacaggatcctgttagtgaagataactttaaaatattaacacccattgctggcaaggctgtgaagagacgggcacttttgtaaattgcttgccagagggtaatcaattctggtaagcaatttacaaaagtgcctgtctcttgggggtgatccgcccacctcgggctcccaaagtgctgggattataggcatgagccactgtgtccagccmattctttttttgtttgtttgtttgtttagaactatcagggaaatcgtacttagtttttagatctatttcaaggaacctgacccaaggagagacataaattagcataaaatagtcttgctgcaccgtggtcatacccggcctgattctttttttatatcattgtataaatttaagaggtatgatggtttgatatacatatccatagtgaaatgattactacagtaaggaatttaacatatccatggccaggcacaggggcccacgcctgtactcgaagcactttgggaggccaagacagga

SEQ ID NO: 32426 - DNA, 601 bp, Human
gcttgaacccaggaggcggaggttgtagttagacaagatcccaccactgccctccggcctgggtgacagagcaagactctgtctcaaaacaaattaaaattaaattaaaatttaaaaataaataatttttaataaagatttatacacaggatcctgttagtgaagataactttaaaatattaacacccattgctggcaaggctgtgaagagacgggcacttttgtaaattgcttgccagagggtaatcaattctggtaagcaatttacaaaagtgcctgtctcttgggggtgatccgcccrcctcgggctcccaaagtgctgggattataggcatgagccactgtgtccagccaattctttttttgtttgtttgtttgtttagaactatcagggaaatcgtacttagtttttagatctatttcaaggaacctgacccaaggagagacataaattagcataaaatagtcttgctgcaccgtggtcatacccggcctgattctttttttatatcattgtataaatttaagaggtatgatggtttgatatacatatccatagtgaaatgattactacagtaaggaatttaacatatccatggcc

SEQ ID NO: 32427 - DNA, 601 bp, Human
aatcgcttgaacccaggaggcggaggttgtagttagacaagatcccaccactgccctccggcctgggtgacagagcaagactctgtctcaaaacaaattaaaattaaattaaaatttaaaaataaataatttttaataaagatttatacacaggatcctgttagtgaagataactttaaaatattaacacccattgctggcaaggctgtgaagagacgggcacttttgtaaattgcttgccagagggtaatcaattctggtaagcaatttacaaaagtgcctgtctcttgggggtgatccrcccacctcgggctcccaaagtgctgggattataggcatgagccactgtgtccagccaattctttttttgtttgtttgtttgtttagaactatcagggaaatcgtacttagtttttagatctatttcaaggaacctgacccaaggagagacataaattagcataaaatagtcttgctgcaccgtggtcatacccggcctgattctttttttatatcattgtataaatttaagaggtatgatggtttgatatacatatccatagtgaaatgattactacagtaaggaatttaacatatccat

SEQ ID NO: 32428 - DNA, 601 bp, Human
atagctgtaatcctagcactttgggaagccaaggtgggtggatcatctgaggtcaggagtttaagaccaacctggccaacacggtgaaacaccgtctctactaaatacaaaaattagccaggcatggtggtgggcacctgtaatcccagctacttgggagcctgaggcaggagaatcgcttgaacccaggaggcggaggttgtagttagacaagatcccaccactgccctccggcctgggtgacagagcaagactctgtctcaaaacaaattaaaattaaattaaaatttaaaaataaatmatttttaataaagatttatacacaggatcctgttagtgaagataactttaaaatattaacacccattgctggcaaggctgtgaagagacgggcacttttgtaaattgcttgccagagggtaatcaattctggtaagcaatttacaaaagtgcctgtctcttgggggtgatccgcccacctcgggctcccaaagtgctgggattataggcatgagccactgtgtccagccaattctttttttgtttgtttgtttgtttagaactatcagggaaatcgtacttagtttttagatctatttca

SEQ ID NO: 32429 - DNA, 601 bp, Human
ctgggcacagagtgagtccctgtctataaaattaaaaaaaaaaaaaaaaagaccctcaagtctaattctcttgtttttgttttttgtttgtttgttttcgtttttgttttttctgagacagagtctcactctgtcacccaggctggagtgcactggtacaatctcggctcactgcaatctccgcctcctgggttcaagcgattctcctgcctcagcctcccgtgtagctagaattacaggcatgtgccaccatgcccggctaattttgtatttttaggagagacggggtttctccaagttkgtcaggctggtcttgaactcctgacctcaggtgatccgcccgccttggcctcccaaagtgctgggattacaggcgtgagccactgcgcccagccaattctcttgttttaagggtttgataaccaaggcccagagaaggacggcaaggtgcccagggtcacacagcaagagagatcacaggccaggatcctcccttcctccccaagccaggtctgcactgcctcacgtacctgacacctgtttgctgtcttcatctcggcagcggacaacatactcctttaggacgccgggacaggtgctc

SEQ ID NO: 32430 - DNA, 601 bp, Human
aaaatattttttgtagagatgaggtctcaccatgttgcccaggctggtcttgaactcctcggctcaagcaatcctccagcctcagcctcccaaagtgctgggattacaggtgtgagccaccacaccgggttttgcctgtgtcctccttatttttgcattcatttatttgtcgctcaatgaacagattcctgcatcttcctcctccccaagagcccccagataccttgacacatctaccccaaccccgcagtgtcagaccagggagaagggacagttgtaaacaagggcatggccagaaggrggcagagaagtcttgctggaggagggaacttttgagctgagttttgaaggacgaataggagttggaccgtgtggaaaacaaacattccaggcaggaggcagggaagggcctgcatgggcaaggctcctggagtgtgagaggaagctgcgagagaaggcaatgggagcagtttgagctgctactttctcctgagggcagtagggagccatagagggagtgagagtgagggcagggctgctaagatcattgtgggaagcgcagtgcagtgcatgctgggtaaataactgggtcctaccccct

SEQ ID NO: 32431 - DNA, 601 bp, Human
gcccctttccatgggaatgaccaaggacccaaaagttactatcccttccctagaaatttctgcataggatcacctgaggtcaggagttcaagaccagcctggccaacatggtgaaaccctatctctactgaaaatacaaaataaatagctgggtgtgatggcacgcacctgtagtcccagctacttgggaggctgagacaggagaatggcttgaacccgggagggggaggttgcaataagccaagatcgtgccactgcactctagcctgggtaacagagtaagactccatctcaaaaaagaaaaaaaaaaagaaaaaaaaaagaaagaaattttgcataaactgccccccttaatctgcatgcaattaaaagtaagtataaatctgactgcaaaaccgctctcagcggctactctccgcctacagggaagccctgctctgcagaggcagtcacggagctataactgctgcttcaataaagctgttttcttctacctctggcttgcccttgaattatttcctgggcaaagccaaggacccaatctgcgggctaagctccactttagggctcccctgcccagcatcattaccatcgctatggt

SEQ ID NO: 32432 - DNA, 601 bp, Human
ggacaccctgcttccaatcagagaaggctcagcctgcctgcggaagaaccctgaacgggcagctccgagatagaccccaatcgctggattcaggcatatctgaagcccattcccttgggattttttccatcaggtttcctttataataaagccactttgaattctgtttctagtgccaggaaatggacctctgcctgcctgtctttaaaatgggaaggggtatggagcactggttttggagtccttaccttgatgaattgggagagaataaaatgagctaatgcgtaacccttgtccagcrtgtgcacccaataaaaagacttggaattagaaaaggcatccttacctccttccctccagggaactcaatggcggagctggcacagggtgtgggcagcggcgggcacaggtgccgtgcggccctggggaggaaaggggaccagtgagaggagctgaggtttttttttttttttggagacggagtcttgctctgttgcccaggctggagtgcagtggcgcgatctcggctcactgcaacctctgcctcctgggttcaatcgattctcctgactcagcctcctgagtagctgagattacaaac

SEQ ID NO: 32433 - DNA, 601 bp, Human
agggttgcacccctgaccgtctggcccactgggccccaggaccttggccttgcacctgtctccatcctccaaggacaactctgtatccagggccagctcaggggcaccctcaggtagctctgtcttctcgagaggctcagtcctctcgcctttgtcccaggacatctctaccaccagggcctcctgcagggatgcctcttcctggaagtccactgggttgatccactgccaagtctgcagagggagggtagggccacagctgtgagcagagctctacttcccatccacagcaggatggaayggaccaggtcactgctggttaaattctctaacatcctgagacctggacgggtgcagtggctcacacctgtcatcccagcactttgggaggctgaggcgggtggatcacttgaggtcagcagtttgagaccagcctggagaacatggccaaaccccatctctactaaaaatacaaaaattagctgagcttggttgcgcacgcctgtaatcccagctacttgggaggctgaagcaggagaatcgtttgaacccgggaatcagaggttgcagtgagccgagatggcgccactgcactccaggc

SEQ ID NO: 32434 - DNA, 601 bp, Human
cctcgggcgagtcactcaccctctctgagcctcaacgatcacatctgtaaagtacaacagtcatggttcctttcagggggtggttgtagggatttggtagggaatcatgtgagtggatggaatgggctgggtatgccataagtgcttaataaccagccgttgtgattgagatagtcgctcttcgtgtctgtaagacaaagtggatgttttcgtttctccctcaggcctccaggccctgatatcccaggagcgatggatgtctagcccccccaccccccgggcagggttgcacccctgaccrtctggcccactgggccccaggaccttggccttgcacctgtctccatcctccaaggacaactctgtatccagggccagctcaggggcaccctcaggtagctctgtcttctcgagaggctcagtcctctcgcctttgtcccaggacatctctaccaccagggcctcctgcagggatgcctcttcctggaagtccactgggttgatccactgccaagtctgcagagggagggtagggccacagctgtgagcagagctctacttcccatccacagcaggatggaacggaccaggtcactgctgg

SEQ ID NO: 32435 - DNA, 601 bp, Human
tgactcctgtgtgtgctacgtagcctcgggcgagtcactcaccctctctgagcctcaacgatcacatctgtaaagtacaacagtcatggttcctttcagggggtggttgtagggatttggtagggaatcatgtgagtggatggaatgggctgggtatgccataagtgcttaataaccagccgttgtgattgagatagtcgctcttcgtgtctgtaagacaaagtggatgttttcgtttctccctcaggcctccaggccctgatatcccaggagcgatggatgtctagcccccccacccccmgggcagggttgcacccctgaccgtctggcccactgggccccaggaccttggccttgcacctgtctccatcctccaaggacaactctgtatccagggccagctcaggggcaccctcaggtagctctgtcttctcgagaggctcagtcctctcgcctttgtcccaggacatctctaccaccagggcctcctgcagggatgcctcttcctggaagtccactgggttgatccactgccaagtctgcagagggagggtagggccacagctgtgagcagagctctacttcccatccacagcaggat

SEQ ID NO: 32436 - DNA, 601 bp, Human
catccagtgctcctgggggtggatgcccagcccagggtccagggatccatctgagccccccttgcccccattcccagtccattctacgccagaacaggtaaatggcagggtctgctcctgccccacggatgccaggcccagcagggtgcagcagcttccatttcatggcagcatctagggttcccccgcaggatgggtggcaacaggcacggggcagagaggaggcaggtgcactggagcctggaggagctctgggttatttgggtccaaatgtgactcctgtgtgtgctacgtagcctcrggcgagtcactcaccctctctgagcctcaacgatcacatctgtaaagtacaacagtcatggttcctttcagggggtggttgtagggatttggtagggaatcatgtgagtggatggaatgggctgggtatgccataagtgcttaataaccagccgttgtgattgagatagtcgctcttcgtgtctgtaagacaaagtggatgttttcgtttctccctcaggcctccaggccctgatatcccaggagcgatggatgtctagcccccccaccccccgggcagggttgcacccctgaccgtctg

SEQ ID NO: 32437 - DNA, 601 bp, Human
tctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggcygtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagc

SEQ ID NO: 32438 - DNA, 601 bp, Human
caacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggctgtgtccatcccggagcaggacaacatcgcctgcacctcaccccatgtgctcaagggtacrccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaag

SEQ ID NO: 32439 - DNA, 601 bp, Human
agctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccaccyagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaa

SEQ ID NO: 32440 - DNA, 601 bp, Human
ttcttcctcacctccttctagccccacctagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacrgggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttcc

SEQ ID NO: 32441 - DNA, 601 bp, Human
atcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgstgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcccctccgtgtctgcctggaattttgtctggatctaggagcctctgctgggagataggatcaggagctgaagagtc

SEQ ID NO: 32442 - DNA, 601 bp, Human
ctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcamcctctatcctggaacctgtcctccctttctccccaactatgcatctgttgtctgctcctctgcaaaggccagccagcttgggagcagcagagaaataaacagcatttctgatgcccctccgtgtctgcctggaattttgtctggatctaggagcctctgctgggagataggatcaggagctgaagagtcagggcagccagcctgcctgcccacagtggcaggggcctctgagactccaacagactgtggaggcacaggagtgctggcccgatgctgtgtcaggggctgggccttgcggtg

SEQ ID NO: 32443 - DNA, 601 bp, Human
ggaaatgaagagacatacacaacaccaaagggaaaagggggctggaatcaagttcagccaaagcacctaacacaaaaaacaggtgagctttggtcagtctgttcttcaaaatatgtatgatcataatatggtgaagtttcataatttccaactcaaaaatacaaatgatcctcagttctatacttttgcctctattctcttataaagaaatatgtcaacataacagtatgacataacagttaaaatgaaggacaaaagcttgcttatccttagtttgacctcagcataaggcaaaatcccstggactaatacatttaaaaacaaacttaaaggaaaaaaagcgaaaccaaccttcatgcaaagattaattttaaaactatcaaaagtcagttcttttattccagaggtcactgagaaaagtaccatctgctaaaattctctttcaagcacttcttccatcatatcctagaggtgagatatgggaaacagaaagcaaatcagtgtttccttcaggagctatattctgttactcaattgaggtaagacaaagtgacaatgaagatatgagtagtatttccttccaatttttaaacattttcag

SEQ ID NO: 32444 - DNA, 601 bp, Human
gagacatacacaacaccaaagggaaaagggggctggaatcaagttcagccaaagcacctaacacaaaaaacaggtgagctttggtcagtctgttcttcaaaatatgtatgatcataatatggtgaagtttcataatttccaactcaaaaatacaaatgatcctcagttctatacttttgcctctattctcttataaagaaatatgtcaacataacagtatgacataacagttaaaatgaaggacaaaagcttgcttatccttagtttgacctcagcataaggcaaaatcccctggactaatacatttaaaaacaaacttaaaggaaaaaaagcgaaaccaaccttcatgcaaagattaattttaaaactatcaaaagtcagttcttttattccagaggtcactgagaaaagtaccatctgctaaaattctctttcaagcacttcttccatcatatcctagaggtgagatatgggaaacagaaagcaaatcagtgtttccttcaggagctatattctgttactcaattgaggtaagacaaagtgacaatgaagatatgagtagtatttccttccaatttttaaacattttcagaagctgaga

SEQ ID NO: 32445 - DNA, 601 bp, Human
aagggggctggaatcaagttcagccaaagcacctaacacaaaaaacaggtgagctttggtcagtctgttcttcaaaatatgtatgatcataatatggtgaagtttcataatttccaactcaaaaatacaaatgatcctcagttctatacttttgcctctattctcttataaagaaatatgtcaacataacagtatgacataacagttaaaatgaaggacaaaagcttgcttatccttagtttgacctcagcataaggcaaaatcccctggactaatacatttaaaaacaaacttaaaggawaaaaagcgaaaccaaccttcatgcaaagattaattttaaaactatcaaaagtcagttcttttattccagaggtcactgagaaaagtaccatctgctaaaattctctttcaagcacttcttccatcatatcctagaggtgagatatgggaaacagaaagcaaatcagtgtttccttcaggagctatattctgttactcaattgaggtaagacaaagtgacaatgaagatatgagtagtatttccttccaatttttaaacattttcagaagctgagatcaaaccccagtcaataaaatgcag

SEQ ID NO: 32446 - DNA, 601 bp, Human
atgaatgggatgttcttctctccccacagaagaagcgcacgctgaaggggtccattgagctctcccgaatcaaatgtgttgagattgtgaaaagtgacatcagcatcccatgccactataaatacccgtttcaggtaagtccatcaggtgggtagttccccattccctggactgtggttaaaatcttcagtcacagccgggtgcagtggttcaagcctgtaatcctagcactttgggaggttgaggcaggcagatcacgaggtcaggagttcaagaccagcctggccaacatgaaaccccrtctctactaaaaatacaaaaaattagctgggcgtactggcgggcgcctgttatcccagctactcgggaggctgagacaggagaattgtttgaacccaggaggcagagttttcagtgagccaagatcgtgccattcactccagcccaggcaacagagtgagactccgtcaaaaaaaaaaaaaaaaaatcctcagtcactgtgagagagggtggacacggatgactctctgcctctctgctccaaggttaggacttagacaaatcccattaggaaacgtatgtgttccttccatcagtgaca

SEQ ID NO: 32447 - DNA, 601 bp, Human
gggtagttccccattccctggactgtggttaaaatcttcagtcacagccgggtgcagtggttcaagcctgtaatcctagcactttgggaggttgaggcaggcagatcacgaggtcaggagttcaagaccagcctggccaacatgaaaccccatctctactaaaaatacaaaaaattagctgggcgtactggcgggcgcctgttatcccagctactcgggaggctgagacaggagaattgtttgaacccaggaggcagagttttcagtgagccaagatcgtgccattcactccagcccaggyaacagagtgagactccgtcaaaaaaaaaaaaaaaaaatcctcagtcactgtgagagagggtggacacggatgactctctgcctctctgctccaaggttaggacttagacaaatcccattaggaaacgtatgtgttccttccatcagtgacatttatttgttaattctttcacttattgaacaaaaattaagcacaaaatcttgaaaaggtggttattccttatacccctttccctcatgtcttctcttcctcaaggaaagtcctaattagtgaaggaagaaataaagctgctatcagggg

SEQ ID NO: 32448 - DNA, 601 bp, Human
aaaatcttgaaaaggtggttattccttatacccctttccctcatgtcttctcttcctcaaggaaagtcctaattagtgaaggaagaaataaagctgctatcaggggcccgaaacctaatgtgctttaagtgcagtttactcatgatttgaggcaacatattgcaattgctgggtatgaattgcttggagattctgaggcaaaaagattcagattttataatctgaggactatctggaatcgcactgtctagtacagtagccactagccacacatggatgttcacatttaaatgtattaaaygatattaaaaattcagcttcttagtcacattgggcacatttcacatgttcaatagcaggacatggctggcagctactgtactgaaacagcactggttatagaatgttcctatcactgcagaaatttttttttttttttttgagacagagtctcactctgtcacccaggctggagtgcagtggcgcaatcccggctcactgcaacctccacctccctggttcaagtgattctcctgcctcagcctactgaatagctgggactacgggcgtgtgccaccactcccggctaatttttgtattt

SEQ ID NO: 32449 - DNA, 601 bp, Human
agtatgaagaagcagagcataggccctcatgtgagatgacctgggtttaaatcccagtctgtcacttgctatgtacacttgggcgagttccttaattgcctgtgcttcagtttcccatctgtttaaaaggaagaaaaggaagggataacagcacctgcctttggagctgatgtgagcaaagtcctagaaactaggttggcccatagacagcatgcaataaatatcagctagctttcaagcttttcagaccattggtaagggtatttcttaagccttaccttcctgatggcacagttagagrcagcagtgtttaagcacatgggatgtggagccaggcatgaaggtgaaaatcccagctctgccaatgattagcatgtgaccctgggtaagttccttgaccttcgtgtgtctctataaattttgactaaaaacagtcatggagctgttgtgagaattgaatgattgaggacttagaaaaatacccatcccaaagaaagccctggatcaatgttaccattattgttctttagcctgaagcactggatgtgtcagaagatctgggttcaaatactaatctgcctctacgaagctgtgaggacca

SEQ ID NO: 32450 - DNA, 601 bp, Human
agccaaggtgggaggatcacttgagctcaggagttcaaggctacagtgagccatgctcatgccactgcacttcagcctgagcaacatagtgagatctcatctctactaaaaataaaaacattaggcaggcatggtggcacatgcctgtgctcccagctacccgggaggctgaggtgggagaatcacctgagcctgggaggtcaaggctgcagtgagccaagtgagccgagcctgggtcacagagcaagaccctgttcttaccccaccaaaaaaaaaagaagaaaaaaaaggaatcaaaagsgccccagctatggtcattggccatttgccctctgtgaagggattttatacacagggtgttaaaactggaaggaatattagagattagatatctagttctgtggttggttcatttatttatttattcattgagacagtgtattagtccattttcacactgctataaagatatgcccgagagtgggtaatgtataatgaaaagaggtttaattgactcacagttccgtatggctgggaggcctcaggaaacttacaatcatggtggaaggtgaaggggaggcaatcaccttattcacaaggt

SEQ ID NO: 32451 - DNA, 601 bp, Human
tacacccaactctgttctgtgccttatgtatgtatttgtttcagtagcagaccccccttttttttccaaccaaaatcttacttcaaagccacaaacctagaagggagaaaaccaaagtggctgtggttaaaggtaggagaggtggggggtggtaattccaccttctcaaccttctcattacccttaaggcacctttgtagagcccagtgtttaacaatctcattgcatagtgggggaaactgaggctcagataagggtttgcccaacttaagaacacataactaatgcaaggcagagccasacgcaagcctagatgtgctgatgcctaaatgtaacatgaactaccccagtaaatagcacagtgcatttatgcgctcagatcaacccatgcttctgagtggtctgggcaatactcattcaggctcactcagccaggtctaatctcgaggtgttataaaattggtagcccttgatagactgacctggaaataactcttctgttggtgccaacctgtttcagaaacgaggaataataacagtttggtgcctaaatatcatcctaatttctggatggatgggaagtggaggtgctgttctcagc

SEQ ID NO: 32452 - DNA, 601 bp, Human
aaatcttacttcaaagccacaaacctagaagggagaaaaccaaagtggctgtggttaaaggtaggagaggtggggggtggtaattccaccttctcaaccttctcattacccttaaggcacctttgtagagcccagtgtttaacaatctcattgcatagtgggggaaactgaggctcagataagggtttgcccaacttaagaacacataactaatgcaaggcagagccagacgcaagcctagatgtgctgatgcctaaatgtaacatgaactaccccagtaaatagcacagtgcatttatgsgctcagatcaacccatgcttctgagtggtctgggcaatactcattcaggctcactcagccaggtctaatctcgaggtgttataaaattggtagcccttgatagactgacctggaaataactcttctgttggtgccaacctgtttcagaaacgaggaataataacagtttggtgcctaaatatcatcctaatttctggatggatgggaagtggaggtgctgttctcagctggagaagcttgcaacaggctgtgcccaatatgatccaaccaagaatggtaagagactgggaattccctcta

SEQ ID NO: 32453 - DNA, 601 bp, Human
agaatctgaggctgagatatagcctcagaacttgtatgggtctgggaagcagcagaagtggatgagtaaaaacagacccagccacacccaacccatagtaacacccatttctgcaaccagaactggccctgatctccccactgtggggagggaaaggaaggaagggaaaagcaaggccagaggacgaagaaagagagaccagtcatagaatgtccagggctggaagtggccaaggctcacagctagtattggtgaagccagagttagaacaccagtctcccagctccaagttgagttctarataggaaccatacttcctattacaggggttttccttcttctgtggtcattgtatacccaggtcactatcccagcctactctttcttggcaagtctgcacgggactgggctccagtgtcaatgtgtgactctcctctaccacatccctgatgtgagctgtccaacttcaagtcaacctcatacagaaatgaggaactcatcgtctacctatgcagcccattctcttcccatctctcgttattaaggacgtctttgtattagcctgaagtctgtgcagtgcctcccgtaccacagagagccc

SEQ ID NO: 32454 - DNA, 601 bp, Human
acagaaatgaggaactcatcgtctacctatgcagcccattctcttcccatctctcgttattaaggacgtctttgtattagcctgaagtctgtgcagtgcctcccgtaccacagagagccccagacacagccacacacctttgattcattgagtccaggaatggcctttgcagagctacaaaggagaaatagtgagagatgcatatgaagagatgagaggaaggagagagagaaagagaaagagagaggagaagagaagagaaaggaggaaagagggaagagagaggagagctaaacagacrgagacatggaaacagagataagcagaaagacaaagacagagagatgctggggttggtatagtttgaaagaggcagaaagaacacatattcagatgccttaaggcaactaaaagtggatcccagcccactcaaaaagcagcacaatgacctcccacctcagccaccccctcctcaagcccacaaccatatcaggaagctagtgagtcactgtccccctgagtcaccaattcccactcctgagcttagcaggtggcagagacattcccggaagtctctatgcctacagggaagggtgcaagt

SEQ ID NO: 32455 - DNA, 601 bp, Human
agagatgcatatgaagagatgagaggaaggagagagagaaagagaaagagagaggagaagagaagagaaaggaggaaagagggaagagagaggagagctaaacagacggagacatggaaacagagataagcagaaagacaaagacagagagatgctggggttggtatagtttgaaagaggcagaaagaacacatattcagatgccttaaggcaactaaaagtggatcccagcccactcaaaaagcagcacaatgacctcccacctcagccaccccctcctcaagcccacaaccatatcagraagctagtgagtcactgtccccctgagtcaccaattcccactcctgagcttagcaggtggcagagacattcccggaagtctctatgcctacagggaagggtgcaagtctaaccccactggcaggcttttcctgggaatacagaaagagagggcccccgaatatggacttctggaagcttctggtgtgtactagaaaagggaatcagaaaccagcaggcccaaggagataaaagacagcttctgacaaggccaagtcaggtttcactgtgtcttattgctccttctggccccctttcttct

SEQ ID NO: 32456 - DNA, 601 bp, Human
ggagaagagaagagaaaggaggaaagagggaagagagaggagagctaaacagacggagacatggaaacagagataagcagaaagacaaagacagagagatgctggggttggtatagtttgaaagaggcagaaagaacacatattcagatgccttaaggcaactaaaagtggatcccagcccactcaaaaagcagcacaatgacctcccacctcagccaccccctcctcaagcccacaaccatatcaggaagctagtgagtcactgtccccctgagtcaccaattcccactcctgagcttakcaggtggcagagacattcccggaagtctctatgcctacagggaagggtgcaagtctaaccccactggcaggcttttcctgggaatacagaaagagagggcccccgaatatggacttctggaagcttctggtgtgtactagaaaagggaatcagaaaccagcaggcccaaggagataaaagacagcttctgacaaggccaagtcaggtttcactgtgtcttattgctccttctggccccctttcttctgttgttttccctgggccctttttctcagaaaaaccccctggctgctcacttcc

SEQ ID NO: 32457 - DNA, 601 bp, Human
aaagagggaagagagaggagagctaaacagacggagacatggaaacagagataagcagaaagacaaagacagagagatgctggggttggtatagtttgaaagaggcagaaagaacacatattcagatgccttaaggcaactaaaagtggatcccagcccactcaaaaagcagcacaatgacctcccacctcagccaccccctcctcaagcccacaaccatatcaggaagctagtgagtcactgtccccctgagtcaccaattcccactcctgagcttagcaggtggcagagacattcccgraagtctctatgcctacagggaagggtgcaagtctaaccccactggcaggcttttcctgggaatacagaaagagagggcccccgaatatggacttctggaagcttctggtgtgtactagaaaagggaatcagaaaccagcaggcccaaggagataaaagacagcttctgacaaggccaagtcaggtttcactgtgtcttattgctccttctggccccctttcttctgttgttttccctgggccctttttctcagaaaaaccccctggctgctcacttccggttgggtccattagttttcat

SEQ ID NO: 32458 - DNA, 601 bp, Human
gggttggtatagtttgaaagaggcagaaagaacacatattcagatgccttaaggcaactaaaagtggatcccagcccactcaaaaagcagcacaatgacctcccacctcagccaccccctcctcaagcccacaaccatatcaggaagctagtgagtcactgtccccctgagtcaccaattcccactcctgagcttagcaggtggcagagacattcccggaagtctctatgcctacagggaagggtgcaagtctaaccccactggcaggcttttcctgggaatacagaaagagagggccccygaatatggacttctggaagcttctggtgtgtactagaaaagggaatcagaaaccagcaggcccaaggagataaaagacagcttctgacaaggccaagtcaggtttcactgtgtcttattgctccttctggccccctttcttctgttgttttccctgggccctttttctcagaaaaaccccctggctgctcacttccggttgggtccattagttttcatgctcattttttcttttcctgtttttctcttttcagcttcaaagaagcctcttcctcctactcctgaagacaacagggtgagt

SEQ ID NO: 32459 - DNA, 601 bp, Human
tctcactttatttattcaacaaatactgatatcaaattgggtggccattcacctgaccactttggagtatagtagcagctcactctacataaaagtgtgtctggcatggtggctcacgtctgtaatcccagcactttgggaggccaaagtgggaggatcgcttgagcccaggagttcgagaccagcctggacaacaaagtgagacccccatctctagaaaaaatttttaaaaattagctggtgtggtggtgcacacctgtagtcacagctacttagcaagctgaggtgggaggatcacttrctcccaggaggtcgagactgcagtgagccatgactgtgtgccactgcacttcaacccgggtgacagagcaagaccccgtctccagaaaaaaaaaaaaaaaaacaaggtgcacatctactcttcgcaagcattttggagacatacatttgttgatattttatatatttcaaagcacttccacccctttattatctattttaaaacttactatccgttctatccacttcagagggttttagttttattctcattgtaaagcttgggaaatcaaatcccaagacaggtcttgaggcttttcca

SEQ ID NO: 32460 - DNA, 601 bp, Human
attcacctgaccactttggagtatagtagcagctcactctacataaaagtgtgtctggcatggtggctcacgtctgtaatcccagcactttgggaggccaaagtgggaggatcgcttgagcccaggagttcgagaccagcctggacaacaaagtgagacccccatctctagaaaaaatttttaaaaattagctggtgtggtggtgcacacctgtagtcacagctacttagcaagctgaggtgggaggatcacttactcccaggaggtcgagactgcagtgagccatgactgtgtgccactrcacttcaacccgggtgacagagcaagaccccgtctccagaaaaaaaaaaaaaaaaacaaggtgcacatctactcttcgcaagcattttggagacatacatttgttgatattttatatatttcaaagcacttccacccctttattatctattttaaaacttactatccgttctatccacttcagagggttttagttttattctcattgtaaagcttgggaaatcaaatcccaagacaggtcttgaggcttttccaaggccattcagcaacttagtaggatgcaaggtttctggcgtggtgg

SEQ ID NO: 32461 - DNA, 601 bp, Human
ccagaagcatctgcatcacctgggagcatgttagaaatacaaattcttaggccccacccccagacctgctgtgtccaaaacgctgggggaggggcccaggaatctgcattttaataagcctcctcactgatctataatatactgacttacaagtcttagatggcatagtacctactctagggcagcttattttgttaaggagatgaaaaaaaaaagatgggggaaaggatcatgacctttaggtagggaatatgaccctgaccttatgataatattaacaccaatatccacttttctttcttttttttttttttttgagatagagtcttgctcttgtcacccaggctggagtgcaatggcgtgatctcggctcactgcaacctccgcctcccaggttcaagcgattctcctgcctcagcctcctgagtagctgggattacaggcgctcaccatcatgcccggctaatttttgtatttttaatagagaccgacttttaccatgttggccaggcaggtcttgaactcctgtcctcaggcgatcaacccacttcaacctcccaaagtgctggaattacaggcgtgagccactgtgcctgaccaa

SEQ ID NO: 32462 - DNA, 601 bp, Human
ggaaccctactgccctcccttgcagacggttccctcaacagtcccgcctaaacccacacctcccatcttaagtgaggctgctcttgtgtctttatttttggtatcaatgaaggtgaaagccagaaaacactgctggtccttctctccctacactctgccatttggcttttcagccttcttggaggagcatcgtggatactgttttgagtgttctgaccacaaaggttttggaatcattgttctagtttcaaccgcatgtctaaatccaatgcaacggttctcttgtctgagccacttgaartcatttctctcctcaccttcttgttctgctgcctgagtggtaatgacatctcgggttgtcatacagagaaactgtttttaatccagtctgagccaacaggtctcatgctctatgtgagaaacactgtgagcagggccagtcctccggggactggccagtcctctgggggttgggggatggctattttggttcaagatgtaaaatatccatggtcagagtgaaggacaatcctaggcctcttttgcctatggatacaaacaaggtcgtatatcacattgaagtacaaattccgattcctct

SEQ ID NO: 32463 - DNA, 601 bp, Human
tgttttgagtgttctgaccacaaaggttttggaatcattgttctagtttcaaccgcatgtctaaatccaatgcaacggttctcttgtctgagccacttgaaatcatttctctcctcaccttcttgttctgctgcctgagtggtaatgacatctcgggttgtcatacagagaaactgtttttaatccagtctgagccaacaggtctcatgctctatgtgagaaacactgtgagcagggccagtcctccggggactggccagtcctctgggggttgggggatggctattttggttcaagatgkaaaatatccatggtcagagtgaaggacaatcctaggcctcttttgcctatggatacaaacaaggtcgtatatcacattgaagtacaaattccgattcctcttggccccctgcatccatgggaactcaactcttcctcttacagtccctcccagtcaacccagggcttgctgaggggccactagaatgtgtctgcatgtgtcctttcttgctggctgcctactaaggcaccctatccctgccactgctacctgggctctctgtgagggcccctcagccccgtggagctcttcccacctggg

SEQ ID NO: 32464 - DNA, 601 bp, Human
ggggttgggggatggctattttggttcaagatgtaaaatatccatggtcagagtgaaggacaatcctaggcctcttttgcctatggatacaaacaaggtcgtatatcacattgaagtacaaattccgattcctcttggccccctgcatccatgggaactcaactcttcctcttacagtccctcccagtcaacccagggcttgctgaggggccactagaatgtgtctgcatgtgtcctttcttgctggctgcctactaaggcaccctatccctgccactgctacctgggctctctgtgaggrcccctcagccccgtggagctcttcccacctggggccagcagaggtcctggggggtcaggttgtgctgaggcctgcagcagagtggccaggaggcaggatcctcattcctttcatgcctcaccacatcatggaggctcccaaacaacccttcctgagcccacagactcagtttctccaaatgccatcccttgattttctcactcaaatctaatggttcccaaccttatcaaactcaatcctgccttttaatgacagatattttgtaaggctccttttgttatcctgaaaagaaatttataa

SEQ ID NO: 32465 - DNA, 601 bp, Human
ctaggctcaggatgttcttatataattactgtataagctggtttctcaccacatgaatgtttaccaggatattcgaaagttgtggggaatgtgggactctacagagcattttgcattaaaggcctatagcatacctcaaactgtgatgttcaaaataacccccatattccaagcttgcatgattattagaaaaaaaaatacatgtccagtgtgcccctacagaaaggtactatcataatttgagggccctgctctgacctttctcttcacagctattaaccaatgagttgacctgcagtgrgatgaatgccatagctctgtttcttcttcaaacatccttgaacactattcctccctccataagctcttagagcaaaagcctcaggccatccactcttgtccatagcaccccatttacacatcctcacaagctccacaaatatctagatttcaaattccaatctgcagccgggcacagtggctcattcctgtactcccagcactttgggaggccgaggcaggagggtcacttgagcccaggagtttgagaccagtctgggcaacatagtgagaccctgtctctcttaaaaaaaaaaatccg

SEQ ID NO: 32466 - DNA, 601 bp, Human
ggatgaatgccatagctctgtttcttcttcaaacatccttgaacactattcctccctccataagctcttagagcaaaagcctcaggccatccactcttgtccatagcaccccatttacacatcctcacaagctccacaaatatctagatttcaaattccaatctgcagccgggcacagtggctcattcctgtactcccagcactttgggaggccgaggcaggagggtcacttgagcccaggagtttgagaccagtctgggcaacatagtgagaccctgtctctcttaaaaaaaaaaatccratctgggctcagctgagatgacatactacatcaaaatgacgagactcttttttcagctccagtatttttatgccactaaatgcttcaatgtactcagagaacttgtgacttcctaacactaaaccacattctagtgaggaacttaatatttccctacatttactctcacaaagtctgctaacccatagcaggcgtgcccatcctgaactctggcgactatgcgctttgtggtcttttcttcatgtcctcaatatggacatgaagaaagggactgaggaacagagacatcagcaatagagc

SEQ ID NO: 32467 - DNA, 601 bp, Human
catcctcacaagctccacaaatatctagatttcaaattccaatctgcagccgggcacagtggctcattcctgtactcccagcactttgggaggccgaggcaggagggtcacttgagcccaggagtttgagaccagtctgggcaacatagtgagaccctgtctctcttaaaaaaaaaaatccgatctgggctcagctgagatgacatactacatcaaaatgacgagactcttttttcagctccagtatttttatgccactaaatgcttcaatgtactcagagaacttgtgacttcctaacamtaaaccacattctagtgaggaacttaatatttccctacatttactctcacaaagtctgctaacccatagcaggcgtgcccatcctgaactctggcgactatgcgctttgtggtcttttcttcatgtcctcaatatggacatgaagaaagggactgaggaacagagacatcagcaatagagcctacaggagaaggaagggagacaggtgctagagtagagagagtcttagggctaattcaagtggtagattggccaggtccatttctccatctgggcctcagtttcctcatcctaaatgaa

SEQ ID NO: 32468 - DNA, 601 bp, Human
aggagggtcacttgagcccaggagtttgagaccagtctgggcaacatagtgagaccctgtctctcttaaaaaaaaaaatccgatctgggctcagctgagatgacatactacatcaaaatgacgagactcttttttcagctccagtatttttatgccactaaatgcttcaatgtactcagagaacttgtgacttcctaacactaaaccacattctagtgaggaacttaatatttccctacatttactctcacaaagtctgctaacccatagcaggcgtgcccatcctgaactctggcgactrtgcgctttgtggtcttttcttcatgtcctcaatatggacatgaagaaagggactgaggaacagagacatcagcaatagagcctacaggagaaggaagggagacaggtgctagagtagagagagtcttagggctaattcaagtggtagattggccaggtccatttctccatctgggcctcagtttcctcatcctaaatgaaaaagtgtattaagtgatctgttagaggaattccagctccaataacctatgattccgtagatctagataaacccacaaatcatattagtaaagcacaaact

SEQ ID NO: 32469 - DNA, 601 bp, Human
tgggctcagctgagatgacatactacatcaaaatgacgagactcttttttcagctccagtatttttatgccactaaatgcttcaatgtactcagagaacttgtgacttcctaacactaaaccacattctagtgaggaacttaatatttccctacatttactctcacaaagtctgctaacccatagcaggcgtgcccatcctgaactctggcgactatgcgctttgtggtcttttcttcatgtcctcaatatggacatgaagaaagggactgaggaacagagacatcagcaatagagcctayaggagaaggaagggagacaggtgctagagtagagagagtcttagggctaattcaagtggtagattggccaggtccatttctccatctgggcctcagtttcctcatcctaaatgaaaaagtgtattaagtgatctgttagaggaattccagctccaataacctatgattccgtagatctagataaacccacaaatcatattagtaaagcacaaactgaaagatttcatgttgactgcatctcctttgccaagggcatgatgcatccagcagagaggctgctgcatataacatagtgcagat

SEQ ID NO: 32470 - DNA, 601 bp, Human
accagaggaaggcagactgtctccccagacaccccgatgaaaggaggcattttacctccttttttatgtctttgcttggttttgttgtctctcttccccagcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggtaagtcatctttgtggctgctgtccccgtgtttgaggtgtggtgcgracaaataaaataccaggatgatttgtcctatctcccacagtgtaaccacagcactgaggtgggagaagagagcagaggcagaaggaagagggaggaagaggaagtagttgaggctcatttttcctcttctcagaagtggctctgaggcagtcacttgctatgcttgttccctgcaccccatctcaggcactccagacccaaactcatctaaaaaaccccctggatttttccactgacatctacaatttgggagcttggcaatttgttctgcaaagtgctattgttcctgagtgttaagtg

SEQ ID NO: 32471 - DNA, 601 bp, Human
aagaggaagtagttgaggctcatttttcctcttctcagaagtggctctgaggcagtcacttgctatgcttgttccctgcaccccatctcaggcactccagacccaaactcatctaaaaaaccccctggatttttccactgacatctacaatttgggagcttggcaatttgttctgcaaagtgctattgttcctgagtgttaagtgaggctgaaggtacatcccattaggaagtgcttatttttggtgaaaagaaaatgtgtgtatagagatggtacagattgatagttatgttaggacgcrtcagaaagaagacactaaagatttagttacaatcgcagtcattgaactagccatccacatgactcagggagaaaataaggttgtacaaatactactttcccactatgcaacttttgaatgaaaaaaataccgagcatgagattcacactgccttttaaggttttttttttcctcttaatatatccgatgtattaacccatgctctggaatattttccagaatctgagttcaatagttgcatcaatccagccataaatgtactctaaattgcaaattcccttgttgaacacttaggttatc

SEQ ID NO: 32472 - DNA, 601 bp, Human
ccaaggtgagtgcatcacttgaggccaggagtttgagaccagcctggccaacatggtgaaaccctgtctctactaaaaatacaaaaattagcatggtgtggtggctcaagcctgtaatcccagctactccactggctgaagcatgaaaatcacttgaacccaggagggagaggttgcagtgagccaagatggtgccacttcactctagcctgagcgacagagcaagactctgtctcaaaaaaaaaaaaaaagtgatcactattaataccttcttgtgtatcataaataaaagttatacctrtgcaaatgcatccttttttcacttgtaccaagtggatccattctgttctgcatcttgcttttaatttttaatgatattaatacacattgaagatcttttcataccagcacatgcaaatctacctcatttttaaaatagttgcatgggccggccgcagtggctcaggcctgtaatcccagcactttgattgggaggccaaggtgggctgatcacctgaggtcaggagttcaagaccaacctggccaacatggtgaaaccccatctctactaaaaatacaagaaattagctgggtgtggtgg

SEQ ID NO: 32473 - DNA, 601 bp, Human
ctctagcctgagcgacagagcaagactctgtctcaaaaaaaaaaaaaaagtgatcactattaataccttcttgtgtatcataaataaaagttatacctgtgcaaatgcatccttttttcacttgtaccaagtggatccattctgttctgcatcttgcttttaatttttaatgatattaatacacattgaagatcttttcataccagcacatgcaaatctacctcatttttaaaatagttgcatgggccggccgcagtggctcaggcctgtaatcccagcactttgattgggaggccaaggygggctgatcacctgaggtcaggagttcaagaccaacctggccaacatggtgaaaccccatctctactaaaaatacaagaaattagctgggtgtggtggcaggcgcctgtgattccagctactcgggaggctggggcaggagaatcgcttgaacctgggaggtggaggttgcagtgggccaagctcacaccactgcactccagcctgggagacagaatgagaatccatctcaaaaataatcataataataataattgcacaatcttagaatgtatgattgtattattagtatttaaataat

SEQ ID NO: 32474 - DNA, 601 bp, Human
ttaaataatcctttatggtgagacatttagttgccagtttatttgtttcctctgctgtttcaaacaaggctttaatgaagatcttgtattcatgtatcttggccatctttggaatacaaacatatatatatgatatatatttatcacattagttttccttttcttttttttgagacagggtcttgctctgtcacccaggttggagcacagtggcactctcacagttcactgcagccttgacctctcaggctcaagtgatcctcccatctcagacccctacagagctgagactataggcackcaccaccatgcccagataatttttgaattttttgtagaaatggggtctcattatgttgcccgggcttgtctcaaactactgtactcgagaaattctcccgctttagcctcccaaagtagttgggattacaggcatgagccaccatacctggcctatatgtcacatttctaactgtgcaacagttaagtcagagtatgtgatatcttaattttgccacataatttcctcacaaagcttgccaaatttaccttcctgctaacagagttatggaagtgccaagactgggtatcattgaacttt

SEQ ID NO: 32475 - DNA, 601 bp, Human
ctacagagctgagactataggcacgcaccaccatgcccagataatttttgaattttttgtagaaatggggtctcattatgttgcccgggcttgtctcaaactactgtactcgagaaattctcccgctttagcctcccaaagtagttgggattacaggcatgagccaccatacctggcctatatgtcacatttctaactgtgcaacagttaagtcagagtatgtgatatcttaattttgccacataatttcctcacaaagcttgccaaatttaccttcctgctaacagagttatggaagtgscaagactgggtatcattgaacttttaaaaaaagtcaatctgatgggttaaaaaaaaaaaagaggggcacaaatatctttaaggataagactttaccttttacatacaccagaatttacattttcaaggtgccttctctttaagtaggcttatcaaccccattacagggggaggaaagacagaagtgagacagggtaaaacgtgatgagattcagaaccatggtttgagaggcagtgtggtttgctagctaagaacagaccccaactcccctcgtctggaacctccctttctagttgattc

SEQ ID NO: 32476 - DNA, 601 bp, Human
gaacttttaaaaaaagtcaatctgatgggttaaaaaaaaaaaagaggggcacaaatatctttaaggataagactttaccttttacatacaccagaatttacattttcaaggtgccttctctttaagtaggcttatcaaccccattacagggggaggaaagacagaagtgagacagggtaaaacgtgatgagattcagaaccatggtttgagaggcagtgtggtttgctagctaagaacagaccccaactcccctcgtctggaacctccctttctagttgattcatgaagacaattgagctrgtcacatcaccttctctctgtccattatagacaggcccatatccgaaataggttcaagactgtctacagggtctacaaacaccgaagggacctagaaattcattagttcaatcaactgactttacttagcacacctaatgtaccaggaaatttgttctcctaggccttacttccccaaatgacagttaaacccttcatttggtgacctgtggaaaggcttaactatgcacttcaaagggcatcaaagaggacaccccagcagccagtcagcattatgggaatttccccagtttgctttgt

SEQ ID NO: 32477 - DNA, 601 bp, Human
aacaccgaagggacctagaaattcattagttcaatcaactgactttacttagcacacctaatgtaccaggaaatttgttctcctaggccttacttccccaaatgacagttaaacccttcatttggtgacctgtggaaaggcttaactatgcacttcaaagggcatcaaagaggacaccccagcagccagtcagcattatgggaatttccccagtttgctttgtgatagtgtggtatagtggaaagcacacaagatggggagacagaggacttggactttatcagctactcttgtcatatgmagctgaggattcacagatgaccatgtcatatgtgtgaccatgtcattcacagatgaccaagtcacttttcctctgtgaatccatttcgtgaactgtaaaatgcagctgataatgtcagctttgtctacgtcacagtgttgagaaaatcaatgagataatggaagtgaaagagctttggaaattctacatatccacatacaactatgagagttaccatttgtgtagatgacccagctttgggtggcatatgctattcaaaagcaaaatattatttgatgcattaatataattgtaaaagta

SEQ ID NO: 32478 - DNA, 601 bp, Human
aagatggggagacagaggacttggactttatcagctactcttgtcatatgcagctgaggattcacagatgaccatgtcatatgtgtgaccatgtcattcacagatgaccaagtcacttttcctctgtgaatccatttcgtgaactgtaaaatgcagctgataatgtcagctttgtctacgtcacagtgttgagaaaatcaatgagataatggaagtgaaagagctttggaaattctacatatccacatacaactatgagagttaccatttgtgtagatgacccagctttgggtggcatatkctattcaaaagcaaaatattatttgatgcattaatataattgtaaaagtatagtatggcaaaagtagacataattaagggaattccaagagtgatacagaaggaatggcaaatttcagaataagctgactttcttccgttggaatggctgccttgagcactgtatgaaggatgattctgagggcagatgtccaattctccaaagaaagtatgccatgattgattagcaatgtctgccagaggagtaaaatataagatgatcatcctgtatttggcacctacagtcttgatttcttcactc

SEQ ID NO: 32479 - DNA, 601 bp, Human
tatcagctactcttgtcatatgcagctgaggattcacagatgaccatgtcatatgtgtgaccatgtcattcacagatgaccaagtcacttttcctctgtgaatccatttcgtgaactgtaaaatgcagctgataatgtcagctttgtctacgtcacagtgttgagaaaatcaatgagataatggaagtgaaagagctttggaaattctacatatccacatacaactatgagagttaccatttgtgtagatgacccagctttgggtggcatatgctattcaaaagcaaaatattatttgatscattaatataattgtaaaagtatagtatggcaaaagtagacataattaagggaattccaagagtgatacagaaggaatggcaaatttcagaataagctgactttcttccgttggaatggctgccttgagcactgtatgaaggatgattctgagggcagatgtccaattctccaaagaaagtatgccatgattgattagcaatgtctgccagaggagtaaaatataagatgatcatcctgtatttggcacctacagtcttgatttcttcactcttcacaactctgaactgattacacattt

SEQ ID NO: 32480 - DNA, 601 bp, Human
tgtgtgaccatgtcattcacagatgaccaagtcacttttcctctgtgaatccatttcgtgaactgtaaaatgcagctgataatgtcagctttgtctacgtcacagtgttgagaaaatcaatgagataatggaagtgaaagagctttggaaattctacatatccacatacaactatgagagttaccatttgtgtagatgacccagctttgggtggcatatgctattcaaaagcaaaatattatttgatgcattaatataattgtaaaagtatagtatggcaaaagtagacataattaagggrattccaagagtgatacagaaggaatggcaaatttcagaataagctgactttcttccgttggaatggctgccttgagcactgtatgaaggatgattctgagggcagatgtccaattctccaaagaaagtatgccatgattgattagcaatgtctgccagaggagtaaaatataagatgatcatcctgtatttggcacctacagtcttgatttcttcactcttcacaactctgaactgattacacatttcccataaacataatcactagattgaaaattggccttattataagaaaattaaa

SEQ ID NO: 32481 - DNA, 601 bp, Human
aaaatattatttgatgcattaatataattgtaaaagtatagtatggcaaaagtagacataattaagggaattccaagagtgatacagaaggaatggcaaatttcagaataagctgactttcttccgttggaatggctgccttgagcactgtatgaaggatgattctgagggcagatgtccaattctccaaagaaagtatgccatgattgattagcaatgtctgccagaggagtaaaatataagatgatcatcctgtatttggcacctacagtcttgatttcttcactcttcacaactctgmactgattacacatttcccataaacataatcactagattgaaaattggccttattataagaaaattaaaacatgttatggaataaagagcaataaactatcaggcatctttttttgttttgttttgtttttttgtttttttgagacagagtcttgctctgtcacccaggccagagtgcagtggcacgatctcagctcatggcaacctccacaccactgcccccacccgccaccacccaggttaggtgagtctcatgcctcaatctcccaagtagctgagactacaggtgcatgccaccaca

SEQ ID NO: 32482 - DNA, 601 bp, Human
acataattaagggaattccaagagtgatacagaaggaatggcaaatttcagaataagctgactttcttccgttggaatggctgccttgagcactgtatgaaggatgattctgagggcagatgtccaattctccaaagaaagtatgccatgattgattagcaatgtctgccagaggagtaaaatataagatgatcatcctgtatttggcacctacagtcttgatttcttcactcttcacaactctgaactgattacacatttcccataaacataatcactagattgaaaattggccttattrtaagaaaattaaaacatgttatggaataaagagcaataaactatcaggcatctttttttgttttgttttgtttttttgtttttttgagacagagtcttgctctgtcacccaggccagagtgcagtggcacgatctcagctcatggcaacctccacaccactgcccccacccgccaccacccaggttaggtgagtctcatgcctcaatctcccaagtagctgagactacaggtgcatgccaccacacctggctaatttttatatattttctagagacagggtttcaccatgttgcccaggt

SEQ ID NO: 32483 - DNA, 601 bp, Human
caattctccaaagaaagtatgccatgattgattagcaatgtctgccagaggagtaaaatataagatgatcatcctgtatttggcacctacagtcttgatttcttcactcttcacaactctgaactgattacacatttcccataaacataatcactagattgaaaattggccttattataagaaaattaaaacatgttatggaataaagagcaataaactatcaggcatctttttttgttttgttttgtttttttgtttttttgagacagagtcttgctctgtcacccaggccagagtgcaktggcacgatctcagctcatggcaacctccacaccactgcccccacccgccaccacccaggttaggtgagtctcatgcctcaatctcccaagtagctgagactacaggtgcatgccaccacacctggctaatttttatatattttctagagacagggtttcaccatgttgcccaggtttgtctcaaactcctgagctcaagtgatccacccacctcagcctcccaaagtactaggattacaggtgtgagccaccacacccagcctatcagtcatctttttacagattgacagagtatggag

SEQ ID NO: 32484 - DNA, 601 bp, Human
gatcatcctgtatttggcacctacagtcttgatttcttcactcttcacaactctgaactgattacacatttcccataaacataatcactagattgaaaattggccttattataagaaaattaaaacatgttatggaataaagagcaataaactatcaggcatctttttttgttttgttttgtttttttgtttttttgagacagagtcttgctctgtcacccaggccagagtgcagtggcacgatctcagctcatggcaacctccacaccactgcccccacccgccaccacccaggttaggygagtctcatgcctcaatctcccaagtagctgagactacaggtgcatgccaccacacctggctaatttttatatattttctagagacagggtttcaccatgttgcccaggtttgtctcaaactcctgagctcaagtgatccacccacctcagcctcccaaagtactaggattacaggtgtgagccaccacacccagcctatcagtcatctttttacagattgacagagtatggagtatctacttaaactagattttaagtataatctagtttaagcccttcatttgacgggtataaagtca

SEQ ID NO: 32485 - DNA, 601 bp, Human
ccaccacacctggctaatttttatatattttctagagacagggtttcaccatgttgcccaggtttgtctcaaactcctgagctcaagtgatccacccacctcagcctcccaaagtactaggattacaggtgtgagccaccacacccagcctatcagtcatctttttacagattgacagagtatggagtatctacttaaactagattttaagtataatctagtttaagcccttcatttgacgggtataaagtcagaggtccagagagtagaagggatgccgctttcaccctgtggtattaamtgagataatgaatgtgaaagtgctttgaaaactacaaagttatacacaaatgtaaagaagtttgatattcttattttgtttattatgttttttgtttatgcacaattattaattcttgctcaaaagtgactcctgatccccaaatctagcctggctttatcctttttttctcgtgtttataccgttcatatctgaagaagctcaattagggaggccttaaattaaaaagcttacaatgccaactggtagtgtcttttagaatctgtggttggaaagtcatcttttatattttaattattt

SEQ ID NO: 32486 - DNA, 601 bp, Human
cgtgtttataccgttcatatctgaagaagctcaattagggaggccttaaattaaaaagcttacaatgccaactggtagtgtcttttagaatctgtggttggaaagtcatcttttatattttaattattttggtttcctgactataaaatgatagtactaaagtggaaaaaatgttgattatcacacaaaaatgtttccttatagaaaatagacactgaatattaatctttttttccagtagaggaaatttcacaatgaggagaacagcaaacagagctttttaagtaaaatcgccacttctttttttattatgtttcatatttcagtagtgaaatcaacctgcctttaacagacaagttgctattattttttaccaattcctttttttttttttttttttttttttgagacagagtctcgctctgttgcccaggctggagagcagtggcacgatctcggctcactgcaccctccacctcctgggttcaagcgattcttgtgcctcagcctcccgagtagctgggactacaggcatgtaccaccacacccggctaatttttttttgtgtgtgtagttttagtagagacagggtttcagcata

SEQ ID NO: 32487 - DNA, 601 bp, Human
cttttagaatctgtggttggaaagtcatcttttatattttaattattttggtttcctgactataaaatgatagtactaaagtggaaaaaatgttgattatcacacaaaaatgtttccttatagaaaatagacactgaatattaatctttttttccagtagaggaaatttcacaatgaggagaacagcaaacagagctttttaagtaaaatcgccacttctttttttattatgtttcatatttcagtagtgaaatcaacctgcctttaacagacaagttgctattattttttaccaattcccttttttttttttttttttttttttgagacagagtctcgctctgttgcccaggctggagagcagtggcacgatctcggctcactgcaccctccacctcctgggttcaagcgattcttgtgcctcagcctcccgagtagctgggactacaggcatgtaccaccacacccggctaatttttttttgtgtgtgtagttttagtagagacagggtttcagcatattggccaggctggtctcaaactcttgacctcgtgatccacctgcctcggcctccaaaagtgctgggattacaggcatgagc

SEQ ID NO: 32488 - DNA, 601 bp, Human
ggttggaaagtcatcttttatattttaattattttggtttcctgactataaaatgatagtactaaagtggaaaaaatgttgattatcacacaaaaatgtttccttatagaaaatagacactgaatattaatctttttttccagtagaggaaatttcacaatgaggagaacagcaaacagagctttttaagtaaaatcgccacttctttttttattatgtttcatatttcagtagtgaaatcaacctgcctttaacagacaagttgctattattttttaccaattccttttttttttttttyttttttttttgagacagagtctcgctctgttgcccaggctggagagcagtggcacgatctcggctcactgcaccctccacctcctgggttcaagcgattcttgtgcctcagcctcccgagtagctgggactacaggcatgtaccaccacacccggctaatttttttttgtgtgtgtagttttagtagagacagggtttcagcatattggccaggctggtctcaaactcttgacctcgtgatccacctgcctcggcctccaaaagtgctgggattacaggcatgagccaccgcccccggcc

SEQ ID NO: 32489 - DNA, 601 bp, Human
ttcacaatgaggagaacagcaaacagagctttttaagtaaaatcgccacttctttttttattatgtttcatatttcagtagtgaaatcaacctgcctttaacagacaagttgctattattttttaccaattcctttttttttttttttttttttttttgagacagagtctcgctctgttgcccaggctggagagcagtggcacgatctcggctcactgcaccctccacctcctgggttcaagcgattcttgtgcctcagcctcccgagtagctgggactacaggcatgtaccaccacaccyggctaatttttttttgtgtgtgtagttttagtagagacagggtttcagcatattggccaggctggtctcaaactcttgacctcgtgatccacctgcctcggcctccaaaagtgctgggattacaggcatgagccaccgcccccggcctaccaattcttgtattctaaactttaaaatgtcttatcgcaaatgccaaataatgtgatattccccaatctttaaatgacttttaatggattaaacctataaaatgatataaaacttagttctatgtaagtctaaacattaattttcctttta

SEQ ID NO: 32490 - DNA, 601 bp, Human
ttttttttttttttgagacagagtctcgctctgttgcccaggctggagagcagtggcacgatctcggctcactgcaccctccacctcctgggttcaagcgattcttgtgcctcagcctcccgagtagctgggactacaggcatgtaccaccacacccggctaatttttttttgtgtgtgtagttttagtagagacagggtttcagcatattggccaggctggtctcaaactcttgacctcgtgatccacctgcctcggcctccaaaagtgctgggattacaggcatgagccaccgcccccrgcctaccaattcttgtattctaaactttaaaatgtcttatcgcaaatgccaaataatgtgatattccccaatctttaaatgacttttaatggattaaacctataaaatgatataaaacttagttctatgtaagtctaaacattaattttccttttaacaggcatgaaggatatgtaccaagcagttatctggtggaaaaatctccaaataatctggaaacctatgagtaagatattttatttgtttttggaaaatacagtcctaaggaatcctccttaagttaggaataaattattggtt

SEQ ID NO: 32491 - DNA, 601 bp, Human
cggcctccaaaagtgctgggattacaggcatgagccaccgcccccggcctaccaattcttgtattctaaactttaaaatgtcttatcgcaaatgccaaataatgtgatattccccaatctttaaatgacttttaatggattaaacctataaaatgatataaaacttagttctatgtaagtctaaacattaattttccttttaacaggcatgaaggatatgtaccaagcagttatctggtggaaaaatctccaaataatctggaaacctatgagtaagatattttatttgtttttggaaaayacagtcctaaggaatcctccttaagttaggaataaattattggttgactgtaaaaataccagatgatccctactgcaacagcaatgttcacacataccatccagctcttgatacctaaataaggctttccactaaaaaaaccaggactttctggagaaaaggcttggggtagggatagaacaaaaaggaacttggaacatctttttgtgccagaaagtaaagaagtacttaaaaagaaatttttcttctttaatttttttttttgagacagggtctcactgtcacccaggctggagtgca

SEQ ID NO: 32492 - DNA, 601 bp, Human
tctccaaataatctggaaacctatgagtaagatattttatttgtttttggaaaatacagtcctaaggaatcctccttaagttaggaataaattattggttgactgtaaaaataccagatgatccctactgcaacagcaatgttcacacataccatccagctcttgatacctaaataaggctttccactaaaaaaaccaggactttctggagaaaaggcttggggtagggatagaacaaaaaggaacttggaacatctttttgtgccagaaagtaaagaagtacttaaaaagaaatttttcttctttaatttttttttttgagacagggtctcactgtcacccaggctggagtgcaatagtgtgatctcggctcatcgcaacctcaacctactgggctcaagcaatcctcagcctcccaagtagctggaactacaggcacatgccaccatgtccagctaatttgtaaattttttgtagagacaggatctcactaggttgcccaggctggtctttaacttccgggctctagtgatcctcccattatggcctcccaaactgctgggatcacaggtatgaaccgctgtgcccagacaaaaagatg

SEQ ID NO: 32493 - DNA, 601 bp, Human
tccaaataatctggaaacctatgagtaagatattttatttgtttttggaaaatacagtcctaaggaatcctccttaagttaggaataaattattggttgactgtaaaaataccagatgatccctactgcaacagcaatgttcacacataccatccagctcttgatacctaaataaggctttccactaaaaaaaccaggactttctggagaaaaggcttggggtagggatagaacaaaaaggaacttggaacatctttttgtgccagaaagtaaagaagtacttaaaaagaaatttttcttytttaatttttttttttgagacagggtctcactgtcacccaggctggagtgcaatagtgtgatctcggctcatcgcaacctcaacctactgggctcaagcaatcctcagcctcccaagtagctggaactacaggcacatgccaccatgtccagctaatttgtaaattttttgtagagacaggatctcactaggttgcccaggctggtctttaacttccgggctctagtgatcctcccattatggcctcccaaactgctgggatcacaggtatgaaccgctgtgcccagacaaaaagatgtg

SEQ ID NO: 32494 - DNA, 601 bp, Human
taatctggaaacctatgagtaagatattttatttgtttttggaaaatacagtcctaaggaatcctccttaagttaggaataaattattggttgactgtaaaaataccagatgatccctactgcaacagcaatgttcacacataccatccagctcttgatacctaaataaggctttccactaaaaaaaccaggactttctggagaaaaggcttggggtagggatagaacaaaaaggaacttggaacatctttttgtgccagaaagtaaagaagtacttaaaaagaaatttttcttctttaatttttttttttgagacagggtctcactgtcacccaggctggagtgcaatagtgtgatctcggctcatcgcaacctcaacctactgggctcaagcaatcctcagcctcccaagtagctggaactacaggcacatgccaccatgtccagctaatttgtaaattttttgtagagacaggatctcactaggttgcccaggctggtctttaacttccgggctctagtgatcctcccattatggcctcccaaactgctgggatcacaggtatgaaccgctgtgcccagacaaaaagatgtgggcgtg

SEQ ID NO: 32495 - DNA, 601 bp, Human
caactaatgaatgataaagtttaaaaatcatcattttgtaacccagagtatcaactgattcaggcaagaatcctcaatgaatgtcaccactagcaagttaaagtttgatgagctgtggcatatttacatagtctcaaagtatctcctcacaaatcacttgtaattacaaagtggaggtaactagcaggcccgtctgaaacagtcaatccaaatgcacataaataatggagcaaaaaggtatcttgtgtctccttatgtgatgcactgagaagggcacacatcacttctgtgatattcctgytcaaaaaatgcacaacatgaatttacttataaggatatattcataaggatatattagacaaatccaaattagggaatattctctaaaattaatgtcctgggctcttcaaaaaaaaatgttaatatcaggaaagacacaacaggctgagaaattggtccacattaaaaaagactaaagaggtcgggcgcagtggcccacacctgtagtctcaacactttgggaggctgaggcaggtggatcacctgagatcaggagtttgagaccaggctgaccaacatggtgaaaccaccgtctctacta

SEQ ID NO: 32496 - DNA, 601 bp, Human
atttacttataaggatatattcataaggatatattagacaaatccaaattagggaatattctctaaaattaatgtcctgggctcttcaaaaaaaaatgttaatatcaggaaagacacaacaggctgagaaattggtccacattaaaaaagactaaagaggtcgggcgcagtggcccacacctgtagtctcaacactttgggaggctgaggcaggtggatcacctgagatcaggagtttgagaccaggctgaccaacatggtgaaaccaccgtctctactaaaaatacagaattatccgggygtgatggcacacgcctgtagtcccagatacttgggaggctgaggcaggagaattgcttgaacccaggaggcagaggttgctgtgagccaagattgcaccattgaactccagcctgggcaacaagagcgaaactccatctcaaaaaaaataatagtaatagattaaagacacatggtaactaaatacagtggtgatcctgggctggatcttgacccatacaaaaaaatattttttgttataatatacattattgggacaaccgatacaatttgaataagatctgcagttaagtaatagtgt

SEQ ID NO: 32497 - DNA, 601 bp, Human
tttacttataaggatatattcataaggatatattagacaaatccaaattagggaatattctctaaaattaatgtcctgggctcttcaaaaaaaaatgttaatatcaggaaagacacaacaggctgagaaattggtccacattaaaaaagactaaagaggtcgggcgcagtggcccacacctgtagtctcaacactttgggaggctgaggcaggtggatcacctgagatcaggagtttgagaccaggctgaccaacatggtgaaaccaccgtctctactaaaaatacagaattatccgggtrtgatggcacacgcctgtagtcccagatacttgggaggctgaggcaggagaattgcttgaacccaggaggcagaggttgctgtgagccaagattgcaccattgaactccagcctgggcaacaagagcgaaactccatctcaaaaaaaataatagtaatagattaaagacacatggtaactaaatacagtggtgatcctgggctggatcttgacccatacaaaaaaatattttttgttataatatacattattgggacaaccgatacaatttgaataagatctgcagttaagtaatagtgtt

SEQ ID NO: 32498 - DNA, 601 bp, Human
ccaaattagggaatattctctaaaattaatgtcctgggctcttcaaaaaaaaatgttaatatcaggaaagacacaacaggctgagaaattggtccacattaaaaaagactaaagaggtcgggcgcagtggcccacacctgtagtctcaacactttgggaggctgaggcaggtggatcacctgagatcaggagtttgagaccaggctgaccaacatggtgaaaccaccgtctctactaaaaatacagaattatccgggtgtgatggcacacgcctgtagtcccagatacttgggaggctgakgcaggagaattgcttgaacccaggaggcagaggttgctgtgagccaagattgcaccattgaactccagcctgggcaacaagagcgaaactccatctcaaaaaaaataatagtaatagattaaagacacatggtaactaaatacagtggtgatcctgggctggatcttgacccatacaaaaaaatattttttgttataatatacattattgggacaaccgatacaatttgaataagatctgcagttaagtaatagtgttatgtagatcttaaatctcatgacttcggtaattgtactgtgg

SEQ ID NO: 32499 - DNA, 601 bp, Human
tcaggaaagacacaacaggctgagaaattggtccacattaaaaaagactaaagaggtcgggcgcagtggcccacacctgtagtctcaacactttgggaggctgaggcaggtggatcacctgagatcaggagtttgagaccaggctgaccaacatggtgaaaccaccgtctctactaaaaatacagaattatccgggtgtgatggcacacgcctgtagtcccagatacttgggaggctgaggcaggagaattgcttgaacccaggaggcagaggttgctgtgagccaagattgcaccattgmactccagcctgggcaacaagagcgaaactccatctcaaaaaaaataatagtaatagattaaagacacatggtaactaaatacagtggtgatcctgggctggatcttgacccatacaaaaaaatattttttgttataatatacattattgggacaaccgatacaatttgaataagatctgcagttaagtaatagtgttatgtagatcttaaatctcatgacttcggtaattgtactgtggttagataagtgtatactctgtgtcttaggaaatagacacagaagtacttaggaataaaagt

SEQ ID NO: 32500 - DNA, 601 bp, Human
tcccagatacttgggaggctgaggcaggagaattgcttgaacccaggaggcagaggttgctgtgagccaagattgcaccattgaactccagcctgggcaacaagagcgaaactccatctcaaaaaaaataatagtaatagattaaagacacatggtaactaaatacagtggtgatcctgggctggatcttgacccatacaaaaaaatattttttgttataatatacattattgggacaaccgatacaatttgaataagatctgcagttaagtaatagtgttatgtagatcttaaatctcawgacttcggtaattgtactgtggttagataagtgtatactctgtgtcttaggaaatagacacagaagtacttaggaataaaagtcaattctcaaatagttcagaagaaaagtcaatctatgtctatctaaagagaatagtaaagcaaatgtataaaatatcagcaattggctcatctgggttatgtgtatatgatggttcttttacactattttacagcttttctgtaagtttgaaattatttaaaaattttaaaaaattaattactcactaaatataagataccaggcctaaagaataaa

SEQ ID NO: 32501 - DNA, 601 bp, Human
aagataccaggcctaaagaataaagctaatgaggacacctattaacgcattagggttcttaattcaaatgtggtcgtgttatttgttgctgaaattctagtagattctttagtgaagaaccgtcattttctggagtctctcaaccttgtttgttttgataaagtatgtgtgagtagcccttccctcagtgaacagaagggtcatcagttctaagaatttttgagctgaaataaaacatatagggtatatgcttaaataaaataaaaaatctttataggcaatacctttgaagaaaaaacartaagcatttatttcaaatgaccactaggctatgtagttttgtttgttcaactttgcttttaatcagaatctctttgtttatgatcaaaggagcaaactcaaaattccaacaggataagcaataggaaatggtgaggtctggagcaaataaaaaaagtcattcacccacctaaaggtattttaagccattttaaaaataaaacactataccatgcaaacaaaacaatctagttatactgtgcactttcagtttgcattctccagattatgaatctcagctggaaaataacatgacttacaa

SEQ ID NO: 32502 - DNA, 601 bp, Human
ttgttttgataaagtatgtgtgagtagcccttccctcagtgaacagaagggtcatcagttctaagaatttttgagctgaaataaaacatatagggtatatgcttaaataaaataaaaaatctttataggcaatacctttgaagaaaaaacaataagcatttatttcaaatgaccactaggctatgtagttttgtttgttcaactttgcttttaatcagaatctctttgtttatgatcaaaggagcaaactcaaaattccaacaggataagcaataggaaatggtgaggtctggagcaaataaaaaaagtcattcacccacctaaaggtattttaagccattttaaaaataaaacactataccatgcaaacaaaacaatctagttatactgtgcactttcagtttgcattctccagattatgaatctcagctggaaaataacatgacttacaagcaaacattcagatatttagtatataactggatatatgaaagattccagtatgataactttttattcgtgaacttagtgttgtctagtttcaggtgagatctgcctaagtacttaaaaatgtaccacctggtaacatagtcatgggttg

SEQ ID NO: 32503 - DNA, 601 bp, Human
agcaaataaaaaaagtcattcacccacctaaaggtattttaagccattttaaaaataaaacactataccatgcaaacaaaacaatctagttatactgtgcactttcagtttgcattctccagattatgaatctcagctggaaaataacatgacttacaagcaaacattcagatatttagtatataactggatatatgaaagattccagtatgataactttttattcgtgaacttagtgttgtctagtttcaggtgagatctgcctaagtacttaaaaatgtaccacctggtaacatagtcrtgggttggtaaattgaatggattcaggtctcctgccttggtttgcagccatgaccttgggcaagttacctcaccctatttgagttctgatcccttctccataaaatgaatgctcagacaagatgaaggaaggcaaatcatgactctcttgctggcattcccttcccatgcactgaactcaggcagacatcaccctttgatagtgaagctatttacccaccatgctggtgacaaccttttcaatgcacagctctaggcagccactactatcgctgatggcctgtgtgtgagatgaagccta

SEQ ID NO: 32504 - DNA, 601 bp, Human
tgcattctccagattatgaatctcagctggaaaataacatgacttacaagcaaacattcagatatttagtatataactggatatatgaaagattccagtatgataactttttattcgtgaacttagtgttgtctagtttcaggtgagatctgcctaagtacttaaaaatgtaccacctggtaacatagtcatgggttggtaaattgaatggattcaggtctcctgccttggtttgcagccatgaccttgggcaagttacctcaccctatttgagttctgatcccttctccataaaatgaakgctcagacaagatgaaggaaggcaaatcatgactctcttgctggcattcccttcccatgcactgaactcaggcagacatcaccctttgatagtgaagctatttacccaccatgctggtgacaaccttttcaatgcacagctctaggcagccactactatcgctgatggcctgtgtgtgagatgaagcctatattttcccaatcctcgattagataatctctaagagcccatgttggtgtcatgtactgttctgtcttataatgttcaaaacctctaacgaatccatgaattcctttagtc

SEQ ID NO: 32505 - DNA, 601 bp, Human
cctcaccctatttgagttctgatcccttctccataaaatgaatgctcagacaagatgaaggaaggcaaatcatgactctcttgctggcattcccttcccatgcactgaactcaggcagacatcaccctttgatagtgaagctatttacccaccatgctggtgacaaccttttcaatgcacagctctaggcagccactactatcgctgatggcctgtgtgtgagatgaagcctatattttcccaatcctcgattagataatctctaagagcccatgttggtgtcatgtactgttctgtcttrtaatgttcaaaacctctaacgaatccatgaattcctttagtcatggctactctcaagtagccaaacaagtttgttaagtggtattccttccctacccagaacttctctcctcctgcatttattaattttcaaaactgattattaaccgatgatcagtctgcctcctcttacctaaaaagcagccagagaggttaggatgtggctaaatattgttaacaacataaaaaaaaaacttcatccctaaaaatcatttatattcttctttaccattttatagttgtttttcaccagacaacaaaa

SEQ ID NO: 32506 - DNA, 601 bp, Human
ctcctcctgcatttattaattttcaaaactgattattaaccgatgatcagtctgcctcctcttacctaaaaagcagccagagaggttaggatgtggctaaatattgttaacaacataaaaaaaaaacttcatccctaaaaatcatttatattcttctttaccattttatagttgtttttcaccagacaacaaaattataaaaataatgcaattacttggcagaatgtctggaagagcagtcttaaagaggaaaatactacagttgttttaaaaggatatttgctaaactttcaaactggtrttacaattttatagctgcactagcaccctcctccttataacgaactgtctactgacttatgaaacgaagaggaaaattaatgttttctaaaactttattttagaaaatttccaatgtatacaaaagtaaagataataatataatgaatatccatgttccccaaacctagcatcaacaatgatcagtattttgccaattctgtttcatatgtttctttccaattaaacattttaatacctggaaatgaatcatgcatttgcttttgagtttaaacgcactggtagaaacatacgtgtgcag

SEQ ID NO: 32507 - DNA, 601 bp, Human
taaaaaaaaaacttcatccctaaaaatcatttatattcttctttaccattttatagttgtttttcaccagacaacaaaattataaaaataatgcaattacttggcagaatgtctggaagagcagtcttaaagaggaaaatactacagttgttttaaaaggatatttgctaaactttcaaactggtattacaattttatagctgcactagcaccctcctccttataacgaactgtctactgacttatgaaacgaagaggaaaattaatgttttctaaaactttattttagaaaatttccaawgtatacaaaagtaaagataataatataatgaatatccatgttccccaaacctagcatcaacaatgatcagtattttgccaattctgtttcatatgtttctttccaattaaacattttaatacctggaaatgaatcatgcatttgcttttgagtttaaacgcactggtagaaacatacgtgtgcagacttgttaaataaataaaatacacttaaaatttttttaaagcactggtagaaatagaaaatgaccatatgattttctagcattgtcttttataagtaaataatgaaactttaaaa

SEQ ID NO: 32508 - DNA, 601 bp, Human
acaacaaaattataaaaataatgcaattacttggcagaatgtctggaagagcagtcttaaagaggaaaatactacagttgttttaaaaggatatttgctaaactttcaaactggtattacaattttatagctgcactagcaccctcctccttataacgaactgtctactgacttatgaaacgaagaggaaaattaatgttttctaaaactttattttagaaaatttccaatgtatacaaaagtaaagataataatataatgaatatccatgttccccaaacctagcatcaacaatgatcartattttgccaattctgtttcatatgtttctttccaattaaacattttaatacctggaaatgaatcatgcatttgcttttgagtttaaacgcactggtagaaacatacgtgtgcagacttgttaaataaataaaatacacttaaaatttttttaaagcactggtagaaatagaaaatgaccatatgattttctagcattgtcttttataagtaaataatgaaactttaaaatatgtcattgacatatgacttttccttgctttcaggtggtacaataagagtatcagccgagacaaagctg

SEQ ID NO: 32509 - DNA, 601 bp, Human
ttaaaatatgtcattgacatatgacttttccttgctttcaggtggtacaataagagtatcagccgagacaaagctgaaaaacttcttttggacacagtaagtctccttaacctgtcttttgacataaaataaaatgaattaagtgcactgtctcatgtctggaatcccagcgatttggcaggccaaggtgggaggatcacttgagcccaggagttcaaggttacagtgagctatcattgtaccactgcacttcagcctgggcaagatcaagaccctgtcaaaagaagaaagagaggaaggragggagggagggagggaagaaaggtaaaaatgaaagaaagaaagaattgtactgttttttcagctttgctgcgttttatgccaatgcagtgggttgacatgttggattaacgatagttttcatgtctggtgaaaatattctgggaatttacaggactagcaaaccacaggataagaaacctgggcttggcattgacatggagacatcatcaccgctgcagcagtctttgtgagtggtgatggctggccatggggtgccatcagggctggtcagtcatgccttcttctcagtgtgggtcag

SEQ ID NO: 32510 - DNA, 601 bp, Human
tggacacagtaagtctccttaacctgtcttttgacataaaataaaatgaattaagtgcactgtctcatgtctggaatcccagcgatttggcaggccaaggtgggaggatcacttgagcccaggagttcaaggttacagtgagctatcattgtaccactgcacttcagcctgggcaagatcaagaccctgtcaaaagaagaaagagaggaagggagggagggagggagggaagaaaggtaaaaatgaaagaaagaaagaattgtactgttttttcagctttgctgcgttttatgccaatgcrgtgggttgacatgttggattaacgatagttttcatgtctggtgaaaatattctgggaatttacaggactagcaaaccacaggataagaaacctgggcttggcattgacatggagacatcatcaccgctgcagcagtctttgtgagtggtgatggctggccatggggtgccatcagggctggtcagtcatgccttcttctcagtgtgggtcagagatgtctgtgactctgattcggcctgactcagctgtgagtccagaggaaacatagcacttgttttaacttacatttcatcaacagtt

SEQ ID NO: 32511 - DNA, 601 bp, Human
ctccttaacctgtcttttgacataaaataaaatgaattaagtgcactgtctcatgtctggaatcccagcgatttggcaggccaaggtgggaggatcacttgagcccaggagttcaaggttacagtgagctatcattgtaccactgcacttcagcctgggcaagatcaagaccctgtcaaaagaagaaagagaggaagggagggagggagggagggaagaaaggtaaaaatgaaagaaagaaagaattgtactgttttttcagctttgctgcgttttatgccaatgcagtgggttgacatgytggattaacgatagttttcatgtctggtgaaaatattctgggaatttacaggactagcaaaccacaggataagaaacctgggcttggcattgacatggagacatcatcaccgctgcagcagtctttgtgagtggtgatggctggccatggggtgccatcagggctggtcagtcatgccttcttctcagtgtgggtcagagatgtctgtgactctgattcggcctgactcagctgtgagtccagaggaaacatagcacttgttttaacttacatttcatcaacagttatcctctaaagcca

SEQ ID NO: 32512 - DNA, 601 bp, Human
tgtcttttgacataaaataaaatgaattaagtgcactgtctcatgtctggaatcccagcgatttggcaggccaaggtgggaggatcacttgagcccaggagttcaaggttacagtgagctatcattgtaccactgcacttcagcctgggcaagatcaagaccctgtcaaaagaagaaagagaggaagggagggagggagggagggaagaaaggtaaaaatgaaagaaagaaagaattgtactgttttttcagctttgctgcgttttatgccaatgcagtgggttgacatgttggattaacratagttttcatgtctggtgaaaatattctgggaatttacaggactagcaaaccacaggataagaaacctgggcttggcattgacatggagacatcatcaccgctgcagcagtctttgtgagtggtgatggctggccatggggtgccatcagggctggtcagtcatgccttcttctcagtgtgggtcagagatgtctgtgactctgattcggcctgactcagctgtgagtccagaggaaacatagcacttgttttaacttacatttcatcaacagttatcctctaaagccatgcagtgtgc

SEQ ID NO: 32513 - DNA, 601 bp, Human
tcatgtctggaatcccagcgatttggcaggccaaggtgggaggatcacttgagcccaggagttcaaggttacagtgagctatcattgtaccactgcacttcagcctgggcaagatcaagaccctgtcaaaagaagaaagagaggaagggagggagggagggagggaagaaaggtaaaaatgaaagaaagaaagaattgtactgttttttcagctttgctgcgttttatgccaatgcagtgggttgacatgttggattaacgatagttttcatgtctggtgaaaatattctgggaatttacrggactagcaaaccacaggataagaaacctgggcttggcattgacatggagacatcatcaccgctgcagcagtctttgtgagtggtgatggctggccatggggtgccatcagggctggtcagtcatgccttcttctcagtgtgggtcagagatgtctgtgactctgattcggcctgactcagctgtgagtccagaggaaacatagcacttgttttaacttacatttcatcaacagttatcctctaaagccatgcagtgtgcatagcaggaccgattttactcagggatgtcaagattaagg

SEQ ID NO: 32514 - DNA, 601 bp, Human
gccaactcaaacctggcgctgccaggctgtgttattggataacaaagtagaacttgattaatatgaactaattgagtggagtgcaaaattagctaaaactctgaattacactgtgtttaaacaagtatagttttgttatattaatcacacatcagttaatgacgtctatggagcacttcaaacagcccacattaatgacttctaaaagatgattcctgtattacagcagttcttgtgaggtgctaagtgctaagtacattttgcttgctctggcagttgaaacattcctccttactgatayatatatatatatatatatatatatatatatatttatatatatatatatattttttttttttttttttttttttgagacagagtctccctctgtcacccaggctagcatgtagtggcatgatctcggcttactgcaacctccgctgcctgggttcgagtgattctcctgcctcagcctcctaagtagctgggattacaggcatgtgccatcacacctaactcatttttgtatttttactagagacggggtgtcgccctgttggccagactggtctcaaaactcctgacctcaggtgatccg

SEQ ID NO: 32515 - DNA, 601 bp, Human
atagtattccatggcgtatatgtgccacattttctttgtccagtctatcattgatgggaatttgggttggtaaaaggatgagttcatgtcctttgcagggacatggataaagctggaaaacatcattctcagcaaactaacacaggaatagaaaaccaaacactgcatgttctcactcataagtgggagatgaacaacaagaacacatggacacatcacacaccaggaacatggatacatcacacaccagggtctgtcagtgggtggggggctaggggagagataggattaggagaaatamctaatgtagatgacaggtttatgggtgcagcaaaccaccatggcacatgtatacccatgtaacaaaccttcatgttctgcacatgtaccccagaacttcaagtataataataataaaaaaagagatgaattgattcattacacctttttatgaactaaaactcctggtgtactgccccatacatatttcgccactagactataaacaatttatcttgttcctgctgtacttaggcacccaaaagtgtatctagcaccttgtagttgttcaataaatatttgttgaatgaatgaatgaata

SEQ ID NO: 32516 - DNA, 601 bp, Human
tgtgccacattttctttgtccagtctatcattgatgggaatttgggttggtaaaaggatgagttcatgtcctttgcagggacatggataaagctggaaaacatcattctcagcaaactaacacaggaatagaaaaccaaacactgcatgttctcactcataagtgggagatgaacaacaagaacacatggacacatcacacaccaggaacatggatacatcacacaccagggtctgtcagtgggtggggggctaggggagagataggattaggagaaatacctaatgtagatgacaggttyatgggtgcagcaaaccaccatggcacatgtatacccatgtaacaaaccttcatgttctgcacatgtaccccagaacttcaagtataataataataaaaaaagagatgaattgattcattacacctttttatgaactaaaactcctggtgtactgccccatacatatttcgccactagactataaacaatttatcttgttcctgctgtacttaggcacccaaaagtgtatctagcaccttgtagttgttcaataaatatttgttgaatgaatgaatgaatacactgaaggcttaataaatg

SEQ ID NO: 32517 - DNA, 601 bp, Human
agtgggtggggggctaggggagagataggattaggagaaatacctaatgtagatgacaggtttatgggtgcagcaaaccaccatggcacatgtatacccatgtaacaaaccttcatgttctgcacatgtaccccagaacttcaagtataataataataaaaaaagagatgaattgattcattacacctttttatgaactaaaactcctggtgtactgccccatacatatttcgccactagactataaacaatttatcttgttcctgctgtacttaggcacccaaaagtgtatctagcaccytgtagttgttcaataaatatttgttgaatgaatgaatgaatacactgaaggcttaataaatgtttttaaactaacaactccacttaagggggacctgggtgatcataagcatcactgcaggagctttttaaaaatacaaattcctggactccaggcctatccagtcagaacctcaagaggtggcacccaagttattctgggacttacctacatttgggagccactaaaaagcatctcctaatgtgccatatcagttcttccaatgttgcctcctcccagaagtctctcatgccttccctc

SEQ ID NO: 32518 - DNA, 601 bp, Human
aatgtagatgacaggtttatgggtgcagcaaaccaccatggcacatgtatacccatgtaacaaaccttcatgttctgcacatgtaccccagaacttcaagtataataataataaaaaaagagatgaattgattcattacacctttttatgaactaaaactcctggtgtactgccccatacatatttcgccactagactataaacaatttatcttgttcctgctgtacttaggcacccaaaagtgtatctagcaccttgtagttgttcaataaatatttgttgaatgaatgaatgaatacaytgaaggcttaataaatgtttttaaactaacaactccacttaagggggacctgggtgatcataagcatcactgcaggagctttttaaaaatacaaattcctggactccaggcctatccagtcagaacctcaagaggtggcacccaagttattctgggacttacctacatttgggagccactaaaaagcatctcctaatgtgccatatcagttcttccaatgttgcctcctcccagaagtctctcatgccttccctcgccctagctatggaacgtggtttttcttgtctttgaacctttatg

SEQ ID NO: 32519 - DNA, 601 bp, Human
atatttgttgaatgaatgaatgaatacactgaaggcttaataaatgtttttaaactaacaactccacttaagggggacctgggtgatcataagcatcactgcaggagctttttaaaaatacaaattcctggactccaggcctatccagtcagaacctcaagaggtggcacccaagttattctgggacttacctacatttgggagccactaaaaagcatctcctaatgtgccatatcagttcttccaatgttgcctcctcccagaagtctctcatgccttccctcgccctagctatggaacrtggtttttcttgtctttgaacctttatgggtcaaatgttattatcagtattattacttctccagtggctctgttctcactctgcctccaatctcagcagtttctcttctgtctttacccatctaggtagatggtaaattccttgcaagtgggtaactctcttagaacaccttacaacatctcacacatagggtgacctgaagttcagacattctaaagtgtcattgaagactcaatgttgacttaataattggtttgtttcaagagaagaaaagcaccacctccagaatgaaagatggct

SEQ ID NO: 32520 - DNA, 601 bp, Human
tggctctgttctcactctgcctccaatctcagcagtttctcttctgtctttacccatctaggtagatggtaaattccttgcaagtgggtaactctcttagaacaccttacaacatctcacacatagggtgacctgaagttcagacattctaaagtgtcattgaagactcaatgttgacttaataattggtttgtttcaagagaagaaaagcaccacctccagaatgaaagatggctgtatttcagagacactcttaaagtataatgcagcataacaagactatgaattatcagtccatctkttcacaataacttaccctgtgtgttgagattatcttctgaaaggtcaccttcaaattatatgaacagaaagaaagaaaaatactcctaacacaaccaacatgtctcagatggagactgacaatggaataattacttccaataagtagcaaacttagcatgtgataataatggccaataatactctaatagttcttgtcctagtattgtattccaggagcaattctaggcacattacctcagttctcccatcaaccttccaaaggtcattttacagatgaggaaactgaagctcatacagt

SEQ ID NO: 32521 - DNA, 601 bp, Human
gtcaccttcaaattatatgaacagaaagaaagaaaaatactcctaacacaaccaacatgtctcagatggagactgacaatggaataattacttccaataagtagcaaacttagcatgtgataataatggccaataatactctaatagttcttgtcctagtattgtattccaggagcaattctaggcacattacctcagttctcccatcaaccttccaaaggtcattttacagatgaggaaactgaagctcatacagttactcatctttataagttccttttaaggccaggcacggtggctyatgcttgtaatcccagcactttgggaggccgaggcaggcggatcactggaggtcaggagttcaagaccagcctggacatcatagtgaaacctcatctctactaaaaatacaaaaaattagccaggcgtggtggcgggcacctgtaattccagctacttggaaagttgaaggaagacagtcacttgaacccaggaagtggaggttacagtgagctgagattgtgcaactgcactccagcctgggtgacagaatgagactccatcttaaaaaaaaaaaaaaatccttttaaacccagagatt

SEQ ID NO: 32522 - DNA, 601 bp, Human
aatattgtggtaagagttggaaaatatctgtaaagagtctgatacatggggagctctaaaagggcagagcttatgtctctgtctccattcatggttcatgtcagcatgagaacagtctgggatccatgtaggagaccaagaaatatctacggaaggacaggagtaaatgaaacggtagccattcttactgaaatctgctctatgccaagtgggcctacagtatttcctccttctgtgggcaagaaagtggagctggaggcataagcctggtttcctgagatcactaactttccattctttytaaccattccagggcaaagaaggagccttcatggtaagggattccaggactgcaggaacatacaccgtgtctgttttcaccaaggctgttgtaaggtatggagctaactctgctcagcaaagtggagagaaacacttctgaagtgtgtgagcactggggaaaagacaacaaagttagacagtgcaagaggtagaggctcactagaaatggtctgttttccctctttactccgagaaaaccaaagccatggagatcaaggatagaacttaagagacttagaaagtgacagagctgggagtg

SEQ ID NO: 32523 - DNA, 601 bp, Human
attgtggtaagagttggaaaatatctgtaaagagtctgatacatggggagctctaaaagggcagagcttatgtctctgtctccattcatggttcatgtcagcatgagaacagtctgggatccatgtaggagaccaagaaatatctacggaaggacaggagtaaatgaaacggtagccattcttactgaaatctgctctatgccaagtgggcctacagtatttcctccttctgtgggcaagaaagtggagctggaggcataagcctggtttcctgagatcactaactttccattctttctawccattccagggcaaagaaggagccttcatggtaagggattccaggactgcaggaacatacaccgtgtctgttttcaccaaggctgttgtaaggtatggagctaactctgctcagcaaagtggagagaaacacttctgaagtgtgtgagcactggggaaaagacaacaaagttagacagtgcaagaggtagaggctcactagaaatggtctgttttccctctttactccgagaaaaccaaagccatggagatcaaggatagaacttaagagacttagaaagtgacagagctgggagtggat

SEQ ID NO: 32524 - DNA, 601 bp, Human
gagtaaatgaaacggtagccattcttactgaaatctgctctatgccaagtgggcctacagtatttcctccttctgtgggcaagaaagtggagctggaggcataagcctggtttcctgagatcactaactttccattctttctaaccattccagggcaaagaaggagccttcatggtaagggattccaggactgcaggaacatacaccgtgtctgttttcaccaaggctgttgtaaggtatggagctaactctgctcagcaaagtggagagaaacacttctgaagtgtgtgagcactggggwaaagacaacaaagttagacagtgcaagaggtagaggctcactagaaatggtctgttttccctctttactccgagaaaaccaaagccatggagatcaaggatagaacttaagagacttagaaagtgacagagctgggagtggatgccaggtcctctttcaattagcatctccaattttagagttctaaagacataaaatacttggcactgtattggatgagtatataatttaatacatagaataacagaagagatatttctatctggaagcaaaaatatatgaactccagttctggctctg

SEQ ID NO: 32525 - DNA, 601 bp, Human
gtaaatgaaacggtagccattcttactgaaatctgctctatgccaagtgggcctacagtatttcctccttctgtgggcaagaaagtggagctggaggcataagcctggtttcctgagatcactaactttccattctttctaaccattccagggcaaagaaggagccttcatggtaagggattccaggactgcaggaacatacaccgtgtctgttttcaccaaggctgttgtaaggtatggagctaactctgctcagcaaagtggagagaaacacttctgaagtgtgtgagcactggggaamagacaacaaagttagacagtgcaagaggtagaggctcactagaaatggtctgttttccctctttactccgagaaaaccaaagccatggagatcaaggatagaacttaagagacttagaaagtgacagagctgggagtggatgccaggtcctctttcaattagcatctccaattttagagttctaaagacataaaatacttggcactgtattggatgagtatataatttaatacatagaataacagaagagatatttctatctggaagcaaaaatatatgaactccagttctggctctgct

SEQ ID NO: 32526 - DNA, 601 bp, Human
aattagaacatttgttagaactaagctgtttgacaatgaccaaagtgcagtcagaattaagagaagagacaaataatttttaaggtgtcttcggaaaatttttttggaagactgaggatgtgagcaggacgtggagcaagggcaggtggcaaagaggaagggcccgatccagggatgggagggaacacagtgtacatcacagaggggccgtgcctctaccatggctgggagacagtaaggaggtgacctgcaaccccacaggtatgacggagaagggatgaaacaaagtctgtgtcgaggytccccacaactacccccagcttcagggattcactaggaggccttccaggacaaagacttattgagatttaatacagcaaagtgatacaaagcaaaatcagcaacgggaaaagacacatgggacaaaatctagaggaaacaaaacacaagcttccaagagtcctctcccactggagccaaacaggacgtgcttaattccgccagcaacaagttgtaaccacacgttagcagtctaccaggggagctcattagagactcagtacccaaggcttttattggaggctgtttccacagacagccc

SEQ ID NO: 32527 - DNA, 601 bp, Human
cagtgtacatcacagaggggccgtgcctctaccatggctgggagacagtaaggaggtgacctgcaaccccacaggtatgacggagaagggatgaaacaaagtctgtgtcgaggctccccacaactacccccagcttcagggattcactaggaggccttccaggacaaagacttattgagatttaatacagcaaagtgatacaaagcaaaatcagcaacgggaaaagacacatgggacaaaatctagaggaaacaaaacacaagcttccaagagtcctctcccactggagccaaacaggacrtgcttaattccgccagcaacaagttgtaaccacacgttagcagtctaccaggggagctcattagagactcagtacccaaggcttttattggaggctgtttccacagacagcccctgcctagcacatgccaaagttccagatacccaaaaggaaaacaagcgttcaccataaaacacattgtttctagcagacggtttaggtacagctcgccacccttatcagttagggaaagagccctcccgaaatccaagttcccaaacaccagccaagggttaaccatgcaagcaggtctttctaagg

SEQ ID NO: 32528 - DNA, 601 bp, Human
aggggagctcattagagactcagtacccaaggcttttattggaggctgtttccacagacagcccctgcctagcacatgccaaagttccagatacccaaaaggaaaacaagcgttcaccataaaacacattgtttctagcagacggtttaggtacagctcgccacccttatcagttagggaaagagccctcccgaaatccaagttcccaaacaccagccaagggttaaccatgcaagcaggtctttctaaggagggtagtcaggcctgttatgttcatcctctgcagcttatttgacttatraagtcaaataagggtgaaggggtcagagaggctttctcaatgtatgctgacaatcagttaaattcatagaataggcaaggcaaacacatagcaaatatttccattccctcattttgtggcaatggaagaaccatcaccaatccatcacagcattgctgtccactgggtccagacacaacctcagagtcctttttaacacagtactgcagcacccaggcccaatctgtcaagacagacttataagttgaacaatatctgccaccttgtgagaggttataagacaaagataataagaactta

SEQ ID NO: 32529 - DNA, 601 bp, Human
ggaaaacaagcgttcaccataaaacacattgtttctagcagacggtttaggtacagctcgccacccttatcagttagggaaagagccctcccgaaatccaagttcccaaacaccagccaagggttaaccatgcaagcaggtctttctaaggagggtagtcaggcctgttatgttcatcctctgcagcttatttgacttatgaagtcaaataagggtgaaggggtcagagaggctttctcaatgtatgctgacaatcagttaaattcatagaataggcaaggcaaacacatagcaaatattkccattccctcattttgtggcaatggaagaaccatcaccaatccatcacagcattgctgtccactgggtccagacacaacctcagagtcctttttaacacagtactgcagcacccaggcccaatctgtcaagacagacttataagttgaacaatatctgccaccttgtgagaggttataagacaaagataataagaacttaatactcgtagacttttttgtgtctcaacattgcttcttaataatcattacatttgtgtttcatttgtttaagtgagaacaatccctgtataaagcattat

SEQ ID NO: 32530 - DNA, 601 bp, Human
aaaagtatgtgttcgattccatccctcttctcatcaactatcaccaacataatggaggaggtaagctctagagcaggggtggacccgggccgcccagcaggaggtgagcagcaggtgagcaagcattactgcctgagctctgccttctgtcagatcagcgtcattagattctcataagagtgcaagccctattgtgaacagcacttgtgggatctaggttgtgtgctccttataagaatcaaatgcctgatgatctgagatggaacagtttcatcctgaaagcaaccccctgccacatccmtccatggataaactgtcttccacaaagccgatccctggtgccaaaaaggttggggactgctgctctagaggacaaagccagagggcacctgggttagacttttttgaattgctatcaaggaatacctgaggctgggtaatttataaagaaaagaggtttaattggtccatggttgtataggaagcatggtgccggcatcttcttggcttttagggagccctcaggaagctttcagtcatggcagaaggcaaaaggggagcaggagtatcacatggcaggagcaggagcgaggagggagaa

SEQ ID NO: 32531 - DNA, 601 bp, Human
ggggactgctgctctagaggacaaagccagagggcacctgggttagacttttttgaattgctatcaaggaatacctgaggctgggtaatttataaagaaaagaggtttaattggtccatggttgtataggaagcatggtgccggcatcttcttggcttttagggagccctcaggaagctttcagtcatggcagaaggcaaaaggggagcaggagtatcacatggcaggagcaggagcgaggagggagaagatgccacagacatttaaacaaccaggtcttgcatgaactcagagtgataaytcatttattatcacaaggacagtgacagcaccaaggcatttgtgatggatcccacctaatgacccaaacaccacctcccatcccaccaggccccacctccaacatagggcttttcttttcttttctttcttttcctttcttttcttttctttctttttttttttttttgagacagagtttcgctctgttgcccaggctggagtgcagtggctcaatcttggctcactgcaacctccacctcccaggttcaagcaattctcctgcctcagcctcctgattagctgggattacaggcatgtg

SEQ ID NO: 32532 - DNA, 601 bp, Human
gcttttagggagccctcaggaagctttcagtcatggcagaaggcaaaaggggagcaggagtatcacatggcaggagcaggagcgaggagggagaagatgccacagacatttaaacaaccaggtcttgcatgaactcagagtgataactcatttattatcacaaggacagtgacagcaccaaggcatttgtgatggatcccacctaatgacccaaacaccacctcccatcccaccaggccccacctccaacatagggcttttcttttcttttctttcttttcctttcttttcttttctttctttttttttttttttgagacagagtttcgctctgttgcccaggctggagtgcagtggctcaatcttggctcactgcaacctccacctcccaggttcaagcaattctcctgcctcagcctcctgattagctgggattacaggcatgtgccaccacatcccgctaattttggtattttttgtagagacagggtttcaccgcattggccaggctggtcttgaactcctgacctcaggtaatctgcccgcctcagcctcccatactgctgggattacaggtgtaagccacagtgcccagccaggg

SEQ ID NO: 32533 - DNA, 601 bp, Human
cacaaggacagtgacagcaccaaggcatttgtgatggatcccacctaatgacccaaacaccacctcccatcccaccaggccccacctccaacatagggcttttcttttcttttctttcttttcctttcttttcttttctttctttttttttttttttgagacagagtttcgctctgttgcccaggctggagtgcagtggctcaatcttggctcactgcaacctccacctcccaggttcaagcaattctcctgcctcagcctcctgattagctgggattacaggcatgtgccaccacatccmgctaattttggtattttttgtagagacagggtttcaccgcattggccaggctggtcttgaactcctgacctcaggtaatctgcccgcctcagcctcccatactgctgggattacaggtgtaagccacagtgcccagccagggattacatttcaacatgagatttggaggggacaaacatccaaactatatcagcacccacacaggagacttaatgaaaactggcaaaagctcgccctggcttctttttgactataaataataaataaatatacaaatagaaaaatatgacaaatatttaa

SEQ ID NO: 32534 - DNA, 601 bp, Human
ctgcaagttgagagcatctagaagtgtttctctgcataagagagtgttaaaattctttggaatacctttaggcgtggcatgatctccagtgctgcagcccctactatgttttcttgccctacggaattgcttcactcacttgggattacctgcctggactctgaaggcatttggctttgcatcccttggtcccaactgtgtgctgcctgtggagaaggctggtctaattttcatttcttatctcctagcttggtggttctcaaatttcagtgtgcatcaaagtcttctagaatgcttattraaaatgttgactcctggctcctatccaaacactcaccaaaacacaatccttgatagggtcctggagtctacttttttttctggcatgatctccctctgtcacccaggctggagatgcagtggcgtaatcatggctcactgctgccttgacctcctgggctcaagcgatcctcccacctcagcctcccaagtagctactatgcctggctaatttttaaaaattttttgtagagacagggtctcactatgttgccctggctggtcttaaactcctgggctcaggcaatcctcctgcctcagc

SEQ ID NO: 32535 - DNA, 601 bp, Human
gcatttggctttgcatcccttggtcccaactgtgtgctgcctgtggagaaggctggtctaattttcatttcttatctcctagcttggtggttctcaaatttcagtgtgcatcaaagtcttctagaatgcttattaaaaatgttgactcctggctcctatccaaacactcaccaaaacacaatccttgatagggtcctggagtctacttttttttctggcatgatctccctctgtcacccaggctggagatgcagtggcgtaatcatggctcactgctgccttgacctcctgggctcaagckatcctcccacctcagcctcccaagtagctactatgcctggctaatttttaaaaattttttgtagagacagggtctcactatgttgccctggctggtcttaaactcctgggctcaggcaatcctcctgcctcagcctcccaaagtgttgggattacaggcatgagccactgtgcccagctgagtctacattttaaacaagcatgctaggtgattttgatacaagtggtcagagggcaatactttgagaaccactgccacgcatgggcttctttatccctaaccagcaccgtgtccggcaca

SEQ ID NO: 32536 - DNA, 601 bp, Human
ctcccaaagtgttgggattacaggcatgagccactgtgcccagctgagtctacattttaaacaagcatgctaggtgattttgatacaagtggtcagagggcaatactttgagaaccactgccacgcatgggcttctttatccctaaccagcaccgtgtccggcacacagtaggtgctcaatactgcctgctgttgagtctctgcctcaaagcagtggaaatctggctgtttaggtaccagaccaagcactggggaaagagtgcctctttagcctccttatgaaaataagggtattctaatmaatgtagaatcttgatgtgtccgtgctggatgggatttcagatattacctggtcagcctactcattttgttggtgaggaaattgagcctcggaatctcgtatttgtttgttaaacatttcttgagagcctcccatgtgccagacactgtgctagcttgtgcctctgcacaaattctctttaaatctttctctttaactgcccctctgccccagtaaggcctaatagggttatgtgtatatagcaggtgctcttaatagatgaatgaatgaaagaatgatcagctcaatgaaatttactta

SEQ ID NO: 32537 - DNA, 601 bp, Human
gcatgagccactgtgcccagctgagtctacattttaaacaagcatgctaggtgattttgatacaagtggtcagagggcaatactttgagaaccactgccacgcatgggcttctttatccctaaccagcaccgtgtccggcacacagtaggtgctcaatactgcctgctgttgagtctctgcctcaaagcagtggaaatctggctgtttaggtaccagaccaagcactggggaaagagtgcctctttagcctccttatgaaaataagggtattctaataaatgtagaatcttgatgtgtccrtgctggatgggatttcagatattacctggtcagcctactcattttgttggtgaggaaattgagcctcggaatctcgtatttgtttgttaaacatttcttgagagcctcccatgtgccagacactgtgctagcttgtgcctctgcacaaattctctttaaatctttctctttaactgcccctctgccccagtaaggcctaatagggttatgtgtatatagcaggtgctcttaatagatgaatgaatgaaagaatgatcagctcaatgaaatttacttagtgtgaaaaatgacatagaaaaa

SEQ ID NO: 32538 - DNA, 601 bp, Human
ggtgcatctgggctactggctcaacaaggacaaggtggctatcaaaaccattcgggaaggggctatgtcagaagaggacttcatagaggaggctgaagtaatgatgtgagtgctcagaacaaggatatgcagaaactctggggggaacatcggttcagtgttcttgaaatgccattcaaacgccagggggtactatctccctgcgcaaactcccagcagtggcttcctattgcacagagaatacaatcaaactcttcacagtggtctccaaggcccaccataatctgatcatgcccacctyccccttctcagctcctacccatctctcctccagtccatgacatgccagccacactggcctctgctcatcttcacacacacagctgactccttgccatttttcaggtctcagctccaatgacatgtttttgttttggggagggaatgaatattattttcatccaaaccataaattagacaaaatgaccattggctattttggtaccataatattttcggcatttttgggagactgagtttaggccatctcaccccttgtctttttcctccaggaaactctctcatcccaaactggtgcagc

SEQ ID NO: 32539 - DNA, 601 bp, Human
acctggaagaggcatgtgtcatccacagagacttggtatgagcatgcagggtgaacacccacaggtccagggtaaagggacagttctcactgaaatgactgggaacgcattaataaataatacattacagataatctcctttcctttctcaacttctcccttccttcacctactttgggtggtcctagtggaaagggcttcatgaggacttacttctgggctctgatcccagcccaaactctttcacctcctgcatttcagtttatattcttccaaaatggagataactgccactccttcttaacctctctgtgactcaatttcctcctggtaaattgaggaaactgagtttgtctgaaggtattattcaagggtctaccagaatcacactggggaagcccttaagctactctcagaatctctggtggctgggactcaggaatattcattttaacacattccccatatgatttgtatgcacattaaaatttgagatatgcagctgggtgcggtggctcatgcctgtactcccagcactttgggaggccgaggtgggcgaatcacgaggtcaggagttcgagaccaccctggccaacatggt

SEQ ID NO: 32540 - DNA, 601 bp, Human
ttcagtttatattcttccaaaatggagataactgccactccttcttaacctctctgtgactcaatttcctcctggtaaattgaggaaactgagtttgtctgaaggtattattcaagggtctaccagaatcacactggggaagcccttaagctactctcagaatctctggtggctgggactcaggaatattcattttaacacattccccatatgatttgtatgcacattaaaatttgagatatgcagctgggtgcggtggctcatgcctgtactcccagcactttgggaggccgaggtgggygaatcacgaggtcaggagttcgagaccaccctggccaacatggtgaaaccccatctctactgaaaattcaaaaaattagctgagcttactggcgggcacctgtaaccctagctacttgggaggctgaggcaggagaatcacttgaacccaggaggcagaggttgcagtgagctgagatcaagccactacactccagcctgggtgacacagtaagactccatctaaaaaaaaaaaaaaaaaaaattgagacacactggagtgttatctccaatggctttttcaatgcaacagtctataata

SEQ ID NO: 32541 - DNA, 601 bp, Human
taagactccatctaaaaaaaaaaaaaaaaaaaattgagacacactggagtgttatctccaatggctttttcaatgcaacagtctataatactaattaggggtcaggtactctccctattgaagaacagttttaagaggattaacaacatcaaaacattcttaatttagtcaactgggagatgctttcttcctgttatccctgatgttaacatttcctatcacatcaggttgcattagagcctatctttggttagacaacaccaaggatttctaattagaactcaagaatgaagataaactyactcatcttgatagtggatcttacacattcaactttccagttaacttccagcggcatttgtgaggcttaattaacatttgtaaagctccatgatgcccttgtatgacagcactgcagtaaagcaaaggactgtgattataggagactccttaactactgatgactcatcaacagttttcctctccgcctttgtttgcctgtctcctctccaggctgccagaaattgtttggtgggagaaaaccaagtcatcaaggtgtctgactttgggatgacaaggtaaaagagggatgtggtgccgg

SEQ ID NO: 32542 - DNA, 601 bp, Human
tccctgatgttaacatttcctatcacatcaggttgcattagagcctatctttggttagacaacaccaaggatttctaattagaactcaagaatgaagataaacttactcatcttgatagtggatcttacacattcaactttccagttaacttccagcggcatttgtgaggcttaattaacatttgtaaagctccatgatgcccttgtatgacagcactgcagtaaagcaaaggactgtgattataggagactccttaactactgatgactcatcaacagttttcctctccgcctttgtttrcctgtctcctctccaggctgccagaaattgtttggtgggagaaaaccaagtcatcaaggtgtctgactttgggatgacaaggtaaaagagggatgtggtgccggtgaagtctcaggaatgggactgaggcccccggaacattctgaccttctccctccactctcttcccaggttcgttctggatgatcagtacaccagttccacaggcaccaaattcccggtgaagtgggcatccccagaggttttctctttcagtcgctatagcagcaagtccgatgtgtggtcatttggtgagtgtca

SEQ ID NO: 32543 - DNA, 601 bp, Human
cagaatggacttgaaagaaattgtactaacagcatttttggatgactcccctctccccagtgtgtataactaggaaggttggggctgatgtgcagtcatctcactatgggtgatgaaactgatcacactgcaccaagcaagcaagggccccacaatgagacatttggagcaatggccactttagcacattcaccttctgactctgaatggggtttattcagccaaagggtgtcagcctgggaatttcctggggcatattaccattacagggttgggctgaaattagtccctgtctaggatrtattatctgaagagagtccagaaatgaggttgatggatggatgcagaattgagagatcaatggaaaaaagtgtgaaaaaactgggggtaccagcctaagcaacagaaacctggatgagctgaaaactccatgcctgcatcagcccattggactttgtcctacgttttaagtttctttgccctaattagcagtgtgctattcagaacaagtcaacctctttgtactttgctcaatttttttatctatacatttctcatctgtgtattaaagcaatcattctgaaaccatgtttcagcatcg

SEQ ID NO: 32544 - DNA, 601 bp, Human
aggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcartgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccatttt

SEQ ID NO: 32545 - DNA, 601 bp, Human
caggggcagccaaagcacctggaggaggaggaggggcagctgaagcacctggtgcagcaggaggggcagctgaagcatctggtgcagcaggaggggcagctggagcagcaggagaggcaggtggagcacctggagcagcaggtggggcagctgaagcacctagaggagcaggagggacaactgaagcatctggagcagcagcaggggcagttggaggtcccagagcagcaggtggggcagccaaagaacctggagcaggaggagaagcaactggagctcccagagcagcaagagggccagstgaagcacctggagaagcaggaggcacagctggagctcccagagcagcaggtaggacagccaaagcacctggaacagcaggaaaagcacctagagcacccagagcagcaggacggacaactaaaacatctggagcagcaggaggggcagctgaaggacctggagcagcagaaggggcagctggagcagcctgtgtttgccccagctccaggccaggtccaagacattcaaccagccctgcccacaaagggagaagtattgcttcctgtagagcaccagcagcagaagcaggaggtgcagt

SEQ ID NO: 32546 - DNA, 601 bp, Human
ggtgctgcagctgaagcagctagagaagcagcaggggcagccaaagcacctggaggaggaggaggggcagctgaagcacctggtgcagcaggaggggcagctgaagcatctggtgcagcaggaggggcagctggagcagcaggagaggcaggtggagcacctggagcagcaggtggggcagctgaagcacctagaggagcaggagggacaactgaagcatctggagcagcagcaggggcagttggaggtcccagagcagcaggtggggcagccaaagaacctggagcaggaggagaagcarctggagctcccagagcagcaagagggccaggtgaagcacctggagaagcaggaggcacagctggagctcccagagcagcaggtaggacagccaaagcacctggaacagcaggaaaagcacctagagcacccagagcagcaggacggacaactaaaacatctggagcagcaggaggggcagctgaaggacctggagcagcagaaggggcagctggagcagcctgtgtttgccccagctccaggccaggtccaagacattcaaccagccctgcccacaaagggagaagtattgcttcctgta

SEQ ID NO: 32547 - DNA, 601 bp, Human
cctggagcagcaggaggggcagctggagcacctggagcaccaggaagggcagctggggctcccagagcagcaggtgctgcagctgaagcagctagagaagcagcaggggcagccaaagcacctggaggaggaggaggggcagctgaagcacctggtgcagcaggaggggcagctgaagcatctggtgcagcaggaggggcagctggagcagcaggagaggcaggtggagcacctggagcagcaggtggggcagctgaagcacctagaggagcaggagggacaactgaagcatctggagcarcagcaggggcagttggaggtcccagagcagcaggtggggcagccaaagaacctggagcaggaggagaagcaactggagctcccagagcagcaagagggccaggtgaagcacctggagaagcaggaggcacagctggagctcccagagcagcaggtaggacagccaaagcacctggaacagcaggaaaagcacctagagcacccagagcagcaggacggacaactaaaacatctggagcagcaggaggggcagctgaaggacctggagcagcagaaggggcagctggagcagcctgtgttt

SEQ ID NO: 32548 - DNA, 601 bp, Human
tatggttctccctaggcaggagtgagggccactccagagatcccatgggggagtgatgcccatccctgctgcttgctgggcaccagcagccatctgcactctctgcagagctgggctgagtcctcttctccctccctcctaggtctccctggcaggaaggtgttgctcctctggtctggggaccctgaagtgccccatggagggcatggcactggctcaccttgtcgatgaaggaggcaaacttgttgttgagggtcttgatctgttcacgctcctcagcccgcacccgctggatggtggratcgatttgcaggttgaggggagtcaggagactctggttgacggtgacctcttggatgcctccaggggggcacacagggaagccagggcccccaaagccaccagcaaggccggctccaccacccagaccaaagccaatgccggctccaccaccgaaaccaaatccactcccggcgccaccaaagccatagctgcctccggctctgctgccatagccgccactgatggcacagctgccccctccaatggagatcctcttggagccccccaggccatacagactgcggctgccaaagccagc

SEQ ID NO: 32549 - DNA, 601 bp, Human
tgtgcttcagggttatgaaaagttatggttctccctaggcaggagtgagggccactccagagatcccatgggggagtgatgcccatccctgctgcttgctgggcaccagcagccatctgcactctctgcagagctgggctgagtcctcttctccctccctcctaggtctccctggcaggaaggtgttgctcctctggtctggggaccctgaagtgccccatggagggcatggcactggctcaccttgtcgatgaaggaggcaaacttgttgttgagggtcttgatctgttcacgctcctcrgcccgcacccgctggatggtgggatcgatttgcaggttgaggggagtcaggagactctggttgacggtgacctcttggatgcctccaggggggcacacagggaagccagggcccccaaagccaccagcaaggccggctccaccacccagaccaaagccaatgccggctccaccaccgaaaccaaatccactcccggcgccaccaaagccatagctgcctccggctctgctgccatagccgccactgatggcacagctgccccctccaatggagatcctcttggagccccccaggccatac

SEQ ID NO: 32550 - DNA, 601 bp, Human
gatggcctcatctgtgcttcagggttatgaaaagttatggttctccctaggcaggagtgagggccactccagagatcccatgggggagtgatgcccatccctgctgcttgctgggcaccagcagccatctgcactctctgcagagctgggctgagtcctcttctccctccctcctaggtctccctggcaggaaggtgttgctcctctggtctggggaccctgaagtgccccatggagggcatggcactggctcaccttgtcgatgaaggaggcaaacttgttgttgagggtcttgatctgytcacgctcctcagcccgcacccgctggatggtgggatcgatttgcaggttgaggggagtcaggagactctggttgacggtgacctcttggatgcctccaggggggcacacagggaagccagggcccccaaagccaccagcaaggccggctccaccacccagaccaaagccaatgccggctccaccaccgaaaccaaatccactcccggcgccaccaaagccatagctgcctccggctctgctgccatagccgccactgatggcacagctgccccctccaatggagatcctcttggagccc

SEQ ID NO: 32551 - DNA, 601 bp, Human
agttataaaatagtattcatctgataaattttacacagtttttattactgataggacctcagttagaagagatgttaaatgttgcccaatgatttgattcccgtcttatttcccatttgtgcaagtctctcctctaaaacatcctgatgttatggtcattctttgttttgaggattaattaacatttccacataacgtataaacgttttaagtcttttttttcttaatctagccaaaatatcctttcttttgtttccaatattttttcctcttatccagaccccagagtgtaatttaccarcccgtgtactcctggcattttctttgacgcttcaaagggaagagttaacctactccattctctgatggcctcatctgtgcttcagggttatgaaaagttatggttctccctaggcaggagtgagggccactccagagatcccatgggggagtgatgcccatccctgctgcttgctgggcaccagcagccatctgcactctctgcagagctgggctgagtcctcttctccctccctcctaggtctccctggcaggaaggtgttgctcctctggtctggggaccctgaagtgccccatggag

SEQ ID NO: 32552 - DNA, 601 bp, Human
tcagagtcacaaattcattctctgctgctgtgcgcttgttgatttcatcctcatatctacaggaagaaaggcatgggacacatttgagccagtgggtaggatgaaacagaaaagcagcctgggattcaacattttcccgaatggaatatattctaattgggctttcctgccacagagagcctaagagacgatttttgcttctgctaaatttgccacttctttaatctccccatcctcccataaccatctgtggttcttgcaggtttgctcctagggactaatttgtgctcttcatttccayggacatgggttgttaggaatattacccccttctggccctggtcacccaatagtcttgaagtgtgtgctgcaggaaactgagtccatttctcctgtttaactcacttgttcttgaagtcctccaccaggtcctgcatgcctctgagctctgagtccaggcggccccgttccccgacaatgctgtccagctgcctcctgaggttgttgatgtactgctcgaacaacggctccaggttctgcctcacagtcttggtgccctgctcctgcagcagggtccactttgtttccagaaccttgttct

SEQ ID NO: 32553 - DNA, 601 bp, Human
tgtaggcagcatccacatcctggggaaagagccaacaacctggagttacctgagctcacctttccaatctacccatcttctagtctccatgccaattctcctctcccaggggagcgaggacacaaagccacttctctccttctaaatgaatttgaacccccggcttcatctgctcaccttcttcagagtcacaaattcattctctgctgctgtgcgcttgttgatttcatcctcatatctacaggaagaaaggcatgggacacatttgagccagtgggtaggatgaaacagaaaagcagcytgggattcaacattttcccgaatggaatatattctaattgggctttcctgccacagagagcctaagagacgatttttgcttctgctaaatttgccacttctttaatctccccatcctcccataaccatctgtggttcttgcaggtttgctcctagggactaatttgtgctcttcatttccatggacatgggttgttaggaatattacccccttctggccctggtcacccaatagtcttgaagtgtgtgctgcaggaaactgagtccatttctcctgtttaactcacttgttcttgaagtc

SEQ ID NO: 32554 - DNA, 601 bp, Human
catcgtcaagcctcagctcagcccaccaagggcactagcatcatgaccattcacacaagagcaaggcttaccttcttgaaatagtcagcaaggctgtcggggtcccagcccaggacctctgagcgaaagggcacattcctcagtgccatggctgctctcccgggaagaagctcacaagctgagcatgggcgcttcacccatgggcagagaagctcaaatccagagctcggaggcgttcttggctcttccaactcccagctaccctgtggaacacccctgttggagccgatgtcttttctgscgtagccagatcccagaaagcaacggcttcctctgcgaacaaatatggtctcttctcagaaaacgactcagctagtttcctttaccacttcctctgctgggctctaaataagtaaacaaggaagcccagctctggaggcttgagatgcagagagagccacagggttggtaattccccactggctccagtcaccccaacccagtaggagaggcaatgaaggggtcttaaactccaatgtgagtctgagtaattttcctttaaactctgggcacccatatgtctacactgcattcttgctca

SEQ ID NO: 32555 - DNA, 601 bp, Human
tctcctgcctccaggacaccacgtctcccctttctagtaagtagcgttgatctcattagcagttacaacagttctctgcatctcagagcatggactttaaaaccagataggtgtggcttgagtcttgcctctatcacatgtagtccctagggcttcggaccatttcacttccctgagctgattttgcagctgagtcaaggggataacaatgctgacctcacaacatagtagggagcgctaaatgggacagtgcctgtgagacaccgaattcaaaccctagcacataataggcacatactcwtttgagggcttctgctcccatccttctctccggaactcatggtcaggaaaactcagcggtctatatggcgctcactcaaccagtaaagttgccatagggttccattgctatcttatacacctcccacattctgccccaattccatcgtcaagcctcagctcagcccaccaagggcactagcatcatgaccattcacacaagagcaaggcttaccttcttgaaatagtcagcaaggctgtcggggtcccagcccaggacctctgagcgaaagggcacattcctcagtgccatggctgctct

SEQ ID NO: 32556 - DNA, 601 bp, Human
tcatcttaccacatggtcagggtagagggactataactaagtcatgtggcttgagatctgcccaagcagatgcgttgtccccttctgccaatgaccaagcacagggatccttcaacctttcctctaagtccagaagataagacagcaacgctctggtcccagcaccgccacaagcctcttttcctctaggggcctcagttttcatagctataaattggggctcacatcagttttctgtcctgcttcacaagactctcataaggctccaaggagactgccccaggcgggagcttgaggaccycccttagggtcgtgagcagtgaaagcccaaatgctgtgtctggcactgctcatcatagtcctctatccagccctcccaccctgcctattctttctcctgcctccaggacaccacgtctcccctttctagtaagtagcgttgatctcattagcagttacaacagttctctgcatctcagagcatggactttaaaaccagataggtgtggcttgagtcttgcctctatcacatgtagtccctagggcttcggaccatttcacttccctgagctgattttgcagctgagtcaaggggataaca

SEQ ID NO: 32557 - DNA, 601 bp, Human
tcaatttccccaggaaaaacacgaagctgaattagatgacttctaccatcttagctttacaatctcatctttatgacagtctggaatatcaacagaatccgatgccagcctgcagggatgagggtgttagaagcttaaccgtctcgcacaagtcatcttaccacatggtcagggtagagggactataactaagtcatgtggcttgagatctgcccaagcagatgcgttgtccccttctgccaatgaccaagcacagggatccttcaacctttcctctaagtccagaagataagacagcaasgctctggtcccagcaccgccacaagcctcttttcctctaggggcctcagttttcatagctataaattggggctcacatcagttttctgtcctgcttcacaagactctcataaggctccaaggagactgccccaggcgggagcttgaggaccccccttagggtcgtgagcagtgaaagcccaaatgctgtgtctggcactgctcatcatagtcctctatccagccctcccaccctgcctattctttctcctgcctccaggacaccacgtctcccctttctagtaagtagcgttgatctcat

SEQ ID NO: 32558 - DNA, 601 bp, Human
gggagtatgattatatgctgtgggtgttgagaagaggggtacagaaagaggaaagccacaaactgggccctggtgggagaggcaatgtggcagacatggctgcttgcctacccaatacccactctccctttgttttcctactgacaggtcctgggtttcattcagggcagtaaatgtgcttgttcaaaatatttaactctccaggctcccttgcagatggtggaggtcacatgactctgttgtggacagtaagatataaccaaagtctgctggatggagcttctggaaaagttactacttycctggaaaaaagggagcatgcatttaccattcaccatacaccttctcctctttgcctttctccccgtctccctgcctgccatggagatatgatgcctaaaggtggagtagccaactgacaactgttaggacagaagccacaggctttttccatcggttagatgaagcctgggttcttgatgtcttctttcaccatcccctggcacccgcctatacatttattacttgaaacagactgacctttatttggttaggccactgtggtcaggtttctgcaacatggggtcacatgccttcccaa

SEQ ID NO: 32559 - DNA, 601 bp, Human
acaggcatggtttctgatctggacgctgatcagaccacctgcggcagggtggggctggtgaagggagtcagccagaagtcctgagggcatcgggcttttggttaagcttcttaactactccttttctttctttctttctttctttctttttctttctttctttctttctttctttctttctttctttctttctttctttctttctctctctctctctttctttctttctttccttctttctttctttcctttcctttcctttcctgtcttttcttttcttttctttctcttttttttttttcatcactgagcagcatctccctgcttctgaactactcccactcagggaggtaccaagactcatgttttgagtgtggtgtgaggagttgaagccttcctaagggctgccagaggggtggcggctgagcactgagcagctggccaccagcttctgctctgctgagacgagggcgtaagctgagggaatttcaggaagattgtggaggaggaggtggacatgagcctggctggagacacagaggagcagggtgtcaggaaagaggaagacattcagaacggggacaagaactgtgaggaaaga

SEQ ID NO: 32560 - DNA, 601 bp, Human
ggcactcttctttgagatcagctggcacagaggctggggctagggcatcttagcaatgtgttcactggatccatctgatccagctcacaggcatggtttctgatctggacgctgatcagaccacctgcggcagggtggggctggtgaagggagtcagccagaagtcctgagggcatcgggcttttggttaagcttcttaactactccttttctttctttctttctttctttctttttctttctttctttctttctttctttctttctttctttctttctttctttctttctctctctctccctttctttctttctttccttctttctttctttcctttcctttcctttcctgtcttttcttttcttttctttctcttttttttttttcatcactgagcagcatctccctgcttctgaactactcccactcagggaggtaccaagactcatgttttgagtgtggtgtgaggagttgaagccttcctaagggctgccagaggggtggcggctgagcactgagcagctggccaccagcttctgctctgctgagacgagggcgtaagctgagggaatttcaggaagattgtggaggaggaggtgg

SEQ ID NO: 32561 - DNA, 601 bp, Human
ttggcacagtgcctggcacagtgtgtgactgagaaatggaggagtaagatgaggaattactacccctggtggggaagcagcaggggtctgggtgagtcttagagtttagtgtttttgcttcttttccgttctgggagctgcctgtcaggttttctgaccactggaaagatctgggcactcttctttgagatcagctggcacagaggctggggctagggcatcttagcaatgtgttcactggatccatctgatccagctcacaggcatggtttctgatctggacgctgatcagaccacctgyggcagggtggggctggtgaagggagtcagccagaagtcctgagggcatcgggcttttggttaagcttcttaactactccttttctttctttctttctttctttctttttctttctttctttctttctttctttctttctttctttctttctttctttctttctctctctctctctttctttctttctttccttctttctttctttcctttcctttcctttcctgtcttttcttttcttttctttctcttttttttttttcatcactgagcagcatctccctgcttctgaactactcccac

SEQ ID NO: 32562 - DNA, 601 bp, Human
ctctgagttccaaatgttggcaaataattttgacttaaacactgtgagagctaaatctgtgaaaccaaacgactcgttgtgtgggctgcatttggccatgttaggacctcttccctacaccccagacctcaggccctctcagtctccacaaggtcagctgcagagaagccagcctggaggagtctgtgcctcttttaccaacatcacatcccagagaacctctttcaccagggttgttggtagaattctcaagatatggggatgccatgaaaaggctttcttgagggaactgagaagggasgggagaaagaaactcatatttgtcaagaactaactctgggcctccacctcttaatgctttagtgaatcctcacatcaactctgtgatgcaggagttaccagcattcccattttgaaagagagaaagccgaggctcagggatatcaaggggatttccacttgtgggggatgagctggggctggaattccactctgtgacatccacagtctattttcttcctgcaaacctccatcctaccacgtctgatccttttgacggcccctgtggcctatgttggagaggattatggggggaaaggtg

SEQ ID NO: 32563 - DNA, 601 bp, Human
gaatccttaagtctgggttttatgtgaaatgctctgagttccaaatgttggcaaataattttgacttaaacactgtgagagctaaatctgtgaaaccaaacgactcgttgtgtgggctgcatttggccatgttaggacctcttccctacaccccagacctcaggccctctcagtctccacaaggtcagctgcagagaagccagcctggaggagtctgtgcctcttttaccaacatcacatcccagagaacctctttcaccagggttgttggtagaattctcaagatatggggatgccatgmaaaggctttcttgagggaactgagaagggaggggagaaagaaactcatatttgtcaagaactaactctgggcctccacctcttaatgctttagtgaatcctcacatcaactctgtgatgcaggagttaccagcattcccattttgaaagagagaaagccgaggctcagggatatcaaggggatttccacttgtgggggatgagctggggctggaattccactctgtgacatccacagtctattttcttcctgcaaacctccatcctaccacgtctgatccttttgacggcccctgtggcc

SEQ ID NO: 32564 - DNA, 601 bp, Human
cttggggtctgcaaaggtaaatagcactgcattaatggtcttctcgatttaaggggatctccctctttcctcaacctggtccagcgagagggagtccccagtggagggcatgtctcactgctcaagagaggtttgtatccttgctgctcagcaactggggctaggataccctgaaaattctggaaatcaccaagccacatcagtggcatgactggaagctcatgactgtctgatgctgtagaggaagttcccctgatgtcccagacccagggacaggatgcagagcaggggagggaacccyttcccctcgttggacaccatcttccagacccctgggattcaggggacaaatgcagatcaaaaagtagggcaaaaacagttctgtgcctcccttttaaggttcaactcgggactgaaaaatcttgcgtttccttacaccagccgcactcacttgcgtgtgaagatgctcctcctctcttcgttcttgttgatttcctgacttaacttactgagaatcctgcaagataaagagacagatgaagagataaaaccatcactcagtctcaaccttccccctgacccttgatatcccctggtctat

SEQ ID NO: 32565 - DNA, 601 bp, Human
tgtgtctctgaagatggtcccagcagaacaggggccataagccaggtggcctgcagagcaagatctcctcccctccatctagacccaaacccttttctgggtaagaactggctgacagacaagtcagtaaggtcacctgaatgaactcaaggagccccaggaaccagaaaggcaagaaaactgaaatacctatcacctcctaaagcaatcacctctgagccctgagagctttacctgtctcttcaggaaaccgcgggacttggggtctgcaaaggtaaatagcactgcattaatggtcttmtcgatttaaggggatctccctctttcctcaacctggtccagcgagagggagtccccagtggagggcatgtctcactgctcaagagaggtttgtatccttgctgctcagcaactggggctaggataccctgaaaattctggaaatcaccaagccacatcagtggcatgactggaagctcatgactgtctgatgctgtagaggaagttcccctgatgtcccagacccagggacaggatgcagagcaggggagggaaccccttcccctcgttggacaccatcttccagacccctgggattcag

SEQ ID NO: 32566 - DNA, 601 bp, Human
tcacaaagctgccctggacactgctgtaaaggtgcaagaacagcccacaccatactcacaaaggacgaccagcccccattgtcctcttcgtggctttctgtggaaggagatgacaccaccatcagcactgaagaaaagccaccacttgagggaaagtcaaagcagcttccccatctgatgccttccctcaccaatgccccttccctggcctccacctacctcccacacccctgcaggtttagccacttactgtcagctccagcgaccctgcccaaggtgctcattctaccagagaaccagsgggtggcgatggttctcaacctttctcgtgtgtaacagtgacttaggaagtgctttaagacctgtagatacctgggggcctatgcctacagcttctgactcagtgggacaggctgggccccaggaatctgcattgcaacactatgtgcaactgaacagttgaaaagctgctttactgtaatcctagcactttgggaggccaaggcgggcagatcatgaggtcaggagatcgagaccatcctggctgacatggtgaaaccccgtctctactaaaaatacaaaaaaagtagctgggcatggt

SEQ ID NO: 32567 - DNA, 601 bp, Human
ggggaggggttgtacaatccgtcagactctcagagggggaactgtgacctttcaatgtaaaaatcaactggattgcaccctctttgaggtcttttcagggccaacagttggttctgaagttcttttccctccgtgtcaccgatggggacttaagtccatgagaaaagctacttgagagtagatttctaggagtgtccatttttggagacggggggtagtgggtgggggttggtaacagtgggtgaagtgcagtcagcaaagtacagcctagggccacgtgcagcctaccctctgtgtttgyaaatgaaggtttatgggcgcaaagccaagcctgtttgtttgctcattgtctgtggctgcttttgtgctccagtagcagagttgagtagctgagacagagagtgcatggctcccaaagccaaaactatttcctgtctggccctgtgcagagcaccttttctgggccctgggtgggtgtgctggcatcatgttagagccccgcttcacttggctccatcctggctccttatcacaaagctgccctggacactgctgtaaaggtgcaagaacagcccacaccatactcacaaaggacgaccag

SEQ ID NO: 32568 - DNA, 601 bp, Human
taaaatgaacagattgggctacggtccataatagagttcttagcctgagactgcttcatgggtggtgactgtgtatacaggttcctggggaggggttgtacaatccgtcagactctcagagggggaactgtgacctttcaatgtaaaaatcaactggattgcaccctctttgaggtcttttcagggccaacagttggttctgaagttcttttccctccgtgtcaccgatggggacttaagtccatgagaaaagctacttgagagtagatttctaggagtgtccatttttggagacggggggtagtgggtgggggttggtaacagtgggtgaagtgcagtcagcaaagtacagcctagggccacgtgcagcctaccctctgtgtttgcaaatgaaggtttatgggcgcaaagccaagcctgtttgtttgctcattgtctgtggctgcttttgtgctccagtagcagagttgagtagctgagacagagagtgcatggctcccaaagccaaaactatttcctgtctggccctgtgcagagcaccttttctgggccctgggtgggtgtgctggcatcatgttagagccccgcttcacttggctcc

SEQ ID NO: 32569 - DNA, 601 bp, Human
catctgtaaaatgaacagattgggctacggtccataatagagttcttagcctgagactgcttcatgggtggtgactgtgtatacaggttcctggggaggggttgtacaatccgtcagactctcagagggggaactgtgacctttcaatgtaaaaatcaactggattgcaccctctttgaggtcttttcagggccaacagttggttctgaagttcttttccctccgtgtcaccgatggggacttaagtccatgagaaaagctacttgagagtagatttctaggagtgtccatttttggagayggggggtagtgggtgggggttggtaacagtgggtgaagtgcagtcagcaaagtacagcctagggccacgtgcagcctaccctctgtgtttgcaaatgaaggtttatgggcgcaaagccaagcctgtttgtttgctcattgtctgtggctgcttttgtgctccagtagcagagttgagtagctgagacagagagtgcatggctcccaaagccaaaactatttcctgtctggccctgtgcagagcaccttttctgggccctgggtgggtgtgctggcatcatgttagagccccgcttcactt

SEQ ID NO: 32570 - DNA, 601 bp, Human
ttctcctgcctcagccgcccaagtagctgggactacaggcacgcaccaccacgcccagctaatttttgtattttttagtagagatggggtttcaccatgttgaccaggatggtctcgatctcttgatcttgtgatctgcccgccttggcctcccaaagtgttgggattacaagtgtaagccaccgcacccggttcaaatattttctttgtattacatctacattcactttataaatgcttgtccctcatccttcttcagcaaagcctccttctggtttggtgctgcctgattcatgaatcmctgtttgctcaaataaactccttaaaaaaaaaaaaaaaaattgcattgtgcctcagtttacctttttaaaatggggtatccatactgtaaaatgcttatgattgggtcctttatctccactcatttcccagtatgcccttgcaaagagctgggcacataacggagctgccaagctctatagccactagtgaatggaagccctcagtttacagagaggatcgaagactagcctcaggcacagcacaagagaggctgcatggcaaggattctgcctctgtgagtaaacagaaacattccagc

SEQ ID NO: 32571 - DNA, 601 bp, Human
accaatcagaagtagccagccaactcataattatataactaggagctttccagcaagatagactaaatgagatcggttataactgtaacccatcaaatattttctttttttttttttttttttttttttttttgagatggagtctctctctgtcaccaggctggagtagtgcaatggtgcaatctcggcttactgcaacctccacctcccgggttcaagcaattctcctgcctcagccgcccaagtagctgggactacaggcacgcaccaccacgcccagctaatttttgtattttttagyagagatggggtttcaccatgttgaccaggatggtctcgatctcttgatcttgtgatctgcccgccttggcctcccaaagtgttgggattacaagtgtaagccaccgcacccggttcaaatattttctttgtattacatctacattcactttataaatgcttgtccctcatccttcttcagcaaagcctccttctggtttggtgctgcctgattcatgaatccctgtttgctcaaataaactccttaaaaaaaaaaaaaaaaattgcattgtgcctcagtttacctttttaaaatggggta

SEQ ID NO: 32572 - DNA, 601 bp, Human
tacatggagttggagttggggaaaggcttggcaggcaggatggagttctgcagagcttcctcgtcattggagggtggcggctcataatccgcgtcatcttccacgggtgcctcttcctcctcattgggggactcatagtctccatcatcctccccatcctggtcatcattgggactttcataatcgtcttcttcctgcccacacagtgatagggacagtgcagtttgtagaggctctgtggccctcgatgtgcctgtgcctactctctccctgccaagcctcacaacagtataacccgggrccaggcagcctgaagatggttactcccattttacagatgaggaatctgaggtcagggagcactgtaccacaggggcagcaagtcatggacttgagaccttggtgaaggtcttcggaccacctttttacacaacacctttctgcacaacagagagagaagaaaggggaaggatgctggaatagaaggtaccggaataggctctgtcttgagtaaacacattttttgctccaggcatcaccatgagaaagactaaaggcctggagcatttgtgatgatactagttaattgccatttctgttc

SEQ ID NO: 32573 - DNA, 601 bp, Human
atttgtttattttctgtcaacaccactactagaatgtaagccccaggaggcaggggctatgtcttctttcctgatcatttctaagcactgagaatggggcctgggctcccagcagatcaacaatgtttgttgaatgaatggagagagaagtgggctaaaaggacagatagacaataaaaatcgtaaacaccatctaatattttttaaagttatagtcaaaccctactcaatatcttcatgtttattctagcataataatgccatgtaactataatttggtcaaaagatggggaggaacagraaagtactcttggagtacctgagtaaactgcagaatgagttgaaactgccaaatagccttaggtggtagttcaatgctgatatcagccaccataggcaagaattggttgcagtcttagtagtcctcacaggaaacctatgtggtctgtacatttattatcctatttcacagatgaggaaattgaggcccagagagacagagttacttgtacaaagccacatagctgttaagaagccgagcagatatcgagacccagagctttctgctacatgggcaagctggggcatcagccttccatgc

SEQ ID NO: 32574 - DNA, 601 bp, Human
ctgactcatccattgcttttccggacctccacttccctgtatatgaaacagacttgatcatggttgtccttattacacagatgtttaaaaaccaccatgagatattgagacagcattttgtgaaagggctttaaaatggaaatgggttataccgcataaaggattaaatggtattcgttttttgtggtactgaccttcaattttcagcgtactctctgaaagtatattatttaagaatatatttgtttattttctgtcaacaccactactagaatgtaagccccaggaggcaggggctatktcttctttcctgatcatttctaagcactgagaatggggcctgggctcccagcagatcaacaatgtttgttgaatgaatggagagagaagtgggctaaaaggacagatagacaataaaaatcgtaaacaccatctaatattttttaaagttatagtcaaaccctactcaatatcttcatgtttattctagcataataatgccatgtaactataatttggtcaaaagatggggaggaacaggaaagtactcttggagtacctgagtaaactgcagaatgagttgaaactgccaaatagcctt

SEQ ID NO: 32575 - DNA, 601 bp, Human
tagttttatttttctctctggcggaggaaataactgcagtggacaccaagtactgtaaaagaacgggaggaggcctaccgagtgattccggccggctggtgggggcgggagggcggccatcggtctctgggggggcacaggaggctgctggggggttttcccagaggggggccggtctgtggaaacacaaggttattaaagtgaaaggggagtatcggccaagctcaggggtctccaggaacagatatgcagctcggggcaccgggggtgcatgatccttgacccccaggcccacatgagmcccagccacggggagacccagcctggatctcacccacccctccctgcccattttttctgtcctagtttgtgtcactctccttatacacaggctcagctttctttgcatttcacaggaataggtatttatcagagattttgccaatcaagaaaggcctctttgtaaccagctcagccagaactggaagggaggattttcagacaattttgtaagaagtaaacatacgcatacctctgtatgcagacacacagatatacacatgtgcacacatgcatgcacacacatgcatatatatgcaca

SEQ ID NO: 32576 - DNA, 601 bp, Human
tattttacagttttcacttctctcaaatagtgggaagtaaataaaaaccaccagtattttaccccaaaaaagaaacacgtgtgaatgcttgggtttgcctttccccagccgagggaaaagattataatcttttcttacaaaattagaatgagataaagatgtttatagttttatttttctctctggcggaggaaataactgcagtggacaccaagtactgtaaaagaacgggaggaggcctaccgagtgattccggccggctggtgggggcgggagggcggccatcggtctctgggggggyacaggaggctgctggggggttttcccagaggggggccggtctgtggaaacacaaggttattaaagtgaaaggggagtatcggccaagctcaggggtctccaggaacagatatgcagctcggggcaccgggggtgcatgatccttgacccccaggcccacatgagacccagccacggggagacccagcctggatctcacccacccctccctgcccattttttctgtcctagtttgtgtcactctccttatacacaggctcagctttctttgcatttcacaggaataggtatttatcagaga

SEQ ID NO: 32577 - DNA, 601 bp, Human
ctgcttctgctgggttcttcgtggttggtctggggtgggggcagtggctgcataaagatccaaacgttaggaagcacttccaatacatcagcaagagccggcactcccaaaacctgtctggatctgctcacttttcctcatcttcatgttctgcctacaaacatccatgtccatttcttcactgaactaccgcagtagcctcctatctgagctccctgttctagactctgccacgcaagctcttttctgcaggcagcagagtgagcatgtcactttcctgctaagcctcctatcacattaraaacaaaattgaaactcgttaatgtcctgcgaggccctgcctgagctggcccatgtctgccctctcaactctttcctgtgatcccttctcagtactcatggggtccctaccatagaatcttcttgcagttcctggaaaatctcaaggttatgccctctttggcatccctacacttgtttccttctgcctagaacgttcttctcccggctcttcccacaactggctcattctgtcccaggtccttgtcacctcccccccccataccgtcatgttacctggtcttccgtcccccgaaccaca

SEQ ID NO: 32578 - DNA, 601 bp, Human
gtgctgggattacaggcatgagccaccatgcccagcaaaatttgccaatttttgcatattctctgagcatgttaaaagtctcaggtggggtgtaaacattttaagaagacagtaatccttccaaaacatcacagaaaacggactaattcaagggtaaaacagaaattgtcagaaaagtgtgtcatttaaaaatgcttttaaatatagaaaaaaagaatattttaaaagaataacttttgtgtcaggaggtgattgcgaaggatttgatgtcagtgttccacttttctgatgtctcggctcrtggtagtgagcagggttggaatctgaagtcaaatctatcttcatttccatgtaattatacagctctctacagcagacaattccaagccaaaccagccagcacagctttgcatgacacagcagagctgtgatgtagttcggggaaagagcagcgagcagcagcctcatatccaagaactgaaagtcattttgttgacagacaaaaagggattgaggccacagaaagctaaatgccttgctcagagcatagccaagaaaggggtgggggcagctgggattctgggctcctttccgttcagtt

SEQ ID NO: 32579 - DNA, 601 bp, Human
ccaaaaaacaagttcacagcttaccttgtcagaaaatggtggtttctttcctgtaaatgacagagagcagatgggccatgagttcagaacttcataagcatgaggtttaaaaacacagtttgatgaaactatgagtctgaaccctcttgggggttgatggggtttaagcattaaagaatcagaaacttcagactaggaagggtccgttagagaccaccaaattttataagctcagagaaattaaatggcttgaccatttaatttgaaggtcacacagctttgtgtacatacaagtagtgtygtggattctgtgctttttttaaataaaatcacattttcttttatataactgatgatcaaaaggattaatgtttccttgggattttatgcctctttaattggccaaagtatttcttctgcagcctaagttttatttttatatctgaaataaatccacttgccacggagagggtaacttttatccaattctgtgaaacacttgatattaaatgaagcactccacttagtttctgaagaaacttttcacttggggagagcatttcaggagactctcctggtatgctgcaaatcttttttgtct

SEQ ID NO: 32580 - DNA, 601 bp, Human
actttggcacaggtggcttcttccctggcagggggctgctcctttcatgtctttccgtggtcggtggtaaaggaggcttttgaatcttgggtaaatgctccccgagtgacctgtggagttcaggaaaaggatgtgtaagaaacaaactttgccgaggcagagttctacagaacgtcccatgtaccctcatgtagatgcaacagtcttaccttcccgctggaatcgagggctgcaagacaggaggaaaaatgtatgagtgtccaagcacttttcaaagaataaggacaagatgtgaaacaarcaaacacaaccaaaaaacaagttcacagcttaccttgtcagaaaatggtggtttctttcctgtaaatgacagagagcagatgggccatgagttcagaacttcataagcatgaggtttaaaaacacagtttgatgaaactatgagtctgaaccctcttgggggttgatggggtttaagcattaaagaatcagaaacttcagactaggaagggtccgttagagaccaccaaattttataagctcagagaaattaaatggcttgaccatttaatttgaaggtcacacagctttgtgtacatac

SEQ ID NO: 32581 - DNA, 601 bp, Human
gtgagtacagttcctatgcactgtgaaggctttgctataacgaggttggaaaactcaatgaaatatttgactggaatctctaaaaacagcagtcaccccttactcttgattagatgtcactctactcatttctcagtagagtccatttccttcaaagagaccctgatccttcatagccaacctgtgaagcctgaacatccctcaagccacagcaagaaaaggcccaccctgcccgggagcaccgaggagcctcggttcccactgcagagtcagcacagggcagcctgtctgccggccactstgagtgacaagctcaagcaacaccagacaattactttggcacaggtggcttcttccctggcagggggctgctcctttcatgtctttccgtggtcggtggtaaaggaggcttttgaatcttgggtaaatgctccccgagtgacctgtggagttcaggaaaaggatgtgtaagaaacaaactttgccgaggcagagttctacagaacgtcccatgtaccctcatgtagatgcaacagtcttaccttcccgctggaatcgagggctgcaagacaggaggaaaaatgtatgagtgtccaagcac

SEQ ID NO: 32582 - DNA, 601 bp, Human
tgagcagtaaggaagacacttgcggtgacctgaaaaacctcccccaaccatttcctgtctgctacctgtattgaaaaataaaatggtgagtacagttcctatgcactgtgaaggctttgctataacgaggttggaaaactcaatgaaatatttgactggaatctctaaaaacagcagtcaccccttactcttgattagatgtcactctactcatttctcagtagagtccatttccttcaaagagaccctgatccttcatagccaacctgtgaagcctgaacatccctcaagccacagcaaraaaaggcccaccctgcccgggagcaccgaggagcctcggttcccactgcagagtcagcacagggcagcctgtctgccggccactctgagtgacaagctcaagcaacaccagacaattactttggcacaggtggcttcttccctggcagggggctgctcctttcatgtctttccgtggtcggtggtaaaggaggcttttgaatcttgggtaaatgctccccgagtgacctgtggagttcaggaaaaggatgtgtaagaaacaaactttgccgaggcagagttctacagaacgtcccatgta

SEQ ID NO: 32583 - DNA, 601 bp, Human
tgtggtttagtcagcaaactaactctttagtagctattaaattttactgagctgttgtttttcccaagaaatgaaaacattttaggtaatattctcccttgctcttgttttaaaacagccctctcagggcccaccttggtgtaaagagaagacaattagaaaatgttgctgctttgggactattccaaagggggcttggtacactttgcccagatgaatgagctagtcaaacagacttggggacagctgccttagggctgcgacaggcatctgcactgcctgggccgtataatgtcctctstggggagaaggggaagagctggacaatttgttgaacacctcctgtgtgtcagacgcttcacacatcatcatctcattctgtgtttatttaaaattttggaattttgttccttatgagtttgctgcatttattttgattttttaaaaacattactctaaaatgttatcaaactccattactgaggaggttttttggcacactttagccctggtcctaatttaatcctcacaacagccaagcaagggtgatagttatgacccctgattcacaaatgagatggaagctttggttgtattcttt

SEQ ID NO: 32584 - DNA, 601 bp, Human
ggggtggaagggagatctggttactccatgttctgccatcattgcaagctgagctaggcaaacctttgttctgcataactaatgcagcaaataattatgtgtgtgtgtgtgtgtgtatatatatatatatacacactctatatgtatatgtacacacacactatatgtatatacacacacacacacacacacatgtggtttagtcagcaaactaactctttagtagctattaaattttactgagctgttgtttttcccaagaaatgaaaacattttaggtaatattctcccttgctcttgytttaaaacagccctctcagggcccaccttggtgtaaagagaagacaattagaaaatgttgctgctttgggactattccaaagggggcttggtacactttgcccagatgaatgagctagtcaaacagacttggggacagctgccttagggctgcgacaggcatctgcactgcctgggccgtataatgtcctctctggggagaaggggaagagctggacaatttgttgaacacctcctgtgtgtcagacgcttcacacatcatcatctcattctgtgtttatttaaaattttggaattttgt

SEQ ID NO: 32585 - DNA, 601 bp, Human
aaaggccacagtcaaaatcattcatcccagttggccaactgggagtcccagcaaagagctgcataaataaacacacatgggctcataaaccccacacaacaaaatcacttttcaatacttttgcaagtatattccctctggttccagaaaacacaactcccagattctcatgagcacaagtgtcaatccttccagagacagggaacctggaatgtgatgttatcctcactgtccagccttacctctgccttgttcctatctctgcagccaagccactgttctcactgtccctgcagcctcygtgggcactggtatccacctgctcaggacactcctgaggggaatccccatgggctttctttaagaatgactctattctgtgtcctccctatcattgaatgaccagcataaatctcacctcctctaggaagtcactgctggctccttgagccacatggcacactttcttccctcagccccacagagcatcccgtgattgcatgctgtctggcatgaggggttgtgagtgtgcctgcctccataagatctcagcacttcatcggaacaagcacagcatctagcacagagctgcaaaaatagc

SEQ ID NO: 32586 - DNA, 601 bp, Human
cgatagttatgcagtatgccaattgacataagtctacttaatactaatttaagacttataattgattctatggggttcctgtactaaacaattccacttgaatgcctgagcaggaaaatgaaagaatgagttataggctgtaagaatgtgtttccgaacataccatcatcttcatcctgggaaggggaagaaaaaaaaagatattaagctatcatcaaaatacaattcttaaaataaaaactgcatttctcaatcaaataaatcaaataggtatctgtttctttctctggcagttatacaycttcataataaatatactgtggagaataatagaagttgctaagtgttttacaatttcttaatacaaacagtcatctaagggcattccagtatgagactctcctcatatactcagcatgaaatagattctgaggtgcctaaaagggcccaaagatgtaataatattgacaatatctacaatgtgtccaaaagattcatacacaagatttcattcagttcccctagtgaccccccaaaaatttaacatcctcattttacaaaagcatgatgctgaggaagcttccttagcttgccaggagtt

SEQ ID NO: 32587 - DNA, 601 bp, Human
acacattgattttgtttttcatttttgaaatgttaacttggcagaaaattgtcagctggaaaccttataaatttcagaaatgatttacaagttttgttttatgaaagtcaaaattttatgctatctcattcattggcagttactgattctttacccacgtgtgttagaagacataaatgtgagaaatgtttccatcaaaccatgcatgcaattttacattttgtgatacaattaaataatctgcactgttacacatgaatttagtcttcttcggtaatctaaccaagtaatccattttackatagttatgcagtatgccaattgacataagtctacttaatactaatttaagacttataattgattctatggggttcctgtactaaacaattccacttgaatgcctgagcaggaaaatgaaagaatgagttataggctgtaagaatgtgtttccgaacataccatcatcttcatcctgggaaggggaagaaaaaaaaagatattaagctatcatcaaaatacaattcttaaaataaaaactgcatttctcaatcaaataaatcaaataggtatctgtttctttctctggcagttatacacc

SEQ ID NO: 32588 - DNA, 601 bp, Human
taaagaggacacaaaaataaagcagatcagatgtaattaggaagtagtaggatggaaccttgctcccagggtgtttctagatgacttaaccaccatagaatccatttacaaaggggcgcagatctagatgatactctaaaatacacattgattttgtttttcatttttgaaatgttaacttggcagaaaattgtcagctggaaaccttataaatttcagaaatgatttacaagttttgttttatgaaagtcaaaattttatgctatctcattcattggcagttactgattctttacccacrtgtgttagaagacataaatgtgagaaatgtttccatcaaaccatgcatgcaattttacattttgtgatacaattaaataatctgcactgttacacatgaatttagtcttcttcggtaatctaaccaagtaatccattttacgatagttatgcagtatgccaattgacataagtctacttaatactaatttaagacttataattgattctatggggttcctgtactaaacaattccacttgaatgcctgagcaggaaaatgaaagaatgagttataggctgtaagaatgtgtttccgaaca

SEQ ID NO: 32589 - DNA, 601 bp, Human
tggtggattaacatatcgttcttaatgctcagtttggttttatgtcttaagacccaaaatgttcagaccctactatctacccgtcatttccttctttctcaatctgcctggcattacttcagtactggatggacctaaacattatattaagctagaatttcatgacagagctacaaacctttctgagaatgctccaggcatgtgagaggatgggagagggttcatgggacttggcttagtagatcttgaagggaaagtgttggagctcataggaagtagtgctggctggggcaaaggtctytgatgcactgtgcagaagtagaaaacaatgaatgagattggcaggccccagctgtcactaagaaacattccataaccgccccccagttagaaacagctagtataaagaggacacaaaaataaagcagatcagatgtaattaggaagtagtaggatggaaccttgctcccagggtgtttctagatgacttaaccaccatagaatccatttacaaaggggcgcagatctagatgatactctaaaatacacattgattttgtttttcatttttgaaatgttaacttggcagaaaattgtcagc

SEQ ID NO: 32590 - DNA, 601 bp, Human
aatttgcattcagagtcatttagctggggctaaatagaagatattttgtgcgaactgctttttatcatgacactggttgcaaaaatgcctgtgaataagagttccttacagtatggaacctcttcaggaaagatacagatacaataatttcttcagtttagcataataacctgcttgattaaaaaaatgggttattgagcagttaagtgacgaatcaaggtcataaacataaaaaacaggattatttttcttgctgtttaatgcaaaacacatgtttgccattgaaagcgtctgaaagaaygccaagggaaaagaacatattgttcatctggatcttctcctttaacttttttttcaaataaataaaataaaacaaagggaagataaaagtacagaagaacattcaatgggagtttctggtgattcttttaccagggaaaaggcaaacaaacaaaaataaaaacatgctctcttacctcttcctccgcgggggatgggggccgaggtttgtttggaagtggcaaggggaagtttctgccttcggctctgataggtggtctgttgctagggccttcaaaagtatagaattctgacagttaat

SEQ ID NO: 32591 - DNA, 601 bp, Human
cctttcacatcaacatggatggcacgtctgtgttaagaggaagatagaactggtacgatgttggaactttgaaagagagtctccttctgacaccatgtgattcctatgacaagacagactctttcattaataaaatctcctaagatgctgccaaccaaatgactgccttgagattcttctgccagcctaatgattcccgagcctaggaatccctgctatgggtgctggtagttgtgaagctggcactaatgggtctcctaggtattacagaaagcaacagcacctagcagaattcctagcytgtaattggtactcaggacaggtcagttcccttctctgccattaatatttacaactatgttaaaataaactatagcacaatacctggtttatctttctaagagcagcttctgcctctggtcgggtaatataagaaacgtaccactcttcatttaatgaattctgaaaatgtaaatttttagaaactgaataaattttacagttacagatgtaagtgaaaagaaaagcctctgagtaatcatttccataaatcaacacctcaattccaggaggtctgaaacatttgttttcttaatttgca

SEQ ID NO: 32592 - DNA, 601 bp, Human
ctgggaagtttgaagactcccagagctgacacagcacccccagaataattagaatctcaaggtgagacccaggaatcgggatttttcaaaagttctccgggtgatctaaatgtgcaactactactgagaactactggtgtggagtttaagtgtgaaagatgaaagatttttgctttcccatttctgataaataaatctaaggtaaagtttcggcactggctacgggaaatatgtttaagactttatgatattaaaggactagctagaaacgtctagggcaaaaagcaaaaagttgctgccrtctctttaatattggtcctttcacatcaacatggatggcacgtctgtgttaagaggaagatagaactggtacgatgttggaactttgaaagagagtctccttctgacaccatgtgattcctatgacaagacagactctttcattaataaaatctcctaagatgctgccaaccaaatgactgccttgagattcttctgccagcctaatgattcccgagcctaggaatccctgctatgggtgctggtagttgtgaagctggcactaatgggtctcctaggtattacagaaagcaacagcacc

SEQ ID NO: 32593 - DNA, 601 bp, Human
cggttcatggtgtctagaggtgggatctgcagcatggcacaggagttccttcatgatctctctgctgtgtcctcactgccaccttcacactcataaaggctcagcaaccaatatttgcagccatagcctggatcgccccagccttgattgcttgctagagagggaaaagcctaactcatttttctagatgtgggtcacaactcacctaggaaccctaacaggataatgcacttcctttaagactaatctgctaggtgcctccctccatgggagctgcaatgagtggttggtctgcacttgwgtgtttccacactggaccaagataaatcttgaagggcaaatacctctgctcctatagggtctgtgcagctctatccactgccaaccagcgattcaaacatttgatcacaagcatgcattttttttctattcattaacattatcataacagaagtatgtgaagcagaagttatgggtaagctgtttctcattctggacatgtttgattcagctggtcctcctcttggaactttgaacttagagtatgtttggggcgttaccttcagttgttagtttcctttgcgaaaaactagccctgagg

SEQ ID NO: 32594 - DNA, 601 bp, Human
aaatccagcagatccattgagagtttaagcagcaaggtgttgtgaccaagttaacattttagaaggatcactggtatggaggttggattggagaggggaaagcctaaaggtatagagactagttaggaagctattgtaggctgggcatggtggttcatgcctgtaatctcagcactttgggaggctgaggtgggaggattgcttgaggccaggagttgaagaccaacctggccaacatagcaagaccccgtctctgtttttcttaattaaaagaaaagtccagacgtagacatagtggctyacgcctgtaatgccagcactttgggaggccaaggtgggcagattgcttgaggtcaagagtttgggattaggccaggcgcagtggctcacgcctgtaatcccagcactttgggaggccgaggtgggcggatcacaaggtcaggagatcaagaccatcctggctaacacaatgaaaccccgtctctactaaaagtacaaaaattagccgggcatggtggcggacgcctgtagtcccagctactcgggaggctgaggcaggagaatggcgtgaacctaggaggcggagcttgctgtgagcaga

SEQ ID NO: 32595 - DNA, 601 bp, Human
gaagctattgtaggctgggcatggtggttcatgcctgtaatctcagcactttgggaggctgaggtgggaggattgcttgaggccaggagttgaagaccaacctggccaacatagcaagaccccgtctctgtttttcttaattaaaagaaaagtccagacgtagacatagtggctcacgcctgtaatgccagcactttgggaggccaaggtgggcagattgcttgaggtcaagagtttgggattaggccaggcgcagtggctcacgcctgtaatcccagcactttgggaggccgaggtgggyggatcacaaggtcaggagatcaagaccatcctggctaacacaatgaaaccccgtctctactaaaagtacaaaaattagccgggcatggtggcggacgcctgtagtcccagctactcgggaggctgaggcaggagaatggcgtgaacctaggaggcggagcttgctgtgagcagagatcacgccactgcactccagcctgagcgacagagcgagactccatctcaaaaaaaaaaaagagtttgggattagcctggccaacatggcaaaaccccatctctacaaaaagtacaaaaaaattag

SEQ ID NO: 32596 - DNA, 601 bp, Human
taaaagaaaagtccagacgtagacatagtggctcacgcctgtaatgccagcactttgggaggccaaggtgggcagattgcttgaggtcaagagtttgggattaggccaggcgcagtggctcacgcctgtaatcccagcactttgggaggccgaggtgggcggatcacaaggtcaggagatcaagaccatcctggctaacacaatgaaaccccgtctctactaaaagtacaaaaattagccgggcatggtggcggacgcctgtagtcccagctactcgggaggctgaggcaggagaatggcrtgaacctaggaggcggagcttgctgtgagcagagatcacgccactgcactccagcctgagcgacagagcgagactccatctcaaaaaaaaaaaagagtttgggattagcctggccaacatggcaaaaccccatctctacaaaaagtacaaaaaaattagctgggtatggtggtgcgcgcctgtaatcccagttactcaggaggctgaggcatgagaattgcttgagcctgggaggtggaggttgcagtgagcccagatcatgccactgcactccagcctggatgacagagtaagatgcca

SEQ ID NO: 32597 - DNA, 601 bp, Human
ctctgagcctgtttctgcatctgtgacataagatggtaagataaaggtggctgtctcaccaattatgtaaggattaaatgtggaaaaggacataaagttgtatagtgctgccatagggacagtgttcagtaaacgtgacacattcttagtatcactaagaatcaggttcttggccaggcaccgtggctcatgcctgtaatcccaacactctgggaggcctaggtcggaggatggcttgaacacaggagtttgagaccagcctgagcaacatagtgagacactgtctctacaaaaaaaaaawaataataataattgtttttaattagatgggcagggcactgtggctcacacctgtaatcccagcactttgggaggccaaggccggaggattgcttgaggccaggagttcaggagcagcctgggccacattcctgtctctacaaagaataaaaaagttaactgggcatggtggcacatgcctgtaatcccagctactcaagaggctgaggaggaggattgcctgagcccaggagttcaagactgcagtgagccttgatcacaccactgtactacagcttgggcaacagagtgagaccttgtc

SEQ ID NO: 32598 - DNA, 601 bp, Human
ctgagcctgtttctgcatctgtgacataagatggtaagataaaggtggctgtctcaccaattatgtaaggattaaatgtggaaaaggacataaagttgtatagtgctgccatagggacagtgttcagtaaacgtgacacattcttagtatcactaagaatcaggttcttggccaggcaccgtggctcatgcctgtaatcccaacactctgggaggcctaggtcggaggatggcttgaacacaggagtttgagaccagcctgagcaacatagtgagacactgtctctacaaaaaaaaaataataataataattgtttttaattagatgggcagggcactgtggctcacacctgtaatcccagcactttgggaggccaaggccggaggattgcttgaggccaggagttcaggagcagcctgggccacattcctgtctctacaaagaataaaaaagttaactgggcatggtggcacatgcctgtaatcccagctactcaagaggctgaggaggaggattgcctgagcccaggagttcaagactgcagtgagccttgatcacaccactgtactacagcttgggcaacagagtgagaccttgtctc

SEQ ID NO: 32599 - DNA, 601 bp, Human
ctaagaatcaggttcttggccaggcaccgtggctcatgcctgtaatcccaacactctgggaggcctaggtcggaggatggcttgaacacaggagtttgagaccagcctgagcaacatagtgagacactgtctctacaaaaaaaaaataataataataattgtttttaattagatgggcagggcactgtggctcacacctgtaatcccagcactttgggaggccaaggccggaggattgcttgaggccaggagttcaggagcagcctgggccacattcctgtctctacaaagaataaaaaasttaactgggcatggtggcacatgcctgtaatcccagctactcaagaggctgaggaggaggattgcctgagcccaggagttcaagactgcagtgagccttgatcacaccactgtactacagcttgggcaacagagtgagaccttgtctccaaaaaaaaaagtttgtttttttttatccactctcctcaccaaacaaactgagtaagttagagccctctcagctggcatgtgttggaaacagtgccctctcattaaagtgctgccctcactcccattgcctcttggccttggtcagtatgat

SEQ ID NO: 32600 - DNA, 601 bp, Human
atggtgaaaccctatctctactaaaaatacaataattaggctgggcgcagtggctcacgcctataatcccagcactttgggaggccgaggtgggcgaatcacaaggtcaggagtttgagactagcctggccaatatggtgaaaccccatctctactaaaaatacaaaaattagggccgggtgtggtggctcacgcctgtaatcccagcacttagggaggccgagacagatggatcgcgagatcaggagttcgagaccaacctagccaacatggtgaaaccccatctctactaaaaaaatamaaaaattattcggttgtggtggcacacgcctgtaatcccagctacttgggaggctgaggcaggagaatctcttgaacctgggaggcagaggttgcagtgagtggagatcccgccgttgcactccagcctgggcgacagagtgagactccatcaaaaaaaaaaaaaaaaaaaaaaaaaattagccgggcgtggtggcgtgcacctatactcccagctacttgggaggctgaggcaggagaatcgcttgaacctggaaggcggaggtcgcagtgagccgagatcgtgccattgcacttcagc

SEQ ID NO: 32601 - DNA, 601 bp, Human
acatggtgaaaccccatctctactaaaaaaatacaaaaattattcggttgtggtggcacacgcctgtaatcccagctacttgggaggctgaggcaggagaatctcttgaacctgggaggcagaggttgcagtgagtggagatcccgccgttgcactccagcctgggcgacagagtgagactccatcaaaaaaaaaaaaaaaaaaaaaaaaaattagccgggcgtggtggcgtgcacctatactcccagctacttgggaggctgaggcaggagaatcgcttgaacctggaaggcggaggtcrcagtgagccgagatcgtgccattgcacttcagcctgggcgacagagcgagactctgtctcaaaaataataataataacaataactagccgggcctggtggcacatgcctgtagtcccagttactcaggaggcggaggcatgagactcaggtgaactagggagacagaggttgcagtgagccaagatcacaccactgcactccagcctggttgacagagcgagactctgtctcaaaaaaaaaaaatcccatttgctcattttttggatactagtataactatcactctaaaccagttagta

SEQ ID NO: 32602 - DNA, 601 bp, Human
ccagctacttgggaggctgaggcaggagaatcgcttgaacctggaaggcggaggtcgcagtgagccgagatcgtgccattgcacttcagcctgggcgacagagcgagactctgtctcaaaaataataataataacaataactagccgggcctggtggcacatgcctgtagtcccagttactcaggaggcggaggcatgagactcaggtgaactagggagacagaggttgcagtgagccaagatcacaccactgcactccagcctggttgacagagcgagactctgtctcaaaaaaaaaaaatcccatttgctcattttttggatactagtataactatcactctaaaccagttagtacttaaatcaagcagatatgggagatggtgaattaccatctacagtgttgtcatatatgtcacatactgagcattatcagctagtagaatctagttaattgttctatgtgtgatgtatgcagagttcccattttgaatgtgtttttactatgcttaaataaatgactgatgtcagcaaccccaaaatgatacatctgatgtaagagcccctgttccccaataataacatctaaactatagacatt

SEQ ID NO: 32603 - DNA, 601 bp, Human
gaggcatgagactcaggtgaactagggagacagaggttgcagtgagccaagatcacaccactgcactccagcctggttgacagagcgagactctgtctcaaaaaaaaaaaatcccatttgctcattttttggatactagtataactatcactctaaaccagttagtacttaaatcaagcagatatgggagatggtgaattaccatctacagtgttgtcatatatgtcacatactgagcattatcagctagtagaatctagttaattgttctatgtgtgatgtatgcagagttcccattttkaatgtgtttttactatgcttaaataaatgactgatgtcagcaaccccaaaatgatacatctgatgtaagagcccctgttccccaataataacatctaaactatagacattggaatgaacaggtgcccctaagtttcctccctccagggtttcttggccggtctctgaggactacacatccctactcccgtctttcctcatcttcaggcgcagtaacagtatctccaagtcccctggccccagctccccaaaggagcccctgctgttcagccgtgacatcagccgctcagaatcccttcgt

SEQ ID NO: 32604 - DNA, 601 bp, Human
ccagctttccttggcttcccccacccccaggtgaaagtgatgcgcagcctggaccaccccaatgtgctcaagttcattggtgtgctgtacaaggataagaagctgaacctcctgacagagtacattgaggggggcacactgaaggactttctgcgcagtatggtgagcacaccaccccatagtctccaggagccttggtgggttgtcagacacctatgctatcactaccctaggagcttaaagggcagaggggccctgctttgcctccaaaggaccatgctgggtgggactgagcatacayagggaggcttcactgggagaccacattgacccatggggcctggaccacgagtgggacagggctcaacagcctctgaaaatcattccccattctgcaggatccgttcccctggcagcagaaggtcaggtttgccaaaggaatcgcctccggaatggtgagtcccaccaacaaacctgccagcagggcgagagtagggagaggtgtgagaattgtgggcttcactggaaggtagagaccccttcctatgcaacttgtgtgggctgggtcagcagctattcattgagtttgtctgtgtcactg

SEQ ID NO: 32605 - DNA, 601 bp, Human
ctgagggattaacatgcatgtgcatgtttattcctcatgacaaccttggtttccagataagctggactggaaagggacagagctgggatcctgggctaatcagtctggtcgccaagcctgagactttagccactgcccttcacatgggggtccatgaaaatagtagtagtctggaacagtttgggggtacatcaaggtcgctgtgttttaagctatggagtctggactataggagacaaatgtaaaagagttttttggttgactggctttttggtttttttgtttgtttgtttgtttgtttttttgtttttttttcctgtttctggggcttgaatcaggaaggaggtttttttgttgttgttgttttgagaaaggatattgctctgttgcccagactggagtgcagtggcacgatcatggctcactacagcttcgacctcctgggctcaagcaatcctcctgccttagcctcccaagtagctggactacaggtgtgtaccaccacacctaattttttgaatttttttttctttttttttttttttttttttggtagagacaggttctcactttgttgcccaggctgatctcaaactcctgg

SEQ ID NO: 32606 - DNA, 601 bp, Human
tgagggattaacatgcatgtgcatgtttattcctcatgacaaccttggtttccagataagctggactggaaagggacagagctgggatcctgggctaatcagtctggtcgccaagcctgagactttagccactgcccttcacatgggggtccatgaaaatagtagtagtctggaacagtttgggggtacatcaaggtcgctgtgttttaagctatggagtctggactataggagacaaatgtaaaagagttttttggttgactggctttttggtttttttgtttgtttgtttgtttgtttgtttgtttttttttcctgtttctggggcttgaatcaggaaggaggtttttttgttgttgttgttttgagaaaggatattgctctgttgcccagactggagtgcagtggcacgatcatggctcactacagcttcgacctcctgggctcaagcaatcctcctgccttagcctcccaagtagctggactacaggtgtgtaccaccacacctaattttttgaatttttttttctttttttttttttttttttttggtagagacaggttctcactttgttgcccaggctgatctcaaactcctggg

SEQ ID NO: 32607 - DNA, 601 bp, Human
ttaacatgcatgtgcatgtttattcctcatgacaaccttggtttccagataagctggactggaaagggacagagctgggatcctgggctaatcagtctggtcgccaagcctgagactttagccactgcccttcacatgggggtccatgaaaatagtagtagtctggaacagtttgggggtacatcaaggtcgctgtgttttaagctatggagtctggactataggagacaaatgtaaaagagttttttggttgactggctttttggtttttttgtttgtttgtttgtttgtttttttgttgttttttcctgtttctggggcttgaatcaggaaggaggtttttttgttgttgttgttttgagaaaggatattgctctgttgcccagactggagtgcagtggcacgatcatggctcactacagcttcgacctcctgggctcaagcaatcctcctgccttagcctcccaagtagctggactacaggtgtgtaccaccacacctaattttttgaatttttttttctttttttttttttttttttttggtagagacaggttctcactttgttgcccaggctgatctcaaactcctgggctcaagc

SEQ ID NO: 32608 - DNA, 601 bp, Human
aattagctgggcgtggtggtgcacgcctgtagtcccagctactcaggaggccgaggcaggagaatagcttgaacctgggaggcagaagttgcagtgagccaagatcacaccactgcattccagcctgggtgacagagtgagacttcatctcaaaaaaaaaaaaaaagagagactgatatggttagtacattggggtggaatgcggagggtccagggaatggagccctgcatagggggctaatgaaacatttcagatttctgaattaaggtagtggctgtggggacaggagcctgggaggcmgggtggagtcagaatggagagactggttggcaatgagggaacaggaggaggaggaggaggagttacgagtggcttgaggtgtcacttaccagacatttgggggatgggggatagccatgattgttgagcaactggtttgggaagagctagcattgatccctgctgttctgtgctagcagaacctatcagcatcttctgggcaggaaactggctccatgagactggcttagggagaggctgctagtcacctaatctgcagagaaggggcagctggagctgtgggacagaagaggcatccat

SEQ ID NO: 32609 - DNA, 601 bp, Human
ggagttacgagtggcttgaggtgtcacttaccagacatttgggggatgggggatagccatgattgttgagcaactggtttgggaagagctagcattgatccctgctgttctgtgctagcagaacctatcagcatcttctgggcaggaaactggctccatgagactggcttagggagaggctgctagtcacctaatctgcagagaaggggcagctggagctgtgggacagaagaggcatccatgtagctggtgggggtgtctcagcttgtgaagaggagatggctttgagcagggctgacamtgaaaaggctggaagaaaaaaacagacacacaagagtctcaggatcaggtagcataggaaagttgtggacagtctttgaggagcactccctcaggcaggcaggcaggcaggtcatgagctatagcgattcaggaagagctccctgggtgtgtgagcagctccaggagcctaagggatgaaagtagtattgcagggggctggagagcaaggagtggctccttctacatttgcaagggaaggagaaaggaagttgctcctgagagtggtaagagtcagtggtggaggcctggagaggagaca

SEQ ID NO: 32610 - DNA, 601 bp, Human
taggaataagacaggacagggaaaaacaaaagcaaccccctgtcccacctctgagttccactctccaagtccctgagcctcacctccagggctccagtggctctgccatgaacccactgtgggctgggagtctgctgtgcacagataccagaccctcagaaacacaaatgccaagtgtgtctgtttttttgttttgttttgttttgttttttagatggagtctcattctgtttcccaggctggagtgcagtggtgcaatcttggcttactgcagcctctacctcccgggttctagtgattsttctgcttcagcctcccaagtagctaggactacaggcgtgtgccaccacgcccagctaatttttttttttttttttttgtatttttagtagagacggggttttgccatgttggccaggctggtcttgaactcctgacctcaggtgattcacccgccttggcctcccaaagttctgggattacaggtggaagccaccgtgcctggcctgagtgtgtctatttgatagagctttctgctctgattctcccttgctatacaccttttctccccttctcagtggcttctcttgcctatgcttcc

SEQ ID NO: 32611 - DNA, 601 bp, Human
ctcacctccagggctccagtggctctgccatgaacccactgtgggctgggagtctgctgtgcacagataccagaccctcagaaacacaaatgccaagtgtgtctgtttttttgttttgttttgttttgttttttagatggagtctcattctgtttcccaggctggagtgcagtggtgcaatcttggcttactgcagcctctacctcccgggttctagtgattcttctgcttcagcctcccaagtagctaggactacaggcgtgtgccaccacgcccagctaatttttttttttttttttttgtatttttagtagagacggggttttgccatgttggccaggctggtcttgaactcctgacctcaggtgattcacccgccttggcctcccaaagttctgggattacaggtggaagccaccgtgcctggcctgagtgtgtctatttgatagagctttctgctctgattctcccttgctatacaccttttctccccttctcagtggcttctcttgcctatgcttcctccccagggccaggtttgagaacatccccatgaagtcctgacctgtcttttatcctaccaggacaagactgtggtggt

SEQ ID NO: 32612 - DNA, 601 bp, Human
gtggctctgccatgaacccactgtgggctgggagtctgctgtgcacagataccagaccctcagaaacacaaatgccaagtgtgtctgtttttttgttttgttttgttttgttttttagatggagtctcattctgtttcccaggctggagtgcagtggtgcaatcttggcttactgcagcctctacctcccgggttctagtgattcttctgcttcagcctcccaagtagctaggactacaggcgtgtgccaccacgcccagctaatttttttttttttttttttgtatttttagtagagacrgggttttgccatgttggccaggctggtcttgaactcctgacctcaggtgattcacccgccttggcctcccaaagttctgggattacaggtggaagccaccgtgcctggcctgagtgtgtctatttgatagagctttctgctctgattctcccttgctatacaccttttctccccttctcagtggcttctcttgcctatgcttcctccccagggccaggtttgagaacatccccatgaagtcctgacctgtcttttatcctaccaggacaagactgtggtggtggcagactttgggctgtc

SEQ ID NO: 32613 - DNA, 601 bp, Human
ttgtgaggggtagaggagaggagagacaagggatggttaggataatgaaggaatgttttgtttttgtttttgtttttgagatggagtttcactctgtcacccaggctggagtgcagaggtgcaatcttggctcactgcagcctccgcctcccaggttcaagcaatcctcctgcctcagcctcccaagtagctgggactacaggtgtgcgccaccacgcctggctaatttttgtattttcagtagagacagggtttcgccatattggccaggctggtctcaaatgcctgacctcaggtgatmcacccgcttcagcctcccaaagtgctgagattacaggcatgagctaccgtgcctggccatgaaggaagatttgttttaaaaaattgttttctttaatattaattgaacacctctgttcagagcactgggctggtgccagagggtttcagacatgaatcagatccagcacctcatagagccttaactctggcacacacacacagccacaaggagacacagacaaggcagggtaggatgagtggaagctaggagcagatgctgatttggaacacttggcttctgcagtgaagccccttctta

SEQ ID NO: 32614 - DNA, 601 bp, Human
tctttcgatattcccctgtccatatctacacatatacttttttttatagtaaatagttctgtattttgccctgcatttcccttgtgtttactatccagtcttcctgtttatcatttttgtcgacaacatgaaattctattgagagactgtctgaacatattgtaatgtagatgttcaggtttttccagtttctctttacaataggtatttaactacagtgagcagttttatgcatttagctaatttctcctttgaggaagtattttcaaaattacctttattcttctcaggtaataatttyattattaccaaagttaccctaggtcttttcaagtgtgtggttaaaaaacgagaatctggctgggcgcgatggctcacacctgtaatcccagcactttgggaggctgaggctggtggatcacctgaggtctggagttcgagaccagcctggccaacatggtgaaaccccatctctactaaaaatacaaaacttagccaggcatggtggcaggtgcctgtaaccccagctacttgggaggctgaggcaggagaattgcttgaacccaggggcggaggttgcagtgagccgatatcacgccat

SEQ ID NO: 32615 - DNA, 601 bp, Human
cgttggcggccccggccccggcccccaggccaggcagtggcggccaaggaccacgcatctactttcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgccygggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggattttttta

SEQ ID NO: 32616 - DNA, 601 bp, Human
tactttcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatytctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggcccttt

SEQ ID NO: 32617 - DNA, 601 bp, Human
cagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggyctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaa

SEQ ID NO: 32618 - DNA, 601 bp, Human
gtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccayaggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctcaaaaaaaaaaaaaaaaatgatttccagcggtccacattagagttgaaattttctggt

SEQ ID NO: 32619 - DNA, 601 bp, Human
ggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccracctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctcaaaaaaaaaaaaaaaaatgatttccagcggtccacattagagttgaaattttctggtgggagaatctataccttgtt

SEQ ID NO: 32620 - DNA, 601 bp, Human
ttgttttctaatacctcttgtcattctaaatatctttaatttattaaaaaatatatatatacagtattgaatgcctactgtgtgctaggtacagttctaaacacttgggttacagcagcgaacaaaataaaggtgcttaccctcatagaacatagattctagcatggtatctactgtatcatacagtagatacaataagtaaactatattgaatattagaatgtggcagatgctatggaaaaagagtcaagacaagtaaagacgattgttcagggtaccagttgcaattttaaatatggtygtcagagcaggcctcactgaggtgacatgacatttaagcataaacatggaggaggaggagtaagcctgagctgtcttaggcttccggggcagccaagccatttccgtggcactaggagcctggtgtttccgattccacctttgataactgcattttctctaagatatgggagggaagtttttctcctattgtttttaagtattaactccagctagtccagccttgttatagtgttacctaatctttatagcaaatatatgaggtaccggtaacattatgcccatttctcacagaggcact

SEQ ID NO: 32621 - DNA, 601 bp, Human
actgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcamaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagat

SEQ ID NO: 32622 - DNA, 601 bp, Human
aatttacacgcctataaatgctgtgagtagccgcatttccagatgtgagccataggagaaggccaaagtgatggtatgtaacctctgtgattaggttatagaagacaatctggcttctgccttggtagctggtagcatgtattcatgttctcgttgtgtttctttctctctctctctctctttctcatcactgacccttaggggggccatatcataagcagccctatgaagaagaccatgaggtgaggaactgacacgtcctgcccacagccctgtgaaagagctcagatgccattcctcyagcccaggttaaaagctgtactgcaacctcatgggaccaagaaacagaaccacccagtttagcagctctgaattctgaccttcaggaactaagaaattaatacaagtctgtggttttaggttgatgaactttggaagtaatttgttaggcaggaatagataactaatgcttaaacatgttgacagtaattagctgctgtgaccaagcctttataagttaagatgaagtgaggccggatgtggtggctcacacctgtaatcccagcactttgggaggccaaggtgggcggatcacgaggtc

SEQ ID NO: 32623 - DNA, 601 bp, Human
gaggcagaggttgcagtgagccaagatcatgccactgcattccagcctgggcgacagagcgggtctcgtgtctcaaaaaaaaaaaaatttacacgcctataaatgctgtgagtagccgcatttccagatgtgagccataggagaaggccaaagtgatggtatgtaacctctgtgattaggttatagaagacaatctggcttctgccttggtagctggtagcatgtattcatgttctcgttgtgtttctttctctctctctctctctttctcatcactgacccttaggggggccatatcatragcagccctatgaagaagaccatgaggtgaggaactgacacgtcctgcccacagccctgtgaaagagctcagatgccattcctccagcccaggttaaaagctgtactgcaacctcatgggaccaagaaacagaaccacccagtttagcagctctgaattctgaccttcaggaactaagaaattaatacaagtctgtggttttaggttgatgaactttggaagtaatttgttaggcaggaatagataactaatgcttaaacatgttgacagtaattagctgctgtgaccaagcctttataa

SEQ ID NO: 32624 - DNA, 601 bp, Human
aaaaaggccaggtgcggtggctcacaactataatcccagcactttgggaggccgaggcagatggagcacttgagttcaggagttcgagaccagcctggccaatgtggtgaaaccctgtctctactaaaaatacaaaacttagccgggcatggtggcacatgcctgtagacccagttactccagaggctgaagcagaagaatcgcttgaacccaggaggtggaggttgcagtgagccaagatcgtactactgcactccagcctgggcgagagagcaggactctgtctccaaaaagagttaagaaaaacaaaaacaaaaaaaacaaaactgaagaggactatcttaacatccattctcaaaaaggcaaaagccaaaaattcaaagatgctatgcactctaaaaatattaaattactttttactgatgctattttttatatagaaccagtgaccttacaaagaaaaaaaaccctactcctggttgtctacacacaacatcagaaataagtaatgataaatcacaatttttacaaaacaaaacaaaaatgtaagtcaacctcatatcaaaatatctgctttaacaaagcaacacttagtaacaat

SEQ ID NO: 32625 - DNA, 601 bp, Human
agcataaagccaagctacttaccatggctgcattggtacacatctgagtgacatcacagccatctgaagttttacacacgaacttcctcctgtttgtcctcaggcggtcatgtgaataaacacttttttgcctcttagttttcagttgaggtttttgaaatggaactaatgacagaagtggtagcatctcaagccttaggaactttctattccttttcaggagcatagctatttatttttctgaagccaaggaaaggcctggatggcctactaaaactatctgcaatcaaggatttatacmcagtatactatactaaacactaagcaaaaattatttttctgaattgtttcattgataatcttaagaacatctctgaaaaaacagcacatggaaagttaaacttaacagttgtgataaattcatgtaaagatttatgtgaaatgaaactattttcttttcttttcttttcttttctgagatagagtatcactctgtcgcccaggctgttgtgcaatggtatgatctcagctcactacaacctccgcctcccgggttcaagcaattctcctgcatcagcctccctagtaactgggattacag

SEQ ID NO: 32626 - DNA, 601 bp, Human
cagcctcacttgggcatcatgttgctctctcatctcatgaagggcttgcgccagcttgtactcatactcaatttgacgcccagaatccacctctaccaagcgcgtttcatgcttccttctggtctcgttaatctcctggggaaaaaacaaaaagcataaagccaagctacttaccatggctgcattggtacacatctgagtgacatcacagccatctgaagttttacacacgaacttcctcctgtttgtcctcaggcggtcatgtgaataaacacttttttgcctcttagttttcagttgaggtttttgaaatggaactaatgacagaagtggtagcatctcaagccttaggaactttctattccttttcaggagcatagctatttatttttctgaagccaaggaaaggcctggatggcctactaaaactatctgcaatcaaggatttatacacagtatactatactaaacactaagcaaaaattatttttctgaattgtttcattgataatcttaagaacatctctgaaaaaacagcacatggaaagttaaacttaacagttgtgataaattcatgtaaagatttatgtgaaatgaaact

SEQ ID NO: 32627 - DNA, 601 bp, Human
acagcctcacttgggcatcatgttgctctctcatctcatgaagggcttgcgccagcttgtactcatactcaatttgacgcccagaatccacctctaccaagcgcgtttcatgcttccttctggtctcgttaatctcctggggaaaaaacaaaaagcataaagccaagctacttaccatggctgcattggtacacatctgagtgacatcacagccatctgaagttttacacacgaacttcctcctgtttgtcctcaggcggtcatgtgaataaacacttttttgcctcttagttttcagttaaggtttttgaaatggaactaatgacagaagtggtagcatctcaagccttaggaactttctattccttttcaggagcatagctatttatttttctgaagccaaggaaaggcctggatggcctactaaaactatctgcaatcaaggatttatacacagtatactatactaaacactaagcaaaaattatttttctgaattgtttcattgataatcttaagaacatctctgaaaaaacagcacatggaaagttaaacttaacagttgtgataaattcatgtaaagatttatgtgaaatgaaac

SEQ ID NO: 32628 - DNA, 601 bp, Human
ttcaaaagaatcttctgaagagagctcactttggcatggtaagtctgctccagctcctccttatacagcctcacttgggcatcatgttgctctctcatctcatgaagggcttgcgccagcttgtactcatactcaatttgacgcccagaatccacctctaccaagcgcgtttcatgcttccttctggtctcgttaatctcctggggaaaaaacaaaaagcataaagccaagctacttaccatggctgcattggtacacatctgagtgacatcacagccatctgaagttttacacacgaacytcctcctgtttgtcctcaggcggtcatgtgaataaacacttttttgcctcttagttttcagttgaggtttttgaaatggaactaatgacagaagtggtagcatctcaagccttaggaactttctattccttttcaggagcatagctatttatttttctgaagccaaggaaaggcctggatggcctactaaaactatctgcaatcaaggatttatacacagtatactatactaaacactaagcaaaaattatttttctgaattgtttcattgataatcttaagaacatctctgaaaaaaca

SEQ ID NO: 32629 - DNA, 601 bp, Human
gtgacagaagaagaaatagcagagactttccatttggcccttatgcaaaaaagccggaagtgtggtagtcacaatctatgcacaatgatgacatgaaagtgagatctaatgcagtctgacattcattcattactaaatggatgtttatgtaggacagcatgatcagtacttgttattggaagaaagttatttcacatggtttgggttcaactactatggcatagtacgaatgatcaatgggacaaaaagacaaaacctaacctctaataaaattgcaacaaccctacattcttctagtaayttttaataacatttagtttatagaaaactgcacttttttgaaaaaatcaattttctatatatttcatggagactaggggaatcatttttaaaaactagaacaaaataaacataaagccatgttcatcatgggaattgtgaagtaatgattttaagtgttcaaaagaatcttctgaagagagctcactttggcatggtaagtctgctccagctcctccttatacagcctcacttgggcatcatgttgctctctcatctcatgaagggcttgcgccagcttgtactcatactcaatttgacg

SEQ ID NO: 32630 - DNA, 601 bp, Human
cagtctcctcatccaaagcacagtgaagatcaacctcaagagaagatctgtactaagtaaatcaaatggattaggcagcagccaaaaaaataataatacagtaggaaaaaataaaattgagggatagacagtaactagtagacaacttactattagtaaatggaaaagagtagtaaatgccaactcagtacaagaacagagaggcccatttttggaaaagtacctgttaagacagttgatataggccaggtgcagtggctcacgcctataatcccaacactttgggaggctgaggcgggcrgatcacctaaggtcaggagttcaagaccggcctgaccaacatggagaaaccctgtctctaccaaaaatacaaaattagcagggtgtggtggtgcatgccggtaatcccagctactagggaagctaaggcaggggaattgcttaaacctgggaggcggaggttgcagtgagccgagattgcgccattgcactacagcctgggcaacaagaacgaaattctgtctcagaagaaaaaaaaacaacaagaaaaacaaagacagtgatacagtctgtgtgtttgtgttcccacaaatttcatgtt

SEQ ID NO: 32631 - DNA, 601 bp, Human
atatataaagccagccgggcgtggtggctcacacctgtaatcctagcactttgggaggctgaggcgggtgggtcacttgcagtcaggagtttgagaccagcctggccaacatggtgaaacctcttctctactaaaaacaaaattagccgggtgtggtgacacacgcctgtaatcccagttactcaggaggctgaggtaggcaaatcgcttgaaaccaggaggtgaaggttgcagtgagccgagaatcacaccactgcactctagcctgggcaacaggctgagactctgtctcaatataaataaataaataaataaataaataaataaataaataaataatatgtaaagtctctttcagccagtttggcattttacaatatattaaatcaccaaaacacttaaaatctcaaaggaactaatccatcctgatgcagttcagcatttaaagtaataataataaataaactaagagtacttgagcaacattttctgcgatgaggtagaaatatgatctattactacttctatacctaggtgttcaaagaaatgaccaagaaaataaagttctttttaaaatgctatttatttttatttcaataaa

SEQ ID NO: 32632 - DNA, 601 bp, Human
tatagttggtgtacttttttctcttttcgtacctgtactttcttatgatcacaacggatataatattaaaattatctggctttttatcctaaatcagccactttccttttggaactttttttttctttttcttttttttgtgagacagagtttcactcttgtcacccaggctggagtgcaatggcacaatcttggctcactgcaaactccacctcccaggttcaagcaattctgtctcagcctcccaagtagctgggattacaggtgcctgccaccatgcccagctaatttttgtattttyattagagacggagtttcaccatgttgaccaggctggtcttgaactcctgacctcatgtgatccgcctgccttggcctcccaaagtgccgggattacaggcatgaggcaatgcacctggcccttttggaactcttttctgagaacaggtgtcaaaaatatttatacattgaccagatttaaaatatatataaagccagccgggcgtggtggctcacacctgtaatcctagcactttgggaggctgaggcgggtgggtcacttgcagtcaggagtttgagaccagcctggccaacatggtga

SEQ ID NO: 32633 - DNA, 601 bp, Human
tattttattacctgttcagaagtgttcttcaagcggataaatttcccatcaacatcaatttcttcgatgcaaacatttccagtggctgaggcggaatgagagatgctaacactactactcgcctctgattcttccacatcaaccctcttccgctttcctctagttgtacgtacactacgacttgaggatgctcgggatactgtcacacgggaagaagggcttggagacagcttcaacctatatgggaaaaataaaacaattcatttttaaaacacatatgcccttctcgccttaaaaaaamaaaaaacaaaaaaacaagggctgggcacagaggctcatgtctgtaacccaacagcactttgggaggccaaggcaggtggattgcttgaggtcaggagttcaagatcagcctgaccaacatggtgaaaccccgtctctactaaaaatacaaaaattagccaggcgtggtggtgggcgcctgtaatactagctactcaggaggctgaggcaggagaatggcttgaacccgggaggcagaggctgcagtgagctgagatcacaccactgcactctagcctgggtgacagagtgaaaacctgtc

SEQ ID NO: 32634 - DNA, 601 bp, Human
aagggtctattttattacctgttcagaagtgttcttcaagcggataaatttcccatcaacatcaatttcttcgatgcaaacatttccagtggctgaggcggaatgagagatgctaacactactactcgcctctgattcttccacatcaaccctcttccgctttcctctagttgtacgtacactacgacttgaggatgctcgggatactgtcacacgggaagaagggcttggagacagcttcaacctatatgggaaaaataaaacaattcatttttaaaacacatatgcccttctcgccttaaaaaaaaaaaaaacaaaaaaacaagggctgggcacagaggctcatgtctgtaacccaacagcactttgggaggccaaggcaggtggattgcttgaggtcaggagttcaagatcagcctgaccaacatggtgaaaccccgtctctactaaaaatacaaaaattagccaggcgtggtggtgggcgcctgtaatactagctactcaggaggctgaggcaggagaatggcttgaacccgggaggcagaggctgcagtgagctgagatcacaccactgcactctagcctgggtgacagagtgaaa

SEQ ID NO: 32635 - DNA, 601 bp, Human
tcatctcccagcctcccattggttgatcctacacacagaaaggagggtgaggggtgttacttcaaagataaagaaagttgtggaataatcaaataaattaatccatacaggcagttaaactaagaccgctttatggtcatcttcccacatttcaggttttcctactataaaaagaaaacacgattctgtcattttgtcaaacagtaacttcaacaatgagttaattagtaaggtacttgactttaaagaggacagaactggaagaacagggtatgaaccaaattaaatggtcaaattcacygctagataaggtgggtctttcaaatttacagcactatctagctgtcataatcacaatttttaaacatcaagtattggattacttcaagcttttaaaatagacacataagcttagaaacagaagaaaatctgtcattttccttctgcatctgtcccacttctgcccacattcagctctcatacatgaaagcataaggggctcaaaaaaagggtcagtggggctgggcatggtggcccatgcctgtaatcccagcactttaggaggccaaggcgggtggatcacctgaggtcaggagttgga

SEQ ID NO: 32636 - DNA, 601 bp, Human
gttagtgtttccctaattgtaagcaatatttctcactagcctatatgtaatcacatagttgatttatgttagtaatcatcatcataaaatgtcagtatccttgctggctaacttaacctaaaactaatatgtcctatagccatgtcattcaataccgcagcaaaatgtggcttgttagcacttaaaatatggctagtctgaaatgaatgtgctgtaagggtaaaatacacactagattttgaagacttagctaaacataaaaaaaaaagaatgtaaaaatatctgactttttagactgatyacatgttaaagcaatattttggatatattgggtttcataaaatatagttctaaaattcatgtctttcttttttactttaatgcggctataagaaaatttaaaattacacatgtggttctcatatttctattctagagttttaaactgatctttgcttttgcctctgcaattttacagaaagatcacttattactaccatgttccaaagagctgcttatcacatttaatgccagtaactgaagggaaaaaagtatcacattattttatatgataattgagttatccactagatctctagaa

SEQ ID NO: 32637 - DNA, 601 bp, Human
aaccagcctgggcaaaatggtgaaatcctgtctctatcaaaaaaaagaaagggtgggggggtggggtggaaacaggaaaaaaaaaatctatgaattactgattaggagagagcccttacttttgagatgttcccctgaagcatccagatctttcatcagcattacaaatggaaaagggcacaagatattaactgggattaaactgaaaaaaagaactgaatctggtccaacattcagactatgtggaatgttagtgtttccctaattgtaagcaatatttctcactagcctatatgtaatyacatagttgatttatgttagtaatcatcatcataaaatgtcagtatccttgctggctaacttaacctaaaactaatatgtcctatagccatgtcattcaataccgcagcaaaatgtggcttgttagcacttaaaatatggctagtctgaaatgaatgtgctgtaagggtaaaatacacactagattttgaagacttagctaaacataaaaaaaaaagaatgtaaaaatatctgactttttagactgattacatgttaaagcaatattttggatatattgggtttcataaaatatagttct

SEQ ID NO: 32638 - DNA, 601 bp, Human
tctggacaaatcactacacctctaggaaactcaatgcctttagctacagggatactactagccctgatctcttagaaagatcatttaaaaacaaatagaaacagaaaagtttgtaatccatacattgttatagaatataaaagactttatgactgcaaaaggaaagctgaagatggcaaagccaagtattatttcaaaatgggggccaggtgtagtggctccagcctgtaatcacagcactttgggaggccgaggcgggcagatcacttgagctaaggagtttaaaaccagcctgggcaamatggtgaaatcctgtctctatcaaaaaaaagaaagggtgggggggtggggtggaaacaggaaaaaaaaaatctatgaattactgattaggagagagcccttacttttgagatgttcccctgaagcatccagatctttcatcagcattacaaatggaaaagggcacaagatattaactgggattaaactgaaaaaaagaactgaatctggtccaacattcagactatgtggaatgttagtgtttccctaattgtaagcaatatttctcactagcctatatgtaatcacatagttgatttat

SEQ ID NO: 32639 - DNA, 601 bp, Human
cagctacagagtgctatacacagctatgtggccaggagaactcacagagcttctcaaggcctcagcttccccatctgataagtgaagatgataatatataagaccctgaagtaaaactgcctacactcacatcctagttcctttacacaccagctgaccctgagcaagttaccttactttagtcatccataaaacagggtagaaatggcacctgtaacaggtgcgattattgaaaagagcaagtgataacccacattcagtggctggctaactcagtgaatggtagcctcagcgttctatkactctgtgggttttataggccatccttccatgttagagccttctgtgactccctctaataatgttctctggctgcctacagcaagaactaaagagaccttctgcagcagagagcctatctagaataatcttatggaaactggtacgtctccaaacagacaatgtcacaataccctagagtatctgagactgcgctccaaaaagaatgctggaaatgtataaatcactcgctgttcaagggaaaatataattgctattgaaataggtcaaagaaataattatatttcccttctcatgagca

SEQ ID NO: 32640 - DNA, 601 bp, Human
cagttctcccacacgccaacgacagcaatgcgatgagactcaaacacttgattctaaaagtctgagaactatgccccagctacagagtgctatacacagctatgtggccaggagaactcacagagcttctcaaggcctcagcttccccatctgataagtgaagatgataatatataagaccctgaagtaaaactgcctacactcacatcctagttcctttacacaccagctgaccctgagcaagttaccttactttagtcatccataaaacagggtagaaatggcacctgtaacaggtgcsattattgaaaagagcaagtgataacccacattcagtggctggctaactcagtgaatggtagcctcagcgttctattactctgtgggttttataggccatccttccatgttagagccttctgtgactccctctaataatgttctctggctgcctacagcaagaactaaagagaccttctgcagcagagagcctatctagaataatcttatggaaactggtacgtctccaaacagacaatgtcacaataccctagagtatctgagactgcgctccaaaaagaatgctggaaatgtataaatc

SEQ ID NO: 32641 - DNA, 601 bp, Human
tcagtaagcatgtcagaacaaggttatgaccaatggcttccttgcaagccaacttacagctctcctggtaggcaaaggatgaaaaagcagtattacaactaaaaggaaaatgagaagaacaaaccatgctgaactcacaacaaaagctccattaacatgcttatggcaatagcaacaaaggagggactcaaattctaaacagaggctcagtgatgcgtggtacagcacctggataaggtgattcgctagggaaagacaaggaggaagccatgttttactagcttcaaagcacactttagcygctttattaggaagtagtatttctaagactagtattggtaggggtatatgcagtgtctttatgtggcaatggggaaggtaaggtactttgacaaggattctaagactgacacactgaaaacacacactccaagaagatgtacactccacaatcttcaaactcacagtttcatgaacattctgagagctagtaacaaggttaataatttaagcatttactagataaaggtactatgccagatactattccaagcatttcccaagtactgtctcattcttattattagctcatggatattgt

SEQ ID NO: 32642 - DNA, 601 bp, Human
cagaatcagtaagcatgtcagaacaaggttatgaccaatggcttccttgcaagccaacttacagctctcctggtaggcaaaggatgaaaaagcagtattacaactaaaaggaaaatgagaagaacaaaccatgctgaactcacaacaaaagctccattaacatgcttatggcaatagcaacaaaggagggactcaaattctaaacagaggctcagtgatgcgtggtacagcacctggataaggtgattcgctagggaaagacaaggaggaagccatgttttactagcttcaaagcacactktagccgctttattaggaagtagtatttctaagactagtattggtaggggtatatgcagtgtctttatgtggcaatggggaaggtaaggtactttgacaaggattctaagactgacacactgaaaacacacactccaagaagatgtacactccacaatcttcaaactcacagtttcatgaacattctgagagctagtaacaaggttaataatttaagcatttactagataaaggtactatgccagatactattccaagcatttcccaagtactgtctcattcttattattagctcatggat

SEQ ID NO: 32643 - DNA, 601 bp, Human
ttattcctaatgtcaatattttctagggctcaattctggaccctctcctgacaaactttactcagcgagtcctgtaactttatttatttatttgagacacagtcttgctctgtcgcccaggctggagtgcaatggcgcaatctcagctcatcccgagttcaagcaattctcctgcctcagcttcctgagtagcctggactacaggcacgtgccaccatgcccggctaattcttgtgtttttagtagagacggggtttcaccatgttggccacgctggtctctaactcctgacctcaggtgrtccacccaccttcggcctcccaaagtgctgggattacaggcatgagccactgcgctgggcctgataccacagtttatctttattacctttatcagaaaatcactttatcttattccctggctcccttactctctttacaatgtgggctccatgatgccagaaaccacgtatggcttttttcctgcttattcctaacacaaagtggctggcatacagcagatactcaggattttccaaataaatgaatagccctgcacttgtaaatatggttagcttccctaccaggtttgccagcctaac

SEQ ID NO: 32644 - DNA, 601 bp, Human
cagctctgtgctcagtcacataatgctggaagcctggcatcagccacagtaggagtatttataccacagaaattagcaaatgctacaaatcagggcgatcttatgtggacgaaagatgattgtttatattttatatattgcatctctacatatataagtaatcatttgcatatacaaaagtttccattatatctatattctggaaagtttggaaggactgctttattttttatttccctcataaaaaacatcttgtttttgccatggtgacaatcgctgtttttaaccacccagtgccccytccctcctgaataagagcccctaggtttacctgggtacacaccccccatggagcacacgtgtgtcacaaggagcccagtgcaatgtggctgtagaggggaggaagaagtcttgagctctaattccgccctcccaactccaggaactggtttagaggtgggcacgtgacccaccctagtccagtgtgagtgaagcccaggatgggtgcctcacaggggatgaagtttagcttccctccataattcaaacactcaatatcagattatttggtgggctggattgtccattcttttaacaaact

SEQ ID NO: 32645 - DNA, 601 bp, Human
aacagtattttgtggggattttttattactcttgcaggaccaaggaagatggaccattttgagcctctcaattagccagtaacttcaattctgtgaaattggtctatctttacaaacagaaatagccatttcacaaatatcagtgttttaaccaaattagtaataaaaaaaatgtgattctttagatcaaccaccgttcaagctatcaactaggagatagcagcatataaagcagaaaaataaattcttaaaaaactttgagagtacccagcttttctcaactcatcttaaaatgaggaaygagtcaaataaaatcttctataacaaaattaccacattccagcttctagaagctcgtggtatacatcccatatgcaaacattggctcttaaggctcatgatgtagcttaagactattagcctcaatgagaacctcagaaaacagcaacttgcctgtcttcattattatgaattaccttaacataactactttaagtgtaaccctgctgttaagcactcttcatttgaaaacatgcaaaaaccaattaatctaatacagaaagccgtataaaaaatgggtgagctaatgtctaaaaatcta

SEQ ID NO: 32646 - DNA, 601 bp, Human
attctgtaccctgtcctaaggtcactcaagaaagagaatgctacaggggaagacacaatattacttcagtaaaagcttatctaacacagaccagctagtttacaatggcagagaaagaaaatcaaaacccagtgtcacagaaatgagacttcgatttgaaatatgcccaataatgtgttttgtaaataaagtaaggtggcagaacagtattttgtggggattttttattactcttgcaggaccaaggaagatggaccattttgagcctctcaattagccagtaacttcaattctgtgaaaytggtctatctttacaaacagaaatagccatttcacaaatatcagtgttttaaccaaattagtaataaaaaaaatgtgattctttagatcaaccaccgttcaagctatcaactaggagatagcagcatataaagcagaaaaataaattcttaaaaaactttgagagtacccagcttttctcaactcatcttaaaatgaggaacgagtcaaataaaatcttctataacaaaattaccacattccagcttctagaagctcgtggtatacatcccatatgcaaacattggctcttaaggctcat

SEQ ID NO: 32647 - DNA, 601 bp, Human
cctgtggaaaatgctgacttggcacaaatgcagcagtgtttttgcttaagcacaaggctaacctgatgatctggcagcaagtaaatgagtgtgtcctcaagagtgctgcagagcatataattttattctgtaccctgtcctaaggtcactcaagaaagagaatgctacaggggaagacacaatattacttcagtaaaagcttatctaacacagaccagctagtttacaatggcagagaaagaaaatcaaaacccagtgtcacagaaatgagacttcgatttgaaatatgcccaataatgtrttttgtaaataaagtaaggtggcagaacagtattttgtggggattttttattactcttgcaggaccaaggaagatggaccattttgagcctctcaattagccagtaacttcaattctgtgaaattggtctatctttacaaacagaaatagccatttcacaaatatcagtgttttaaccaaattagtaataaaaaaaatgtgattctttagatcaaccaccgttcaagctatcaactaggagatagcagcatataaagcagaaaaataaattcttaaaaaactttgagagtacccagcttt

SEQ ID NO: 32648 - DNA, 601 bp, Human
gtgagccgagatcacgccactgcactccagtgtcacagcaagactgtctcaaaaaagaaaaaaaaaagagacagcatttctgtttattattattactattattcatccctttttttggagacagagtctcactctgtcgcccaggctggtgtgcagtggcatgacctcggttcactgaaaccttcacttcccaggttcaagcgattctcatgcctcagccaccccagtagctgggattacaggcatgcaccaccacgtgcggctaatttttatacatttttagtagagatggggttttgcyacgttggccaggctggtcttgaactcctggtttcaagtgatccacccacctcagcctcccaaagtgctgggattacaggcatgagcctccacacttggcccctgtttattatttttaaaggggtggggcggggggagctgtatatcagtaactttctggttactaaactgaaatttccgcataattagtagcagttcttataccttccatatttcctgcaggggaggaagtactatccaattcgaaatatctgctgagaagtttccactgctttttatcctattctgttactaagaattc

SEQ ID NO: 32649 - DNA, 601 bp, Human
tcttcctcctcctcctcttcttcaggtatggttgttttaaagactgtacttctttgagcaacctcctaaaaacaatagtagtttaagttaaaaaacacacttaaaatcaccaaatgcgggggagagggaccttttctttgcttaagagacagcatttcttgccaggcgcagtggctcacacctgtaatcccagcactttgggaggccaaggcaggcagatcacccgaggtcaggagttagagaccagcctgaccaacatggtgaaaccccgtctctactaaaaatacaaaaattagctggscatgatggcacgtgcctgtaatcccagctactcaggaggctgaggcagaagaatggcttgcattgaggttgcagtgagccgagatcacgccactgcactccagtgtcacagcaagactgtctcaaaaaagaaaaaaaaaagagacagcatttctgtttattattattactattattcatccctttttttggagacagagtctcactctgtcgcccaggctggtgtgcagtggcatgacctcggttcactgaaaccttcacttcccaggttcaagcgattctcatgcctcagccaccccag

SEQ ID NO: 32650 - DNA, 601 bp, Human
tttatatgcagattcttgctctaaattagtgatctaaaccttttaatcataggaccctacagagtaaacaagtttggagtaaacatccaatccatagacatgttttactgtaacacataatgcacattagaaaacaaaggacaaaactgaaacttggtacaatgagaaaaaataaaaataaaagtgccaacatattcttccagtaccctaaagtatcaccttgaatatccctttggggagtacaaaccccacttggtagataactgcgctggttcatcaactgataggggaaaaacccaaccacactcttggtcttcatgtaattctgtgaataaaatttgaaataaatatattaaataaataaagtaatacctgctggtggaaaagttcttcctcaacaaccactccagctgcttcttcctcctcctcctcttcttcaggtatggttgttttaaagactgtacttctttgagcaacctcctaaaaacaatagtagtttaagttaaaaaacacacttaaaatcaccaaatgcgggggagagggaccttttctttgcttaagagacagcatttcttgccaggcgcagtggctcacacctgta

SEQ ID NO: 32651 - DNA, 601 bp, Human
ttctcaactactctgctggcctggagtacctcctctagcatctgacatgctatataactcatgctgaccctcttgtctggtgccttgagttatctcttacataattattttacttctagtaattacgatggttcccattgaagcacagaaaatggaacttgtgcttgtttcttgtaagttaagtgtaacatatgtgttttaaaatattcctccaaaatgtatgagaaggcatccaggtaaaaaattcatgctacttcatgcaacccacctcaagtggttctcaaccctgggggttaaatayatgagacagtgtttatttagaccaggactagggctaatgaagcaaagcagacttaagactaaaaatctggagccatggaaacaaagtcttatcaggataagggtagacactttgattaatgatcggactcaaacagcttgagaatataaactgaaggctcattagttattaataattccaatttaattataattaaaaccaaatttggagtttctttatttcaagggctctcaaaagcccaaccatcagccaaaatctatcttcaattagataatgattaggaacttaatacagcaagaa

SEQ ID NO: 32652 - DNA, 601 bp, Human
gctaaaaacctcatacatctttattttttttcttctctcaccctcaagtttagtcactaagccttaataaatttccattatatattccctcactgcctctggaatctcctctctagagttagtccctctgattcagcttggccagtgatattttaaaatgcagtcttaacttctcctttgttccaaattgtacagaagctacatccctaagcattccagactatgtcagtttaattccaatctttcaacttcatttaactctcacatgaaccctacaaaataactggatgagcggatatasttggtgcattaagtctttttttatgaggcagagtctcactctgtcacccaagctggagtgcagtggcgccatctcagctcactgcaagctccgcctcccgggttcacgccattctcctgcctcagcctcccgagtagctgggactacaggctcccgccaccacgcccggctaattttttgtatttttagtagagacggggtttcaccgtgttagccaggatggtctcgatctcctgaccttgtgatctgcctgcctcccaaactgctgggattacaggcgtaagccaccgtgcccggcca

SEQ ID NO: 32653 - DNA, 601 bp, Human
acatcggagactacagcttgctagatcctgaacttacacatcccaagccatctgcagtggatttgtcctccaaggtgaagtcaacatggctcctctacccatttctttatcactcattaatttcatataacctcacaatatgacttgtgactcaccactgattgaactaaaactggttttttgaaggtcaccaaaatatttctaatcaattcaaaaggcgattggattcatcctcaaatatgaagttcaaacgcctgttctgcccttccatcttccctcttatgaaccttggtatcattaktttctgtgatcacaaaagctaaaaacctcatacatctttattttttttcttctctcaccctcaagtttagtcactaagccttaataaatttccattatatattccctcactgcctctggaatctcctctctagagttagtccctctgattcagcttggccagtgatattttaaaatgcagtcttaacttctcctttgttccaaattgtacagaagctacatccctaagcattccagactatgtcagtttaattccaatctttcaacttcatttaactctcacatgaaccctacaaaataa

SEQ ID NO: 32654 - DNA, 601 bp, Human
accatacttctttattttgaggaagacagttgaaaattttacataattgcacagcttctattggatgctcttggggttccctgatgaggaaaacagaaggaaaaattaatactaaagaaatagatcacagtattctaaaataagacaaaaacttttaactacagggataccaaaccatattacctaacctcaaatggaccctttatcatctctcatcttttctaaccttttctttttttctttttctttgtttgtttgagatagagtctcactctgttgcccaggctggagtgcagtggtrcaatcttggctcactgcaacctctacctcctgggttcaagcgattctcatgcctcagcctcccgagcagctgcgactacaggtgtgcatcaccaccacgttagccaggctggtcttgaactcctggcctcaagtgatccacctgcccttggcctcccaaagtgctgggattacaggcgtgagccaccgtatctggcctctaaccttcttttatggacttctttctagaataccccccaacaaattccagaacagtaattgtcaactctggctacacattcagatcctgaggagtttaaaa

SEQ ID NO: 32655 - DNA, 601 bp, Human
taccatacttctttattttgaggaagacagttgaaaattttacataattgcacagcttctattggatgctcttggggttccctgatgaggaaaacagaaggaaaaattaatactaaagaaatagatcacagtattctaaaataagacaaaaacttttaactacagggataccaaaccatattacctaacctcaaatggaccctttatcatctctcatcttttctaaccttttctttttttctttttctttgtttgtttgagatagagtctcactctgttgcccaggctggagtgcagtggygcaatcttggctcactgcaacctctacctcctgggttcaagcgattctcatgcctcagcctcccgagcagctgcgactacaggtgtgcatcaccaccacgttagccaggctggtcttgaactcctggcctcaagtgatccacctgcccttggcctcccaaagtgctgggattacaggcgtgagccaccgtatctggcctctaaccttcttttatggacttctttctagaataccccccaacaaattccagaacagtaattgtcaactctggctacacattcagatcctgaggagtttaaa

SEQ ID NO: 32656 - DNA, 601 bp, Human
aaagattaccatacttctttattttgaggaagacagttgaaaattttacataattgcacagcttctattggatgctcttggggttccctgatgaggaaaacagaaggaaaaattaatactaaagaaatagatcacagtattctaaaataagacaaaaacttttaactacagggataccaaaccatattacctaacctcaaatggaccctttatcatctctcatcttttctaaccttttctttttttctttttctttgtttgtttgagatagagtctcactctgttgcccaggctggagtgyagtggtgcaatcttggctcactgcaacctctacctcctgggttcaagcgattctcatgcctcagcctcccgagcagctgcgactacaggtgtgcatcaccaccacgttagccaggctggtcttgaactcctggcctcaagtgatccacctgcccttggcctcccaaagtgctgggattacaggcgtgagccaccgtatctggcctctaaccttcttttatggacttctttctagaataccccccaacaaattccagaacagtaattgtcaactctggctacacattcagatcctgaggag

SEQ ID NO: 32657 - DNA, 601 bp, Human
caagacgcacagtggtttatttaccctcccctcctcataagaacttaaaaaaaaagaaaaaacacacatacaaaaaaagtcaaaaaatttgaggaaccccttccgaacagtacacagttattaagttcagtgtcaataattcacatcttgcaacaaagtgtatggacatgatttcttttacaaaactttcagtgtcaaaaaggaaattaaggccatcagatttgcagcttaaaaattcacataaaggaaatataaaaatattctgtgcttctgagaaggctctgcactgtatacaggtaargattaccatacttctttattttgaggaagacagttgaaaattttacataattgcacagcttctattggatgctcttggggttccctgatgaggaaaacagaaggaaaaattaatactaaagaaatagatcacagtattctaaaataagacaaaaacttttaactacagggataccaaaccatattacctaacctcaaatggaccctttatcatctctcatcttttctaaccttttctttttttctttttctttgtttgtttgagatagagtctcactctgttgcccaggctggagtgcag

SEQ ID NO: 32658 - DNA, 601 bp, Human
ttctggctccttgaagatgaaaaaagttcccttgcaatcgtccattcatcagagaattaatgaagcctactcaccagcagatgatgtaatcctggtggcttcccccatcagatctaggctgcctgccccacggataccttctgggctaattgcctgctttgcacctgttccttctcgggaggccctggcaccctagcacctggtgcctgtgccatctcccctctctgccaggacacccagaggcccttgtgaatagcaaagcccacttaacggctgagggcaggtgggggtatttccttcycaattctgctcaaggcccgttgctgttctttgaggatgttgcaaatccagggtttggagggctgggcctcttggtggcctggttgtctatctgatagggcggagccttcacccttgcagcgagctctctcacaccagatgtgctctgcgtggaatcctaggccatcaggggattccttagcaagccctgcaggacccaaatcctaactcagaccctcatcctcctactcagaatgtggagacttgtgatcctcagtttggacgaattccaagagaccttccaattcccagaggccatctt

SEQ ID NO: 32659 - DNA, 601 bp, Human
agtacctggcacaaagtagatgctcccaaatctttgttccccttcattgatcctctgtgatggaaggaacttgtagccactttcctcatccgccttggtttttcaaaaacaccctttgaagttataacctccttgggagccaaggcttctctgaagcaccccattacaatctttgccctcaactcagaactggaatgtgtttgaaaatgctaacaagggcagcagccccacctcttcgtcattgcctaaggttgttaggcaaacacacacacacacacacacacacacacacacacacacagcacacacactcacacagttgctggggagatcatggtaaacacaagcctctcttttggatcagaataattgagtggtctccctttgtggccagtgtacaggaacaaattagatgggtaaattagcagttcccgaagacattagcaaccagcggctcacacagcaagcgcctgactcaccgtggggcctctccaagtcacagcctatgaatagatgctcttcctccctccgaaagagaagccagagtgcccggaacaccacaggggaagcttgaagacttgtacccctttggagtcttttt

SEQ ID NO: 32660 - DNA, 601 bp, Human
gattcaccttttcagggcaacctaaagaagtatgggttggttttctttaagctgaaacattacggcaagaacctggagtaatatctgcttcaaaggggagttatgcaaagtcaacaagagaagacgtgtaaaacccaagcacagtacctggcacaaagtagatgctcccaaatctttgttccccttcattgatcctctgtgatggaaggaacttgtagccactttcctcatccgccttggtttttcaaaaacaccctttgaagttataacctccttgggagccaaggcttctctgaagcaycccattacaatctttgccctcaactcagaactggaatgtgtttgaaaatgctaacaagggcagcagccccacctcttcgtcattgcctaaggttgttaggcaaacacacacacacacacacacacacacacacacacacacagcacacacactcacacagttgctggggagatcatggtaaacacaagcctctcttttggatcagaataattgagtggtctccctttgtggccagtgtacaggaacaaattagatgggtaaattagcagttcccgaagacattagcaaccagcggctcac

SEQ ID NO: 32661 - DNA, 601 bp, Human
tcgcagccacatgggtagaactggaagctgttatcttaagttaaaaaagtcagacactgaaagacaaatatcacattgttcactcataagtgggagctaaataatgtgaacacatggcattagggtatggaataatatacactggagactcagaagggtggggggaggatgatgagaaattaattaataggtacaatgtggtgatatcaatctggtgatagatatcaatagatatcaatctggtgatagataccaatagatatcaatctggtgatagataccttagaagccctgacttcamgactatgcaatttacgcttgtcacaaaattgtacttgttccccataaatttatgtaagtttttttgtttttgtttttgtttttatgagatggagtttctcgtcacccaggctggagtgcaatagtgccatcttggctcactgcaacctccgcctcccgggttcaagcaattctcctctctcagcctcccgagtagctgggattacaggcatgagccaccacgcgtggctaattttcatatttttagtagagacagggtttcaccatgttgcccaagctggtcttgaactgctgacctcag

SEQ ID NO: 32662 - DNA, 601 bp, Human
attagaactaccattcaatccagcaatcccactactgggtatccatccaaaggaaaagaaataattagatacctgcacttgtatgtttatcgtagcactagtcacaatagcaaagatgtggaatcaacctaagtgtccatcaatggatgattggatttaaaactgtggtgtatatatatgcaatggaatattattcagccataaaaaagaatgaaatcatgtctctcgcagccacatgggtagaactggaagctgttatcttaagttaaaaaagtcagacactgaaagacaaatatcacaytgttcactcataagtgggagctaaataatgtgaacacatggcattagggtatggaataatatacactggagactcagaagggtggggggaggatgatgagaaattaattaataggtacaatgtggtgatatcaatctggtgatagatatcaatagatatcaatctggtgatagataccaatagatatcaatctggtgatagataccttagaagccctgacttcacgactatgcaatttacgcttgtcacaaaattgtacttgttccccataaatttatgtaagtttttttgtttttgttt

SEQ ID NO: 32663 - DNA, 601 bp, Human
attcaatatgtttgggatagcagttgattatgggtgggaaacgtaaatgcagcatcttattgtggaaggccttagctgcaagtctccaggaatgtggattttttttttttttttttgagacagggtcttgctctgttgctcaggctggagtgcagtggtgatactgtggttcactgcagccttgaccttctgagttcaggtgatcctcccacctcaacctcccaagcagctgtgtgtgccaccacgcttggctaatttttgttttgttcttttgttttgttttttgtttgtttgtttgttkgctttttgtagagatggggttttgccatgttgctcaggctgatctcaaactcctgggctcaagccatctgcccgccttggcctcccaaagtgatgggattacaggtgtgagccactgcacctagccaagaatgtggatttaatgagccactagtccatggaagactcttgaacaggggaaggatgtgagtggagttgcatttgggttgggttggggtggggagaggctggaggtgaggctgctgtgctaggagcttaaccaccagtgaagggttgaagaaaggaggtgggggcaggggga

SEQ ID NO: 32664 - DNA, 601 bp, Human
tgcagcctctgcctcccaggttcaagcaattctcctgcctcagcctcccaagtagctgggattgcaggtgcccaccaccaagcttggctaatttttttgtatttttagtagagacggggtttcaccatgttggccaggctcgtctcaaactcctgacttcaggtgatccacctgccttggcctcccaaagtgctgggattacaggcatgagccaccatgcccggccacaactcttaagtcagatttgggtcatggagatataggctgacatctggaagggtgtcacaaagatgcacaaagmagaaggggtgcttgagggcacatttagaaggggtgctggaggacaccacatgcgctgggctgacaattgggcatcatttctatgataaaagtagtttgtaggggaggtgggactaaacatacaggaccacattcctttttgtttgtcctgatggctgctcaggatgatgtgatattcctggcccatggtgttgtagaagaattgtacattccaaacagatagggatgacactgtgggtgcagtattgccgaggtgtcccagcgctgagtagggaaactgtgtcccaggccaccagctata

SEQ ID NO: 32665 - DNA, 601 bp, Human
aactggtgggcagcctccaggatgcagtggttggctgggctgtggtcatcacctgcaatgtggccattgtctccctgggctggtacaccttttttttttttgagccagagtttcgctcttgtcacctaggctggagtgcaatggcacaatcttggctcattgcagcctctgcctcccaggttcaagcaattctcctgcctcagcctcccaagtagctgggattgcaggtgcccaccaccaagcttggctaatttttttgtatttttagtagagacggggtttcaccatgttggccaggctsgtctcaaactcctgacttcaggtgatccacctgccttggcctcccaaagtgctgggattacaggcatgagccaccatgcccggccacaactcttaagtcagatttgggtcatggagatataggctgacatctggaagggtgtcacaaagatgcacaaagaagaaggggtgcttgagggcacatttagaaggggtgctggaggacaccacatgcgctgggctgacaattgggcatcatttctatgataaaagtagtttgtaggggaggtgggactaaacatacaggaccacattccttttt

SEQ ID NO: 32666 - DNA, 601 bp, Human
gctttgggaggcccaggaagggaagttccagccacaatggcaatgaggtttattgtgcccaatggggaggaagtgagaggagagagttataactttggtggcctgggtggtggccacccttttcaggtatgtgacaaatgctgattgagggatcccccaagggaagctgtttgtgctccagcaagggggtcccttggtagatgatgtgggtaactggtgggcagcctccaggatgcagtggttggctgggctgtggtcatcacctgcaatgtggccattgtctccctgggctggtacaccttttttttttttgagccagagtttcgctcttgtcacctaggctggagtgcaatggcacaatcttggctcattgcagcctctgcctcccaggttcaagcaattctcctgcctcagcctcccaagtagctgggattgcaggtgcccaccaccaagcttggctaatttttttgtatttttagtagagacggggtttcaccatgttggccaggctcgtctcaaactcctgacttcaggtgatccacctgccttggcctcccaaagtgctgggattacaggcatgagccaccatgcccggccacaa

SEQ ID NO: 32667 - DNA, 601 bp, Human
cataggacagggcaagacctaggagcctagaccagaagtgtttggtgttggtggttttgtggtgcaaataagggagtggcctgctcatgggggcagataggaggcccaacattgcatgaggtccagccactgggatgtggctttatctctgtgtacatacaagttagcccggagatagccttaggcagtagaattgctttgggaggcccaggaagggaagttccagccacaatggcaatgaggtttattgtgcccaatggggaggaagtgagaggagagagttataactttggtggcctgkgtggtggccacccttttcaggtatgtgacaaatgctgattgagggatcccccaagggaagctgtttgtgctccagcaagggggtcccttggtagatgatgtgggtaactggtgggcagcctccaggatgcagtggttggctgggctgtggtcatcacctgcaatgtggccattgtctccctgggctggtacaccttttttttttttgagccagagtttcgctcttgtcacctaggctggagtgcaatggcacaatcttggctcattgcagcctctgcctcccaggttcaagcaattctcc

SEQ ID NO: 32668 - DNA, 601 bp, Human
gaagaaatccatggtcaacagtgaggtgctgatcaaaactgcaatcagattggattagggagagatcagagtggatggacatcagcatggaaggctttctggaggaagcagaaaatcgagttgccccttgatgagcgattatctggaaacttcctttgttgtcaggcttgtactttgagctatacatagagtgttttttaggcccttgcaacactctaatgaagtaagtattgtaatcataattttatgggtgatgaaactgagtcacagaaagcctacagaacttgctccagctcacagrgctactaaggactgagtaggaattaacagccggtgatttcaataatggttttcttaacagagcaggtgtgtctggtaggaaacagcccaagtaagggtctgggtatggggtcagttggaggagctggaggtgcagttcacaggtagtaatgaagtcagctggttgcagaattggaccataacaatattccagtgaaaggaaccagatctgctgttctctcccatttaaaagccttggatgccaaaacgcaccacacctgacccggtgatcacaggcaattcaaaggtgtattacttatgc

SEQ ID NO: 32669 - DNA, 601 bp, Human
gtaggagagccaggtaaaatgcaatcacttctttccaagacctttatctcttacttggaagtcaaaatgaacacatttgtaatggagaagaaatccatggtcaacagtgaggtgctgatcaaaactgcaatcagattggattagggagagatcagagtggatggacatcagcatggaaggctttctggaggaagcagaaaatcgagttgccccttgatgagcgattatctggaaacttcctttgttgtcaggcttgtactttgagctatacatagagtgttttttaggcccttgcaacacyctaatgaagtaagtattgtaatcataattttatgggtgatgaaactgagtcacagaaagcctacagaacttgctccagctcacagagctactaaggactgagtaggaattaacagccggtgatttcaataatggttttcttaacagagcaggtgtgtctggtaggaaacagcccaagtaagggtctgggtatggggtcagttggaggagctggaggtgcagttcacaggtagtaatgaagtcagctggttgcagaattggaccataacaatattccagtgaaaggaaccagatctgctgt

SEQ ID NO: 32670 - DNA, 601 bp, Human
gcttcatgaggcaaaagccaacacgcagacaccgtattacctagcggcatttattggatttgtctcttgagtgattcaaacaaaagattacagttataaatagatagacctaattgttgcaaacaatgcctaccttttattgagcacttattatgtgccaggcattttaaatacttgatcttattcaatcctgataaaaaacctcctgagatcagtaatattattccaattttacagaggaggaaagtgagagagaaatttcaataactttcccagggtcatacagctgcataaatgtagragacggaatttagacctaggtcttctgactatgccctcacctcattcactatgccagtgtttcccaaatttcctacgtttgcatgttaggaatacatattcttaggcccacacccaatctcccagatcaagggagaaacctcagaaggcctttccctggatacctgatctaaaaaatagcctcctccccaggcactaacacaccgttatttaattttcatcattatatttgtcactacttgatattttcttatttgtgtatttgcatattgtctttcttctccactaagggatgagttcc

SEQ ID NO: 32671 - DNA, 601 bp, Human
gaagagcttcatgaggcaaaagccaacacgcagacaccgtattacctagcggcatttattggatttgtctcttgagtgattcaaacaaaagattacagttataaatagatagacctaattgttgcaaacaatgcctaccttttattgagcacttattatgtgccaggcattttaaatacttgatcttattcaatcctgataaaaaacctcctgagatcagtaatattattccaattttacagaggaggaaagtgagagagaaatttcaataactttcccagggtcatacagctgcataaaygtaggagacggaatttagacctaggtcttctgactatgccctcacctcattcactatgccagtgtttcccaaatttcctacgtttgcatgttaggaatacatattcttaggcccacacccaatctcccagatcaagggagaaacctcagaaggcctttccctggatacctgatctaaaaaatagcctcctccccaggcactaacacaccgttatttaattttcatcattatatttgtcactacttgatattttcttatttgtgtatttgcatattgtctttcttctccactaagggatga

SEQ ID NO: 32672 - DNA, 601 bp, Human
tcaaacatgcctaaactagagaactggatgacccttgttccttagactcgggcattcttgctcacaggaatgtcttttgaaaatttatttttcaagaggaagagcttcatgaggcaaaagccaacacgcagacaccgtattacctagcggcatttattggatttgtctcttgagtgattcaaacaaaagattacagttataaatagatagacctaattgttgcaaacaatgcctaccttttattgagcacttattatgtgccaggcattttaaatacttgatcttattcaatcctgataaraaacctcctgagatcagtaatattattccaattttacagaggaggaaagtgagagagaaatttcaataactttcccagggtcatacagctgcataaatgtaggagacggaatttagacctaggtcttctgactatgccctcacctcattcactatgccagtgtttcccaaatttcctacgtttgcatgttaggaatacatattcttaggcccacacccaatctcccagatcaagggagaaacctcagaaggcctttccctggatacctgatctaaaaaatagcctcctccccaggcacta

SEQ ID NO: 32673 - DNA, 601 bp, Human
atcccccatgagtgaaaaagggcaggtagcctggtgcccatttgataggagaggaaattaggccaaagccctttcaaatctcaaacatgcctaaactagagaactggatgacccttgttccttagactcgggcattcttgctcacaggaatgtcttttgaaaatttatttttcaagaggaagagcttcatgaggcaaaagccaacacgcagacaccgtattacctagcggcatttattggatttgtctcttgagtgattcaaacaaaagattacagttataaatagatagacctaattgtkgcaaacaatgcctaccttttattgagcacttattatgtgccaggcattttaaatacttgatcttattcaatcctgataaaaaacctcctgagatcagtaatattattccaattttacagaggaggaaagtgagagagaaatttcaataactttcccagggtcatacagctgcataaatgtaggagacggaatttagacctaggtcttctgactatgccctcacctcattcactatgccagtgtttcccaaatttcctacgtttgcatgttaggaatacatattcttaggcccacacccaa

SEQ ID NO: 32674 - DNA, 601 bp, Human
atctcttatccctctgagtctcagaaatcccccatgagtgaaaaagggcaggtagcctggtgcccatttgataggagaggaaattaggccaaagccctttcaaatctcaaacatgcctaaactagagaactggatgacccttgttccttagactcgggcattcttgctcacaggaatgtcttttgaaaatttatttttcaagaggaagagcttcatgaggcaaaagccaacacgcagacaccgtattacctagcggcatttattggatttgtctcttgagtgattcaaacaaaagattacrgttataaatagatagacctaattgttgcaaacaatgcctaccttttattgagcacttattatgtgccaggcattttaaatacttgatcttattcaatcctgataaaaaacctcctgagatcagtaatattattccaattttacagaggaggaaagtgagagagaaatttcaataactttcccagggtcatacagctgcataaatgtaggagacggaatttagacctaggtcttctgactatgccctcacctcattcactatgccagtgtttcccaaatttcctacgtttgcatgttagga

SEQ ID NO: 32675 - DNA, 601 bp, Human
ttcagttagagaaatgtttccacaggtccttgataaactagggaaaaagacccccagggctttctgatagcaggcgggtgtccttgatagcgtgacgggtggggcaggcggaactttggcatcagggcgcagggatggattctaacggtttctttgctggttgaagaggctgcttcctgccgacttcttttttttttcttcttattcttcacttaccagcccagcttgtgaatgtgaaggagttgtcccttttccaaatgaacaggactggtgtatcaggtggccttgccattgtatgcayctgccggtctgagaaagcaagtgttctgtctgtatctgcaactgtttgtgtctcacgctttgcaaatctcttatccctctgagtctcagaaatcccccatgagtgaaaaagggcaggtagcctggtgcccatttgataggagaggaaattaggccaaagccctttcaaatctcaaacatgcctaaactagagaactggatgacccttgttccttagactcgggcattcttgctcacaggaatgtcttttgaaaatttatttttcaagaggaagagcttcatgaggcaaaagccaacacgc

SEQ ID NO: 32676 - DNA, 601 bp, Human
atccaattcactcccttattgtgttactatgatcttgcccagtctctgaaactcagagctcagttttaagtttattttaaaaaagtgatcaaaccaccctttaaacccattgtttgcataaacatacttttaaaaaggaatgttatttttctcctgagaatttgttgaaggaagtgggggtttttgttataacaaacctagctcattacagaactggtgtcttaaccttcaagactgaatagtgatgtttatattctcattggatggtggtacttcctgtgttttatgagaatatgttgarcttttatgctggtaactgagggtaaaacccaggtaaataaacaccatagaaagccgaaattgaagggtgtatgtgtgtgtgtgcggtatttcaagcaggaaagcacaattcttttaaagcaggaaaagaaaaaacaaaacaaatgtctcttaaaagcacaaatggacaagtcattaaccagctcctttggtcttgtgtaacaaatcccttcaaaggattagagggggacttcaaaggaataaaaattctcaaaaccagacagctaatgactcttaaaagggcatttgcgttgacaggaaa

SEQ ID NO: 32677 - DNA, 601 bp, Human
ggcaggaggatcacttgagcccaggagtttgaggccagcctgggcaacgtggcaaaatcctgtttctacaaaacatataaaaaattgcccaggcttggtggcatgagccagtagtcccagctacccaggaggctgaggtgggaggatcatctgagcccaggaagttgaggctgcagtgagcactgcactctagactagacaacacagtgagaccctagctcaaaaaaattcaaaactatagttttttgtttgtttgttttgagacacagtttcactcttattgcccaggctggagtgcaayggcacaatctcggctcactgcaacctccacctcctgggttcaagtgattctcccgcttcagcctcccgaatagctgggattacaggtgtccaccaccaggcccagctaattttttttattttaagtagagacgaggtttcattcactgaagccttgctttctttcctttgtttctacagattgtatataaggactgccatttccccttctaataactaataccctagctttttcatgtgtatcaactcagagttgcatctcttctctttccacagcccatggtcttactctgggctttca

SEQ ID NO: 32678 - DNA, 601 bp, Human
gtctataacactctgacaacttcaggtgatcccgtcatgtgaagtatgaagtgttccttatgaatatttaggagtgctaaagccatgcccacactttctagacacagtgtaacagcacttcatgagactatcatctttggaacaagaaaatgggaagctcaagttagtttatctggggaaaaaaaatggccaggtacagtggctcacgcttgtaatcccagcactttgggaggccaaggcaggaggatcacttgagcccaggagtttgaggccagcctgggcaacgtggcaaaatcctgtytctacaaaacatataaaaaattgcccaggcttggtggcatgagccagtagtcccagctacccaggaggctgaggtgggaggatcatctgagcccaggaagttgaggctgcagtgagcactgcactctagactagacaacacagtgagaccctagctcaaaaaaattcaaaactatagttttttgtttgtttgttttgagacacagtttcactcttattgcccaggctggagtgcaatggcacaatctcggctcactgcaacctccacctcctgggttcaagtgattctcccgcttcagcc

SEQ ID NO: 32679 - DNA, 601 bp, Human
tcctcgtgccagtactggtcgatggccttcaggaagtagcggtccccaatgttctgctggcagccgccgcatgtcagcagggatggggggatctgcagcacctcatccactggttccctggagagaaggccaagcatcagggacagcctcaccagagtgagaccagcaccgagggtccgagatcgttttgggccagacagggcatctcacctgactgcctttcagtgacctaagggagaagggacaggacaacacatcccttggccagactgcagagtcccaaccaaccttgggttaagaygggaaagagccagaccttactccctagatgtctaagaagtaaacacagggcaccaagaggcatcaaaggcaattgcaggtggcactgtgcccctgcccatgcccagcactacctgggcacctctggtctccttctgctttttcccactctccccgctgactctatcttcacagatctccctcattttcctcctcccataacctggacacccaagggcactgcctaacctcaaaggacgcactctggactaaaagagtcgctcactgccagggcagcagatgacccagagtgctaagaatc

SEQ ID NO: 32680 - DNA, 601 bp, Human
acaggagctgagactcagcctctgcagtctgacctctttctataggtggtgtccgagcctggagcagggtaaggggcaacacacaccgactgcagatgtccatggaccacccagcctcccttccgagggcccagtggagtgccggggagggtacctgagatagtctctccggcagagcttccggcccagtttgtagtagaggcgccgccccacctcacccagccggcagccacagaggtcgcagctcaggcagtcctcgtgccagtactggtcgatggccttcaggaagtagcggtccccratgttctgctggcagccgccgcatgtcagcagggatggggggatctgcagcacctcatccactggttccctggagagaaggccaagcatcagggacagcctcaccagagtgagaccagcaccgagggtccgagatcgttttgggccagacagggcatctcacctgactgcctttcagtgacctaagggagaagggacaggacaacacatcccttggccagactgcagagtcccaaccaaccttgggttaagatgggaaagagccagaccttactccctagatgtctaagaagtaaacaca

SEQ ID NO: 32681 - DNA, 601 bp, Human
ccaaacttagaaacactcccagtccctctgatcctccgtgtgtactcctcctcaatcccatcccctagcttctcccgctccccaagggaagcacttttctgaattttgggtatacaattctcttgcctttaaagatattagtattttaccacataggaacgtaaccctgagaacatgcttctcaaacaggaagaaatgccctctgcttctcagcacaggagctgagactcagcctctgcagtctgacctctttctataggtggtgtccgagcctggagcagggtaaggggcaacacacacygactgcagatgtccatggaccacccagcctcccttccgagggcccagtggagtgccggggagggtacctgagatagtctctccggcagagcttccggcccagtttgtagtagaggcgccgccccacctcacccagccggcagccacagaggtcgcagctcaggcagtcctcgtgccagtactggtcgatggccttcaggaagtagcggtccccaatgttctgctggcagccgccgcatgtcagcagggatggggggatctgcagcacctcatccactggttccctggagagaaggccaag

SEQ ID NO: 32682 - DNA, 601 bp, Human
atgcttcacagaccctctgctccaggaaaacggagaaatactgacagctacacagttgagcagatctgacagtagagggcacagagacagttacctccacagcagctcatcggaaactagaaacactagtacattctaggcaaaggctttcacacagtgctggaaaattcggatggccaataggatggcccagagcatgggagatgtcctcagctcctgtcttacttggtgttgtcgagttcctattttactcttccattcttccatccctttgctcattagattggaaaataatgattaygtaagagcagctaacatctatttgatccataccaagccaagtagtttatctgcattattccatcaaatcctccccacatccttagaggtaggtgctattatcatccccattttacagataaggaaatcgaggcttaggaaggttaaataacttgcccaaggccaccaagctgggaagcaatggtattgggactcaaacctccaactgcctacagggcctttgcctttctgctcttcgaagactgccttcctgctatgagtcaatgcttggagctccatatgctttctatttttaaatttc

SEQ ID NO: 32683 - DNA, 601 bp, Human
tgtttctataatgtaaaatgctctgagggcaggtttgggaggaaaagctggcccagcagccaagggcgctgaggtctcaacaagcttccatgggttggatggtcctggtgtatcagggaagcatgcttcacagaccctctgctccaggaaaacggagaaatactgacagctacacagttgagcagatctgacagtagagggcacagagacagttacctccacagcagctcatcggaaactagaaacactagtacattctaggcaaaggctttcacacagtgctggaaaattcggatggccrataggatggcccagagcatgggagatgtcctcagctcctgtcttacttggtgttgtcgagttcctattttactcttccattcttccatccctttgctcattagattggaaaataatgattatgtaagagcagctaacatctatttgatccataccaagccaagtagtttatctgcattattccatcaaatcctccccacatccttagaggtaggtgctattatcatccccattttacagataaggaaatcgaggcttaggaaggttaaataacttgcccaaggccaccaagctgggaagc

SEQ ID NO: 32684 - DNA, 601 bp, Human
aagcctcagttgatcagtcacttatttcaggcagtattcagtgtcaaggtgggagacagaacatggcagggctcagtgcagtggttctcaaagtgttggtcctgggaccagcgacatcagcactgcctgggaacctgacagaaatacaaattctcaggctgggcgcagtggctcacacctgtaatcccaacactttgggaggctgaggcaggcaaatcacttgagctcacaagttcgagaccaccctgggcaacatggtgaaactgtgtctttacaaaaaatacaaaaattagccgggtgyggtggtgcatgcctctagtctcagctattaatacttgggaggctgaggtgggaggatggctttagcccgggaggtggaggttgcagtgagccgagatcatgccactgcactccagcctgggccacagagccataccttgactcaaaagaaaagcaaaaactaaacaaacaaacaaaaaaacaaattctcagccctcctccttccctacccaactgagacaccctggggagaaggcccagcagtctgtgcgttaacgaacacttccgggggactggttgcaggctgacatttgagaagcaa

SEQ ID NO: 32685 - DNA, 601 bp, Human
gaagtgtcagcccctgaattatgccacttggatgctatgtcttgatacccaataaaggtctaccatcccctaagaaatcccttaccccaccctcaaacccccaaagtgcctaagagtgaagacgaagatgccatggagacggcgtcttcagtgaacacctccccaaagatgcccggggacacgggcctatatcatcccattgatcttagtccactcgtagatgtcctgttcgcacactatgtcagagttgatgaggaggtatctgtcacctacacagaaatgcttctgacaggcggcgcayttgaaacattccaggtgatacactttgtctttcacccgcattgtcatctcataggcacgaatccgcttgtcacaggatgcgcagagaccgtcttgcccaaaaagcctggggcaaaagaaagaaaagctaagaagacagtgaaagggacaatcctggaagacagggctcggggatgagccctagaaaggaggccgaactttcaggatgtcaggaagccagggaaggtcggctccagaaggagggccggctagtgcagtcttcaccagcaggcagagggaactcagatgaaactggcatttg

SEQ ID NO: 32686 - DNA, 601 bp, Human
gtcaaagtcacaacaagtctgtacacaacaactctctatctgtagatatgaaattccatcatgatagcacagcgcctgcttgcccctaaatgttcctttcttctgctaatcatgtcagttactatggatgggctgtggccataagttctccctcaagggctggtccttctgtcaccttgaagtgtcagcccctgaattatgccacttggatgctatgtcttgatacccaataaaggtctaccatcccctaagaaatcccttaccccaccctcaaacccccaaagtgcctaagagtgaagaygaagatgccatggagacggcgtcttcagtgaacacctccccaaagatgcccggggacacgggcctatatcatcccattgatcttagtccactcgtagatgtcctgttcgcacactatgtcagagttgatgaggaggtatctgtcacctacacagaaatgcttctgacaggcggcgcatttgaaacattccaggtgatacactttgtctttcacccgcattgtcatctcataggcacgaatccgcttgtcacaggatgcgcagagaccgtcttgcccaaaaagcctggggcaaaagaaaga

SEQ ID NO: 32687 - DNA, 601 bp, Human
tgtcatttttattaagcctgcagagctgttttttttttctacacacgacaaatactttgatataatctaggataataaaatagttgaacaactttttaagatttatatttgtatagaaacaatctgtggaactcctcccctcaaaatgaaggtgtctaaaaacagtgattcatcagcattgctttaaataattgtttggttaaaagttgtggtttccattctcaaccgaaatgcgtctccatgcagttttccttgggtccaaagcttaaggccttgggaagggggccaagaaaaaaagaayggccactctcctttctgtccttcccttgtgtggaggacagtgattgaaacaggggagttaaaaagccaggaagaaaagaaatcaattgcacatctctagttcgcaagcgtcaaagtcacaacaagtctgtacacaacaactctctatctgtagatatgaaattccatcatgatagcacagcgcctgcttgcccctaaatgttcctttcttctgctaatcatgtcagttactatggatgggctgtggccataagttctccctcaagggctggtccttctgtcaccttgaagtgtcagcccc

SEQ ID NO: 32688 - DNA, 601 bp, Human
tcactccatacaatgctgaagtgaaatgcatattgtacaataacaatttaattattctacattcctctgagctacatgatgacctgttacataattgccagtaatatagaaatgtgcctgcctcatacaaacccttgcaatacacagaagtttttatttgacctaagagtaaattgcttatttgcttctcctttagaaaagaaaaagcagagcatttccccgccatcccaaattataagtcgtaatcaaataaacaacactgtatttcagtctgtcatttttattaagcctgcagagctgttttttttttctacacacgacaaatactttgatataatctaggataataaaatagttgaacaactttttaagatttatatttgtatagaaacaatctgtggaactcctcccctcaaaatgaaggtgtctaaaaacagtgattcatcagcattgctttaaataattgtttggttaaaagttgtggtttccattctcaaccgaaatgcgtctccatgcagttttccttgggtccaaagcttaaggccttgggaagggggccaagaaaaaaagaatggccactctcctttctgtccttcccttg

SEQ ID NO: 32689 - DNA, 601 bp, Human
cctgacttggtcccagaccccaactatgtgcaagcatccacttatgtgcagagagcccacctgtactccctgcgctgtgctgcggaggagaagtgtctggccaggtaaggagctgaggcagaagtgtagagtgttgggatagtccccgggagtcacccagaacccagcctagctgtggctgccagctaggctgtctgcaagctgatgaccctggccaagtgccccagcctcccaggaccctgaccgtttcatcagtgagccttgcctgccccgagggagtcaggaggggaggggagcaagygggggcccagcatttctgtatactgtacctcactatacaaggaactccacttttactgtggcacttcatctttatatgagccctgaaggcatgggttaccccctcaggaaactgaggagcaatgaaaggaactcaaaccttttggatctgagctgtttaatgagaaggttccttttgggagcccaggcttccagtggtcatacggggacccaaggaagtcctattgggtggatgtacctgcaggatagagcccaggagtatggagccatgtccacagaggacagttgtggctttggctgg

SEQ ID NO: 32690 - DNA, 601 bp, Human
atgaccctggccaagtgccccagcctcccaggaccctgaccgtttcatcagtgagccttgcctgccccgagggagtcaggaggggaggggagcaagcgggggcccagcatttctgtatactgtacctcactatacaaggaactccacttttactgtggcacttcatctttatatgagccctgaaggcatgggttaccccctcaggaaactgaggagcaatgaaaggaactcaaaccttttggatctgagctgtttaatgagaaggttccttttgggagcccaggcttccagtggtcatacrgggacccaaggaagtcctattgggtggatgtacctgcaggatagagcccaggagtatggagccatgtccacagaggacagttgtggctttggctggtccaggctgcctctgcctagtcacagcaggggcagtgagcccgggggacaaagaagtttcagttatatgttgcactggaaagaggggaaggagaccagtttccatgcacctagaaggtgagcacagctggctcgccattattcatgggtgatcctgcctctcgcagtgtttgcttctaatttataagcagttcatattctgctg

SEQ ID NO: 32691 - DNA, 601 bp, Human
acagctggagagaacagccctcacctgtaccccagtgacagaaccaagacacgagtgggaaaagagccagaaggactggttcacaggccagggctgctggaggtcagaggagggagggatcagcaagggctgaggcctcagaggaggtgggcgtgggagttcagacctggagaatcctgcaaaactggagccctggggcaggagggccctctgagatcatttcaagtatgggccgcaggctggtgccagttcacatgctgcaggcagaacccagagaagaaaagggaccaattccaagtckcaccaccagtttgtggccaagctgggcctagaacctagacccttatggtttcccacggtgtgctgagccgaacagaagggcaggatttaaccgaacagagggaaggaggatgttttgtttcaacccagacatagacagattccaagcctcccccagacaaggctgagggcctttcatcctggcagacagtctgagccgcctgttgtccagacattctctcaaagagagcgctaatccctacgactggccaccgctcccctctggccttaggatcggaccttaatgagtgccagggaagag

SEQ ID NO: 32692 - DNA, 601 bp, Human
tgatcctcctgcctcgacctccaaaaagctctgtaattacaggcatgagccaaagtgcctggcccccgcaatagggctgtttttcagtggcccttcagagattgctatgtgctcctgcacctaggggctgaccccagctgagtcacctgcaggtatcagggacactgccatgcttggtaccgctttagaaagatgctgttggcagctggcggccacatggtggaggccagaaaggaggggacagccaggatttcacggggtcagaagacagaggaagaggcctgagcctccgccacagttsgaggagacagaggagaagatcttcagggacaaggagtggggctgcagaaccagtggccaagggctgggggtggggctgagggggcccatgctgggttctggtgtcactgtgccccaaccccccctcatctcccccgccgtccctgcagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagtgagtggggaggg

SEQ ID NO: 32693 - DNA, 601 bp, Human
tctgataagggggattagatgatgttttcttggtttaccagctgcctcttctttcccctctgtgtctctctagcagtgtgtctctgttctccctctctctgtcacctctctgtctgtctgtctgcctctttaccaccttctctggtgagcagttgaggtgcagcccccctgactagactccctttctccctgtttctcttcttcctcaggtgcacgtgaacccaaagtatattgttttggagtctgacttcaccaacaacgtggtgagatgcaacattcactacacaggtcgctacgtttmtgcaacaaactgcaaaattgtccagtaagagtttgcccaccacccttcctggctccgtccctttcctgcctggggagcaggcaaggccacctgagatacctaagatacctgcactttaggtcaccttgatggccgaacgcagctgcagcagggcccatcaaaaagagccttgtccgtgccaaccccaagctgagtgtttacggtggggctcaggccgtagggtgttgatctggggctgcatcctgtggctccctgagatgtcccaagtgaaaaccagcagaaggcagagtcatttgatgc

SEQ ID NO: 32694 - DNA, 601 bp, Human
gttcacagtggcacacagtgaacagcagctgtgatcattagtgtccttttcaagtggactggattaaacagtcacagattagaagtgattctggttcaaaggagccatcttcagtccctaggcccccattgtagaagaagtgcctaaaatctgggcttgggattttggcacatgctgctgggtagggtcctcagtctttctcctgattccccatgtgaagtagtttgcagagggaccccttgcttacaagctcacaaggaaaccccaccacactccagatcgaagcaacccttttccattaaaaaaaaaaaaaaaattagtcctagagctttcagctttagttcatcaactgggagaaaggtggtagagatcttaaggcccagagaggtatctttccctaaaagtgtgtacttattaatggatggcaggtatgagagattaagcctatgactatggtcagggtgtggtgtatggccagggtcaggattcagtctgtgacaagggttagggctcagtgtgtgacaagggttaggactcaatgtgtgaccaggatcaaggctcagtgtgtgaccaggatcagggttcagtgtatacctagggt

SEQ ID NO: 32695 - DNA, 601 bp, Human
gtgtgtgaccagggtcagggctcagtctgtgaccagagtcagggcccagtgtgtagccaggctcagggctcagtgtgtgaccaggatcagggctcagtgtgtgaccaggatcagggcttagtgtgtggccagggtcagggctcagtctgtgaccagagccaggctcatttagagacagccctctcacacttggttgctaccatcaacctaactgttcacagcatgctgccaccacatcatgaatattaaaaatgggaacagcagcctccagttcagtgcagagattaggttcctcatgagyagaatgagatcagaattccccagggcacacagcatgtttgaaaggacgaactcctgtcccatcactggcagtttggctctttagcaggcctgggtttccagcacattcctgctcctcagggcctgtcttagccattcaagacccagggtcacctaagtggtagaagccattctagggaaggaggaggaaggaagaagggggtatccaggaaacaaaggaggctgctgggggctcggggaggcagggaatccctcctgctgctgggaaagggggatgggaacagaaacagcatcccacgtg

SEQ ID NO: 32696 - DNA, 601 bp, Human
ggggtatccaggaaacaaaggaggctgctgggggctcggggaggcagggaatccctcctgctgctgggaaagggggatgggaacagaaacagcatcccacgtgccaggcgcctggagcagccaggagggctgtcggcagggcagatggagaagcagcctgcgcggccctcccagctccccgggggcctgtgggcagcagggggagccaaagcccttccttccaagagctctttacataagtgcttggaaaggccgggccttattagagtgtctcagtctctgtgaccctgaccgcaggcargcagctgggccagcgtgcacaggaagctggacagagcgttcccagaaaggccacgggactgacgcctgtgggtttccatcgtgtttctggaggaaaaaggaggcttaaaaaaaaaaaagtactgagttagaaaaaacaagaaagtatttccagacagtagcagctctgctaatggcctagaaaacaatctgggactagggcatggggaggggaatgtgctgagactgtgccctgggtgggtgggagtccatcaaacccctccttttggagctgggctgagggggtcggaactttctcttg

SEQ ID NO: 32697 - DNA, 601 bp, Human
cagcctgcgcggccctcccagctccccgggggcctgtgggcagcagggggagccaaagcccttccttccaagagctctttacataagtgcttggaaaggccgggccttattagagtgtctcagtctctgtgaccctgaccgcaggcaggcagctgggccagcgtgcacaggaagctggacagagcgttcccagaaaggccacgggactgacgcctgtgggtttccatcgtgtttctggaggaaaaaggaggcttaaaaaaaaaaaagtactgagttagaaaaaacaagaaagtatttccaracagtagcagctctgctaatggcctagaaaacaatctgggactagggcatggggaggggaatgtgctgagactgtgccctgggtgggtgggagtccatcaaacccctccttttggagctgggctgagggggtcggaactttctcttgagggaaatgtaggcccatgcctgccctgccacgagggatctgggctgtgggagggacgccctggctgaggaggccacgggggcctactttgcagcccctcattgacccactgtctttccttcctcagatcctgatctccgggagggacagatg

SEQ ID NO: 32698 - DNA, 601 bp, Human
gagggaaatgtaggcccatgcctgccctgccacgagggatctgggctgtgggagggacgccctggctgaggaggccacgggggcctactttgcagcccctcattgacccactgtctttccttcctcagatcctgatctccgggagggacagatggccaatctctccccttccaaagcaggccctgctccccgggcagcctcccgccgaggggcccagcccccaacccacaggcagggaggggcatccctccctgccggcctcagggagcgaacgtggatgaaaaccacagggattccggaygccagaccccattttatacttcacttttctctacagtgttgttttgttgttgttggtttttattttttatactttggccataccacagagctagattgcccaggtctgggctgaataaaacaaggtttttctactctgtggctctgcatgcggcctgctggctggctggccagccacagctagtttgggcctgggggatgtccttaggcatcatccttcccctcgccaaatgtggaaagggcagccaccacccggtcaggaccacagtgaccatgagggcgctgagcccatcgtggaagc

SEQ ID NO: 32699 - DNA, 601 bp, Human
gtgtgataaggacctgagacaatctgttttgtaaagatgcctgtcatgcagtatggacccccttctgtcccagtctgacgtggtttctgtttccttccccagaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagtaggcaacctactctctcrtcaccaccctgccagtccttttggagtctgttcttactgcttggcatctgggcatacattcttctctctcagaactacagaatttcaggatttagtgaggcttttaaaagagcttattgatcccctcctccaatgcaagaattaatatcagacaatccatgcagtcatccagcctggtctctgtgtcaaggcttccccagagcttgtccattgcatctctgggtaattctaatgacgaaaaagctggctcagctatagtgtgtatgtgttagaaagaaacaggatcctggcctaaatatg

SEQ ID NO: 32700 - DNA, 601 bp, Human
ttccccagagcttgtccattgcatctctgggtaattctaatgacgaaaaagctggctcagctatagtgtgtatgtgttagaaagaaacaggatcctggcctaaatatgaacaaaatttgtgacatttggcattgttcaacttatttgagctcttcagtttggtctttagatcaaaccctctctaaagctctctcagctgtgatgacccagagttttctcaagagctaatctgtgcatccctgccactctactgatagggagttatggtggacagacacagagaaccattcagtttcttttrctaatgcaagcctctcacatattcaaaggcagtttcatgccattgtcaacatattgatgccattccctagccttttcttccacccaagtcttctctttctcaagttattttttaatagaattaatgaatgcaaattgtgtgttcttttgaggaggattaaaaaatggtgcctcaagatcaaggccagttattcatgggcccaaaataatctgtccccactacttcatttatctcctttttaggtccttctttcctgtattacagctggggtctttatgaaaattaagaaatttaaacagt

SEQ ID NO: 32701 - DNA, 601 bp, Human
atccctgccactctactgatagggagttatggtggacagacacagagaaccattcagtttcttttactaatgcaagcctctcacatattcaaaggcagtttcatgccattgtcaacatattgatgccattccctagccttttcttccacccaagtcttctctttctcaagttattttttaatagaattaatgaatgcaaattgtgtgttcttttgaggaggattaaaaaatggtgcctcaagatcaaggccagttattcatgggcccaaaataatctgtccccactacttcatttatctcmtttttaggtccttctttcctgtattacagctggggtctttatgaaaattaagaaatttaaacagttttgtattgtgcttatttttatttgaccagtttgttacttaattattcaataacattcattttatatatatgtttatatatatacataataatatgtaaatatatttttatatattttatatataaatatatttatttatatacatgtatattattattgttattattttttagacaaagtctcactctgctgcccaggctggagtgcagtagtgcaatctcagctcactgcaac

SEQ ID NO: 32702 - DNA, 601 bp, Human
tctatgccatttatctttcatgtctaggggtagggagcataattagagactggtgactgatgacatcagtttgtgggtctgaaagctcccaaaaagcagacttgagcaactaaaagggggaaaaaaattaaaacccccagataaccttccccactcgttcaatgcatgttaaaacataaattaaaaatgataataatgttgtcttcatgattggcaggtatgtagggagagaagttttttgatcctttctccatttcctaaaggaaaataagaaactgttttatggaactcttatttatargccttaaaattactagaatacaaagcagctaaaagtccagcataggctaatcactgaaagaccaaagagagggcagacaaagggatattcctcctccagacagtttttggggccttgtttgtggtccttttgaatgggtctccttttgtggacctttagaaaatgcatgttaattcagttcaactcacatttataaagaaccctctgtgtgccaattgttgcattaaatgctgaaggagagagatacaaggagagaaattgtgcagatatatatagagaagtcactgtcagcaaggagct

SEQ ID NO: 32703 - DNA, 601 bp, Human
ggattacaggcgtgagccactgcacccagccttagtctgcgttttaaaccagtgcttcccaaactttaatgtgcctgtaatccacagagggatcttgttaaactttggattttaattcaggtctggagtggggcctaagattctggatttctgtcaagctcccaggtgcccatggcctgcactttgtgtaacaaggttctggaatactgtttttgagaacttgttaatggaccatcctctacataaacacctttggtcaatgttgactcatatcctccagcctactggacatgcaatcttycacatatgtcatttcagatgaccgctgcaaccactgcagtcttctggaagactatctcccctaccctaacacacacgtacacattttctcatttcacctaaatggttatctttaaaggcccaactcaattaccgtttcctggaagaaaacttctctgatctccacccctcccttttctcaagtttagatttacatcttaatctctgtgttttatagagttttataagtctgctgtagatagcacttaccacagtctgactggtatagaaatatacatatgtgtgtgtgtgtatatacata

SEQ ID NO: 32704 - DNA, 601 bp, Human
aaacaaaagtcagaaacaaataggggctggacaggactttgttctctcctccagttagcctatcccaagcacagggtttgcattcagaatctatctaaagatgaatttcataccgcgcaccatgcaggaaagagatgctagatgctcttcatgcccaagcaattcacacgctcactctctcacctcgccaaatatcacaatatttaccaccgattgatggaagaacctccacagtccctgagtctaactccctcaccttacggatgaggaagcaggtataccgactctcagtttccacctyttccttttacctctgcgtcccacctcagtgtcgacgcgcagtatctaaccagaactctctcttcactttcaggaaatttgccccgcgatgttctgtgtgcaaggagcctattatgccagccccgggccaggaggagactgtccgtattgtggctttggatcgagatttccatgttcactgctaccgatgcgaggtctggttgacagccctgccctgccagtctgtggcaggcgttgaaaggctcgttcgagctaggtttacatagatgtagcaattactaaatctcagaacggccttagt

SEQ ID NO: 32705 - DNA, 601 bp, Human
ttttacctctgcgtcccacctcagtgtcgacgcgcagtatctaaccagaactctctcttcactttcaggaaatttgccccgcgatgttctgtgtgcaaggagcctattatgccagccccgggccaggaggagactgtccgtattgtggctttggatcgagatttccatgttcactgctaccgatgcgaggtctggttgacagccctgccctgccagtctgtggcaggcgttgaaaggctcgttcgagctaggtttacatagatgtagcaattactaaatctcagaacggccttagtgcctrtactcataggacttgggttttagatttgacactagtattccgagcacatgctgttgaataagtcactgtacctctctcagtctgcttgctcaccggaagaaaggactcaagtccttaactcctccaaatatggctgtgagagtgaaatacaaaattgtatattaaaggacattgtaaattgtgaaatactaaattagtgagaaatggtgttattgaacatttaactttggctctgaggctttggttagaacttcttgttcagagtcatggagatttatttatttgttagcatgcactact

SEQ ID NO: 32706 - DNA, 601 bp, Human
aagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattcyttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacct

SEQ ID NO: 32707 - DNA, 601 bp, Human
cataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggagrctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttt

SEQ ID NO: 32708 - DNA, 601 bp, Human
acttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggascaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataa

SEQ ID NO: 32709 - DNA, 601 bp, Human
attccccctttcccctctttgactctgaataatgaaggtctgttcctgaacctctgacacgaactccctgccttgccttggacaagctccttcccttctctggcctgagcctccacatgcgccctcgaagccggcctgcctgcctgttctaggaggcccctctccactccccacctacttggtatggacgcctagttgtggaggtggggggtcctctaaaccagagtgaggacaagtggaagatgtctggccaacagccagcacatagatgaggccagtgtgtctacagcccatcttggcsaagcctcaaattgcctgctgtctctgtggggcccctgcaacggggccttctgcaggatgagcgcctccaagaattggactccttcagcccggagggacagctgggggcagggcacttggaagggtccttctctgtgtctgggaaccttccctgtcccgctgggcctccttcctgcctcctcccttcctcagcctcctgctctcccatcctcttactctctccagctttctccctccccttatccattttctctgctctccctccactacctccttccaagatccccttccttgttgaagc

SEQ ID NO: 32710 - DNA, 601 bp, Human
gccttggacaagctccttcccttctctggcctgagcctccacatgcgccctcgaagccggcctgcctgcctgttctaggaggcccctctccactccccacctacttggtatggacgcctagttgtggaggtggggggtcctctaaaccagagtgaggacaagtggaagatgtctggccaacagccagcacatagatgaggccagtgtgtctacagcccatcttggccaagcctcaaattgcctgctgtctctgtggggcccctgcaacggggccttctgcaggatgagcgcctccaagaaytggactccttcagcccggagggacagctgggggcagggcacttggaagggtccttctctgtgtctgggaaccttccctgtcccgctgggcctccttcctgcctcctcccttcctcagcctcctgctctcccatcctcttactctctccagctttctccctccccttatccattttctctgctctccctccactacctccttccaagatccccttccttgttgaagccattctcagctccagcagcaagaggagagggctaactgcacacaaccggggccagcgtgggcaactgggagggt

SEQ ID NO: 32711 - DNA, 601 bp, Human
tcccttctctggcctgagcctccacatgcgccctcgaagccggcctgcctgcctgttctaggaggcccctctccactccccacctacttggtatggacgcctagttgtggaggtggggggtcctctaaaccagagtgaggacaagtggaagatgtctggccaacagccagcacatagatgaggccagtgtgtctacagcccatcttggccaagcctcaaattgcctgctgtctctgtggggcccctgcaacggggccttctgcaggatgagcgcctccaagaattggactccttcagcccrgagggacagctgggggcagggcacttggaagggtccttctctgtgtctgggaaccttccctgtcccgctgggcctccttcctgcctcctcccttcctcagcctcctgctctcccatcctcttactctctccagctttctccctccccttatccattttctctgctctccctccactacctccttccaagatccccttccttgttgaagccattctcagctccagcagcaagaggagagggctaactgcacacaaccggggccagcgtgggcaactgggagggttaagctctgggctgtaa

SEQ ID NO: 32712 - DNA, 601 bp, Human
acacccttggctctcctagtggcctcctccccacccacccctgagagccccgggagcctggctccctagcccacaggcacatttttgcccagcattggggcgtcacattcctgttcatggttctaaattgaatttcctggggatttggaaccttcagacctaaaataaaaccaacttgtcccagactaactggccagctcaggccctctttagttttcagcttggtggcctgggagtgtgaccattggattcgcatcaaccatgtgtgcatcaaaggagtccaccctctctgactttcttrgggttcaggtccaggtgccacccctagtcttcatttctttctctttctccttcccctgacaggggcattccaaactccagaaagtactccccagtaggcatttgccgagtgccccctggggatgcagagatgaatatggacaccactccaagggagtgagttgggagggctgtagtctggttgagaagccgggatttcactagcaaattgtaattaacaagagggaacactggagctaaattcttagcaactgggtcagagaaagctgtctagaggaagaggtgaagtttgagcttggtc

SEQ ID NO: 32713 - DNA, 601 bp, Human
ttcctgttcatggttctaaattgaatttcctggggatttggaaccttcagacctaaaataaaaccaacttgtcccagactaactggccagctcaggccctctttagttttcagcttggtggcctgggagtgtgaccattggattcgcatcaaccatgtgtgcatcaaaggagtccaccctctctgactttcttggggttcaggtccaggtgccacccctagtcttcatttctttctctttctccttcccctgacaggggcattccaaactccagaaagtactccccagtaggcatttgccragtgccccctggggatgcagagatgaatatggacaccactccaagggagtgagttgggagggctgtagtctggttgagaagccgggatttcactagcaaattgtaattaacaagagggaacactggagctaaattcttagcaactgggtcagagaaagctgtctagaggaagaggtgaagtttgagcttggtccaggatgagttgggtttggagagtgggaggggtaggatcttctggtcaacaggaataatataagcatgggtggactggtcagaagatccggcaatggcccagaccat

SEQ ID NO: 32714 - DNA, 601 bp, Human
ttagaaaaaggaacccccttggtcagatggagcaggtgcgcagttgggtgagcagatggcacctactaggagggcaaggacttcagccacatccgctcacccccttggcaggcaccttctgcagtacatgaattgcacatccacacggggggcctccttcacctttgctggccacccccttgcctcctgcccaccccacacttccaccctccagaagtttctcccctgagatgttctcccctctgtggctggacagcggtgtctcttggttacagaatggcaaagtgggctcttggcgccwctgccccatctgttccaagcaggagctgcttctcagtccacacctaggggtctgggccacccgggcagtgtctcctctgcagaccaggtcttcctgcagctgcttcttccttttccttctgcttccctgtctctggatatctggcacagctccctcttctgccctccgtgctggtttgctgggtcccctctgtggcccctcctggctccagaggttctctgtccctctgtgtgtctccaggtcaggattattggacttggttttctttccttcctcatttttcctccacggtctgatgcc

SEQ ID NO: 32715 - DNA, 601 bp, Human
tccagaggttctctgtccctctgtgtgtctccaggtcaggattattggacttggttttctttccttcctcatttttcctccacggtctgatgcctggtaggctttctgtgggatgggcctcctcgggccttggtctgcactctgtaatttcctgttcccaccagatccaaggtcaccagccctgtaggtgactgtcaggagaggctgcccagagagcagagacactttgggtaaggcaggtggagatgtgaactccaggctccttaaaccctcttccttgccttcctccctctctaacacygcggggaggagggggagcagggcagggagcagaagtcctggctctctctaccataggactcacagtgtcacctctgtgagccctggtgacctcagcaggaagcctgggaaatgaccacaaggcctgtcatgccctgctatcattctaggcttcccagcctcaacaccaccccgcagcatgtggcttccttgctctctgtgtagcggctcactcgggggtcttgattcctgctgctcttctcaaaactccccctctgtactgctgattggtcaagactcagtgtgagtactgcctgcccca

SEQ ID NO: 32716 - DNA, 601 bp, Human
gagggagggagggagggaaggagggaaggaaggaaggggaaaggtcagaagccaaactactcattaaaaaaaaaagagagagagaaaggagggaggaaggaaagaagagaggaagggaaggagggaagagtagtagggctgtgggtgaaaggctcgtgaacaaccccctgatgagcattttctttcctccttgaaaccctgtggcatgagattaggactgcaaagtaacccaaccctttccatgcaaagtaacccaactctgataatttgccaggctggtaactggtgaatgtagggcttrgatcttctgcttctcactcaggtctttctgtctcattacaccctgtgggagagtcaggtcccccagttcagggcccagggccatagcaaggtgcctctgggggccagggtccggagctaggcaggcccctggtttcctggaaattaggaccctgagcctcccttttcatggcaacttggtcttagccttcaagagccatatctgagctggtgtagaccgggctcagggctaggagaggcaccatctagcaccagcgtctccacttgcctgctcctccttgtccaaatcctctgatcgtcc

SEQ ID NO: 32717 - DNA, 601 bp, Human
gaacaaccccctgatgagcattttctttcctccttgaaaccctgtggcatgagattaggactgcaaagtaacccaaccctttccatgcaaagtaacccaactctgataatttgccaggctggtaactggtgaatgtagggcttggatcttctgcttctcactcaggtctttctgtctcattacaccctgtgggagagtcaggtcccccagttcagggcccagggccatagcaaggtgcctctgggggccagggtccggagctaggcaggcccctggtttcctggaaattaggaccctgagmctcccttttcatggcaacttggtcttagccttcaagagccatatctgagctggtgtagaccgggctcagggctaggagaggcaccatctagcaccagcgtctccacttgcctgctcctccttgtccaaatcctctgatcgtccaaaagctatttgatttcccaatgattaacccagctaagaggggagctctcaacaggcccaaagagcagatggagctgaaaggaacccacccctgcctccgtggagccatgggccccgggaagggttcccagcacataactctcctgccctgcacaaa

SEQ ID NO: 32718 - DNA, 601 bp, Human
tggagccatgggccccgggaagggttcccagcacataactctcctgccctgcacaaatcctaggagcgccagccctccctccccattgccccagctcctgtctccaggcaagccctgtggtttttccctgggcaggtgagagcatgcctgctgggcctgccgccctctgtgcttcccacatggggcctctggggcgtccattcccctggctgtgggggaccagaccccttggaacaagggtcatgagggtcactgagggtcatggccacagaaggctgtgctctgggcccagggaggcagmtgggccacaggatcttctcctcagcatgcttccaactcccatcccccaggcctgcatgcccaagcctccactgatccctctaattacctccctcctctcttctttgatctctcatctccctctctttgcctctctcccccacccccactctctccctctctgtgtcaacccctcactattctctgtgattgattccatttcaattcccaagactaccctgtgtctctctgtgtctctgtctctgcatgtgcctctttctggtctctctgtggggtgtgtactctttgggcttccctgctg

SEQ ID NO: 32719 - DNA, 601 bp, Human
ccccatcccttttccccctgagcctaggggccctagtcctgcaggctggggagctgtgggtttgaaggtggctccatttctgcctcctgccgcccctgcacagagccactgtaattacatgtggctgcggttcacctcttccccagtgctccggccggctccttgtcctcctcctgactgtagcccctccctgctcctcacccccaggttcctctgactcctctatcatcatcctctctgacccagtttctcccgtctccctccgcgctctgtatcacacagtgctaccttctctgtcgcytctgcccctgccccatctctatctttctctccattactgacttccgtgctattgctgcgtctcactcccgtctcaggctgtctgtcactgggtcactgtggatcccttttccgtgcccaatctctcgcagtccgatgctctatctccctttacctctacctctcactgtccctttgattctccctgtcactctcgatgcctgtccctatctctccgttgctgaccgtccgtctgttctcccgtgttgtgtttctgcctcctctccctacttctctttatattctgccatctctgcccctc

SEQ ID NO: 32720 - DNA, 601 bp, Human
ccgtctccctccgcgctctgtatcacacagtgctaccttctctgtcgcctctgcccctgccccatctctatctttctctccattactgacttccgtgctattgctgcgtctcactcccgtctcaggctgtctgtcactgggtcactgtggatcccttttccgtgcccaatctctcgcagtccgatgctctatctccctttacctctacctctcactgtccctttgattctccctgtcactctcgatgcctgtccctatctctccgttgctgaccgtccgtctgttctcccgtgttgtgttkctgcctcctctccctacttctctttatattctgccatctctgcccctcccgacaccacatgcacacgtgcacacactcaaatgcatgcacacccttgctcactcccagattgtggtttgggagctttctattttggagcccggtgctgttgtcagctagagtaagggctgcataactgatgcagacagacaaagaatgagggttcggtgggcatgctgggctgtggggcggggcccacggctgggcaaacaggaaggccccaggaaaatggacctcagtcatctgcttttttcctagccc

SEQ ID NO: 32721 - DNA, 601 bp, Human
acctctcactgtccctttgattctccctgtcactctcgatgcctgtccctatctctccgttgctgaccgtccgtctgttctcccgtgttgtgtttctgcctcctctccctacttctctttatattctgccatctctgcccctcccgacaccacatgcacacgtgcacacactcaaatgcatgcacacccttgctcactcccagattgtggtttgggagctttctattttggagcccggtgctgttgtcagctagagtaagggctgcataactgatgcagacagacaaagaatgagggttcrgtgggcatgctgggctgtggggcggggcccacggctgggcaaacaggaaggccccaggaaaatggacctcagtcatctgcttttttcctagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgtgagtcctagggggccaggaggttg

SEQ ID NO: 32722 - DNA, 601 bp, Human
tctttccctgagtgggctcacttgctctcctaatcagcctgcaatgaggcagcaggatggctactgcgaagcccattttagagatgaggaaacaggcacagagaacggcccaccctggtcccaagctgggaaactcaggtctcccggcccaacactctttgcagtgcctgcctgcatgcccagctggcatggctgagctggaagcctcctccagccagggcatctggggctaagctggactccctggaagtcaggcttactaatcccactagtgcacggccctcggtctcctccagcacayccactagcagaattgagagaaagaggtcagcgccttggcagtggaggagggggtctggtgggaatgggacagacactcctgtgtctgtgagccctgagtgtttgctctgtgactcagcccccacggccatggccacagacaagctctgtgtctgtccacgtcgcccagatccttcagctcaccacacactcccgccctctggtcagtgtgcccatgtttcggcagaagggcaaggggcaccgaagctggccaaggacttggcccagtcaccctgtgtggggccaagaggtgggggcctga

SEQ ID NO: 32723 - DNA, 601 bp, Human
ggctcacttgctctcctaatcagcctgcaatgaggcagcaggatggctactgcgaagcccattttagagatgaggaaacaggcacagagaacggcccaccctggtcccaagctgggaaactcaggtctcccggcccaacactctttgcagtgcctgcctgcatgcccagctggcatggctgagctggaagcctcctccagccagggcatctggggctaagctggactccctggaagtcaggcttactaatcccactagtgcacggccctcggtctcctccagcacacccactagcagaatygagagaaagaggtcagcgccttggcagtggaggagggggtctggtgggaatgggacagacactcctgtgtctgtgagccctgagtgtttgctctgtgactcagcccccacggccatggccacagacaagctctgtgtctgtccacgtcgcccagatccttcagctcaccacacactcccgccctctggtcagtgtgcccatgtttcggcagaagggcaaggggcaccgaagctggccaaggacttggcccagtcaccctgtgtggggccaagaggtgggggcctgatgattcaggcctgg

SEQ ID NO: 32724 - DNA, 601 bp, Human
cagcttattcctcagtcgcttgtctcccagcctctgcccccatgctggcctctgccctctgagccccagctcctaatctctaacacttgctagctgtgtgaccttgggcaacttactgtacctctctgacacttgctagctatgtgaccttgggcaacttactgtacctctacctctccgggactcagtttcctcatcagtaaaagaagactagcaatactgaggggatgcgtgagcagcaagtacttagaagggctggcgtgcaggaagcaggcagtgtgcaatgttgtgactgctgccrtcactggaagacccggcctcttcagccaagggaggcaccgaggccaccctcccctctccttgggctccagggcccccaagacatctcctacacaattcacatacacagaccaggcctggagggagatggggatccagatcccagctcctgagggactgaagtgccccccacatttacagagggtccttgaggccacagggtcctgcccaggagtcaggacccctgcacagctgaggggccccagagctctcagtgacccctcttcagtccctccgcactccccccaccatacacacctcc

SEQ ID NO: 32725 - DNA, 601 bp, Human
gaagtgccccccacatttacagagggtccttgaggccacagggtcctgcccaggagtcaggacccctgcacagctgaggggccccagagctctcagtgacccctcttcagtccctccgcactccccccaccatacacacctcccctcatctcttgagagcagaactgagccagctggttctcacccagaactgaacatccctgagcgaggagcaggaaggaattcggggtttggggggtctccagggtcaccttgcctgtactccattgataaagctgaagtctggtccctcagcctgcartggggacccgggggtcctggcttcaggggtctccccactgcccttcttcttgccttcttccctccctcctctcccagacccctctgccagctgcccatagaggcaggatggggttgagggtgcggagggcagaggcttgagtggaggcaccaggtggaaggagcaggaggtagaggggctgcagtgaggagcccctggattccagagccaggcgttcatctccaaacagatgtttccaataaatcacccagtgcgccaagggcaataacagctgggggcttggcagaggccgaggtgaag

SEQ ID NO: 32726 - DNA, 601 bp, Human
cactgccaccactctgccaaaaccccaggatgacaagagcaggagaatggactttgtgtgaggaacaaaggagaggtccagggctccgagcccctgcccttatacatctgtcatttctggactgagcactgaactgagagtcaggagctaggcccaactcaatttcatggcgtggctctggactagtcatttcttctctctgggcctcagtttccccatctgcaggatacaggtctggctgggtgctttggggtatatgtaagaatgcagcaggcaggattcgagcatagctctgggggcygaatgacccccacccttttcccatcacactttctcttcatctctccaggccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaaggtaagcacccatcccatctctccctgg

SEQ ID NO: 32727 - DNA, 601 bp, Human
tgcagggaacctgacgcatgaccaaatcttagaaccttgcaaagtacacccgttgggtaaaggtgtacctgccttctcaaggccacctccccaccccaccccaaacccctccccatcccttctttcccagagttgctgtgacaaggaacggagccacctgggttgatccatcttaagccactctgtttctggaaacagaaattttctgttaagggaggaaaaaagaacatgtagcagaataaaatggtgccagggcagggctgcaaggtgcagtaggaggtcagaggatccagacacccarccagccgatgtgcctacaacacaaagatcctctgcagggccacaggggcagccagtcccctcctcatcagccatcaattgaacatggccaacagctgcctgagctcagtgatggcctgacctttacctcagaatgttccagtgattcctgtccatgtgaagggaccctggcctgggcatctgcaaaacacacttgcacataacatgctcagaaaccttcccactctgcaaagcagattctgcccaacagtctttttccttttttttttttttttttgagatggagtcttgctctgtcgcc

SEQ ID NO: 32728 - DNA, 601 bp, Human
agaaccttgcaaagtacacccgttgggtaaaggtgtacctgccttctcaaggccacctccccaccccaccccaaacccctccccatcccttctttcccagagttgctgtgacaaggaacggagccacctgggttgatccatcttaagccactctgtttctggaaacagaaattttctgttaagggaggaaaaaagaacatgtagcagaataaaatggtgccagggcagggctgcaaggtgcagtaggaggtcagaggatccagacacccagccagccgatgtgcctacaacacaaagatcytctgcagggccacaggggcagccagtcccctcctcatcagccatcaattgaacatggccaacagctgcctgagctcagtgatggcctgacctttacctcagaatgttccagtgattcctgtccatgtgaagggaccctggcctgggcatctgcaaaacacacttgcacataacatgctcagaaaccttcccactctgcaaagcagattctgcccaacagtctttttccttttttttttttttttttgagatggagtcttgctctgtcgcccaggctggagcgcagtggcgcaatcttggc

SEQ ID NO: 32729 - DNA, 601 bp, Human
ccttgtctaaatggtgaaaccctgtctctactaaaaatacaaaaaattagccaggcgtggcggtgggcgcctgtaatcccagctactccggaggcggaggttgcagtgagccaagatcgtgcccgagattgcactccagcctgggcaacaagagcaaaactttgtctcaaagaaaaataaaatgaaatgtcctaggcacctgctatgtgctggaaacctggttcatgacctcataaagctctcatgagagacgtagataggtaatcgccatacgatgtgataagtgcaatgataaactcaygcagaggattacgcaaacacagggggaccactcacaccagcccagaaatctggggagggaatcctgggaaggcttggaggtgatgtctgaacatgccttaaaagaccagaaggaggctccagccaggagagcatgcgcacagagctgagaaatggccagtgtggctggagggtgaactgccaaaggtgagactcctggcaggcaggggtcctgggaggtccttaccaaccaggcagtaagcctagactatctggagagcagtagggagccactgaagggttttaaacaaggtggtcacct

SEQ ID NO: 32730 - DNA, 601 bp, Human
acctgctatgtgctggaaacctggttcatgacctcataaagctctcatgagagacgtagataggtaatcgccatacgatgtgataagtgcaatgataaactcacgcagaggattacgcaaacacagggggaccactcacaccagcccagaaatctggggagggaatcctgggaaggcttggaggtgatgtctgaacatgccttaaaagaccagaaggaggctccagccaggagagcatgcgcacagagctgagaaatggccagtgtggctggagggtgaactgccaaaggtgagactcctrgcaggcaggggtcctgggaggtccttaccaaccaggcagtaagcctagactatctggagagcagtagggagccactgaagggttttaaacaaggtggtcacctcattagatttacatttgaagataactaccctatccagtttggagagagatcacaagaccctagttccctccacacaggaatgcaggagaacagggttagaccctccacagcacagtgaacctcccagggggccccctggccaggagagctgcacgctttgccccatggcctggccccagcacacggagggctgcagg

SEQ ID NO: 32731 - DNA, 601 bp, Human
ttggagagagatcacaagaccctagttccctccacacaggaatgcaggagaacagggttagaccctccacagcacagtgaacctcccagggggccccctggccaggagagctgcacgctttgccccatggcctggccccagcacacggagggctgcaggacgtgggttctagagccagcagcctggattcaagtcccagctccaccacctcccagctggtgcccagcgcagcttcatgcatttctattctattcactgagcacctctatgtgtctggcgctgttctagggacttgtaatcyttcattgaacaaaatgggcaaagatgcctgccctgctggagcttacatatccggtagaaggagatgacaatgaatatgaggaaaccgtgtagtacagtgggaggcgatgtcctctgagggaagaagaaggcagtcaggtagggccgggcagggagtgtgaggcagagccagccggttgcggtattgaagcgggtggtggaaggcctcggtgagaggtggcatttgggcaaagaaggagatgagggactcagccaagcacgtgcctgtggcaagattgttccaggcagaggaatcagcgcc

SEQ ID NO: 32732 - DNA, 601 bp, Human
gatgtcctctgagggaagaagaaggcagtcaggtagggccgggcagggagtgtgaggcagagccagccggttgcggtattgaagcgggtggtggaaggcctcggtgagaggtggcatttgggcaaagaaggagatgagggactcagccaagcacgtgcctgtggcaagattgttccaggcagaggaatcagcgcctgcatggccaaggagcagccaggaggctggcgtggccagagcagagtgatctggaggagaagagtgggagaagagaactaagagggcacagggaccacactacagrgggcctcagaggccacttcaaagatttcagcttttatcacaagcgacatgtgaaccatgggaggggtctgagcagaggagggccaggatccaacaggtatttctaaaggatccctctggctgcggtgtggagtggagatgccaggtggcagtggtcaaagggagaccagtaagcaggctgtcgaaggtgtccaggtgagagatgagccaggtggtaggattctgggtgtagacttaactactctccctctcttttttttttttttttttttttgagagagagtccagctcttgttgccca

SEQ ID NO: 32733 - DNA, 601 bp, Human
ctcttcatctgtagagtggggctagtaaaggcccctgcctcatagagtcattggaggcctaaatgaatgtaattcatgcacagcactcagaacagtgccaagaacatgtatcactccatatgttggttaaacaaataaacagagggtggctaagagcaaggatgatccagactgcccgctccgatgtgcttaactgtctgtgcctcggggtcatcacctagaaaatggagctgtggggacggattcgtgagcttcaggcacacagtgaacactcagcgtccctgctgctgccgctgccgcrggcccccacacccccggctatttcacacacgctcatccctcccctctctcacccgtccccctctccaccgccaccccgcagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggaga

SEQ ID NO: 32734 - DNA, 601 bp, Human
ccgcgggcccccacacccccggctatttcacacacgctcatccctcccctctctcacccgtccccctctccaccgccaccccgcagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctrgagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacat

SEQ ID NO: 32735 - DNA, 601 bp, Human
ctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggrccgcagggggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaa

SEQ ID NO: 32736 - DNA, 601 bp, Human
gggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggaccgcagrgggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaaggg

SEQ ID NO: 32737 - DNA, 601 bp, Human
gctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtatgtagtgatacctattatgctggttctttaataaagagggtgaaaaaattcattgctaacataagcagtttcttattttgctattcttttattgctttgatgagcaagaatcactgatacataattggcctcattttwaagtatttttttgaaaatcaattgtgggtgtagcattgtgtcatgcaaagtagaacagtactgagaacctgccatttatatgctttccttctcatgggaaagccatactttgacaggcagaaaatttagttagatatcagaagcaaggatttaaagtagagtgtgagccattcatgttagaaatatgggtgatagactacctgattggagttagagtatcttttacatctcctcctgcctgaattacttcattaattcagcaaaatttatgttacatttattgtattagtctatgaaatg

SEQ ID NO: 32738 - DNA, 601 bp, Human
ataatttttctagtcttttgaaaactcaacaagtagagacaagtaatttatatttctatctgttgtgtatataatcgtctctttagagttccagacagctgctagtgtccaaatatgtttttctaaagaaatattttgtttgtgagtaccaacagtcttagtaactctcttatccctcttatgtgctgagtacagtcggaggaagaggaattggagttggtgagtgtgggtttctgcttgaaggaagttgaaaaagatgtagaaagtactaattctcttacgtgttgttatctaaccaatrttccctttgttacacaaatttttttaaacactattcaaacactttgaataaagcaatctactggtactacagactctagtttttctatttataattgtatgtgttgacccattttatttgttggagggaacattggaatagagcctttaaaaacagtagctgtccatgagcataggatacttgttaattttttttttaaggaaagatacaaaataccttatatagctctccaaattattgaaatatttttagaaaatgacttcaccctcgaagttcctcagattgtaacacacgatgttg

SEQ ID NO: 32739 - DNA, 601 bp, Human
agtacagtcggaggaagaggaattggagttggtgagtgtgggtttctgcttgaaggaagttgaaaaagatgtagaaagtactaattctcttacgtgttgttatctaaccaatgttccctttgttacacaaatttttttaaacactattcaaacactttgaataaagcaatctactggtactacagactctagtttttctatttataattgtatgtgttgacccattttatttgttggagggaacattggaatagagcctttaaaaacagtagctgtccatgagcataggatacttgttaattttttttttaaggaaagatacaaaataccttatatagctctccaaattattgaaatatttttagaaaatgacttcaccctcgaagttcctcagattgtaacacacgatgttgtgttgtttctctttcaaaaagattacatcatttttggtgaggtcacctttttcagcgttggaattatttcatcctgcatgatacagcctgaaccacaagggggttccctgtttactaaaaggaatgtctgtaattgaatgtgtatataagtttacttttctatcagaaggcgctcttttcttaaaagc

SEQ ID NO: 32740 - DNA, 601 bp, Human
tcaccctcgaagttcctcagattgtaacacacgatgttgtgttgtttctctttcaaaaagattacatcatttttggtgaggtcacctttttcagcgttggaattatttcatcctgcatgatacagcctgaaccacaagggggttccctgtttactaaaaggaatgtctgtaattgaatgtgtatataagtttacttttctatcagaaggcgctcttttcttaaaagcaactattgccctttttccaaaacaaacgttttctgttggcttttcctctagaaaataaacttgactaaaagcarcttgcagttgatctatttcttctttaggaactaaaaccaaaacctcacaggagtcatcatataatttcaaagtcagctgctaattaaaggactttaaggggaataaaaacttgaaaatgtttcttagcatggacaaaggttaagagtgcatgaaagcatgggggaggaaggcatccgttggttttaatattccatgtttatgcatgctggtgtgttttgcacagtttgttttcttttcaaagaaggttatctgttccccttaaaatacgagattgttctttatttagctttgtgatcact

SEQ ID NO: 32741 - DNA, 601 bp, Human
cacctttttcagcgttggaattatttcatcctgcatgatacagcctgaaccacaagggggttccctgtttactaaaaggaatgtctgtaattgaatgtgtatataagtttacttttctatcagaaggcgctcttttcttaaaagcaactattgccctttttccaaaacaaacgttttctgttggcttttcctctagaaaataaacttgactaaaagcagcttgcagttgatctatttcttctttaggaactaaaaccaaaacctcacaggagtcatcatataatttcaaagtcagctgctmattaaaggactttaaggggaataaaaacttgaaaatgtttcttagcatggacaaaggttaagagtgcatgaaagcatgggggaggaaggcatccgttggttttaatattccatgtttatgcatgctggtgtgttttgcacagtttgttttcttttcaaagaaggttatctgttccccttaaaatacgagattgttctttatttagctttgtgatcactcacagttttgggtgtagttttgtattggccaactgaaatattctagtcagctgtaaatgttttgaattatattatgaatatc

SEQ ID NO: 32742 - DNA, 601 bp, Human
taagtccaaagtagatctctatctcgaaaagtcattaaatttataaacttgatgctgagactaaaatatattccgaactggcatacattgattttccacattcctcagagtacatctgtaattacagaacctcagagataaatatattaggtccttgaagactttaaaatacatacctaaaaacttataaacagccatttatattatttaaaacttaatcaattaaaaatgcagaactttatgtgccagaaccaaaatataatcagaagcacagtccgttacaacttagaaagttgttcarcttgccttgagctctaaagtataattgtggatgactctgatccgaagtgcagaaggacaggtgccctggggcctgcactaaagactgtactgttaagaccagcgacagattcctttagaagccgagcaatactagaacaacttgacttcatgaaagctgcagtagactaggctatggattagaaggaataaaaatatgtatcttttttcccaccagttatatagaaatttgggacagagggtttcttaggacaataaggatattatcttatatttgtgtagtacttcagttatgaaagca

SEQ ID NO: 32743 - DNA, 601 bp, Human
gaaccaaaatataatcagaagcacagtccgttacaacttagaaagttgttcagcttgccttgagctctaaagtataattgtggatgactctgatccgaagtgcagaaggacaggtgccctggggcctgcactaaagactgtactgttaagaccagcgacagattcctttagaagccgagcaatactagaacaacttgacttcatgaaagctgcagtagactaggctatggattagaaggaataaaaatatgtatcttttttcccaccagttatatagaaatttgggacagagggtttcttrggacaataaggatattatcttatatttgtgtagtacttcagttatgaaagcacttctgacatagtaacctcatttgattctcacagtagctgtgcaaggcagccaggacaaagattgctatatcttctttatttgacaatgaagaagttcagagaggtcaaattattttcccaatgcctaggaaatggtgaatctgggacagaaactcaggcaatacatccacatccacatgatctttctcacatcttctaacctaggttagaaagtagaaattaaaaagaaataaactgagatcaggat

SEQ ID NO: 32744 - DNA, 601 bp, Human
tttgtctgatgtacccttttgaaaattgtgatagagaaaatggaatcacattctaactcttcataatctcaaaggcactgaattatactttactgatttggctcagacccccgaatgtcagttatcaggctgtaacataatttataaaaaacaaatagagttgtgctgtggctttcttatgtgctagtgacacagagtctgttgtgttcctctgatctttgattttcaaaaaccgttaccttaagccagtttggcgagaaactgcttctgtcgtactcctacacgttaaggacaatgactrtcttagactaactggattatttaatagttgaattttttttatccattcccagcatggataggatgctacacagatgcatccagttggcaaaaagcatttaatattgctcttccactgccctgtcggcagtacttgattcaaaattctctactcaaagcctctgctacagaaggccaggggactatgaagggatacatgtccgaatctgttgttaaaaaataggtcaactgcatgattggagagaaagaaataagaatacaagctgcacccaataagccatgacttcaaaccgtgttaaca

SEQ ID NO: 32745 - DNA, 601 bp, Human
gcttctgtcgtactcctacacgttaaggacaatgactgtcttagactaactggattatttaatagttgaattttttttatccattcccagcatggataggatgctacacagatgcatccagttggcaaaaagcatttaatattgctcttccactgccctgtcggcagtacttgattcaaaattctctactcaaagcctctgctacagaaggccaggggactatgaagggatacatgtccgaatctgttgttaaaaaataggtcaactgcatgattggagagaaagaaataagaatacaagytgcacccaataagccatgacttcaaaccgtgttaacacgtaaataataccgcaaagaaaagtagttttgattcctatactcatagacgtacaatccctatatatacagatgacctttgccatcatcaggtatttaaaacctacacatacttcatttaggggagtctgacagtatttgtagtggcatcaagtcctcattttgtgcaacaaatagaagtgctaatgcctgtaacagaagttcctattttaacgtggggtgtctgacactaatcaactattttaaaagaattaatgtaaaaat

SEQ ID NO: 32746 - DNA, 601 bp, Human
gtacttgattcaaaattctctactcaaagcctctgctacagaaggccaggggactatgaagggatacatgtccgaatctgttgttaaaaaataggtcaactgcatgattggagagaaagaaataagaatacaagctgcacccaataagccatgacttcaaaccgtgttaacacgtaaataataccgcaaagaaaagtagttttgattcctatactcatagacgtacaatccctatatatacagatgacctttgccatcatcaggtatttaaaacctacacatacttcatttaggggagtcygacagtatttgtagtggcatcaagtcctcattttgtgcaacaaatagaagtgctaatgcctgtaacagaagttcctattttaacgtggggtgtctgacactaatcaactattttaaaagaattaatgtaaaaataggacccttcaaattaaatatttagttattctcactagtatttttgaagttttcacatcatcagtgcttcagaaaatgacattcatatgaaactgtgaaaaatgtcacttaaattgaaagtgatttttaagtcaacataaataccacatcagaacacattttctct

SEQ ID NO: 32747 - DNA, 601 bp, Human
tgcatgattggagagaaagaaataagaatacaagctgcacccaataagccatgacttcaaaccgtgttaacacgtaaataataccgcaaagaaaagtagttttgattcctatactcatagacgtacaatccctatatatacagatgacctttgccatcatcaggtatttaaaacctacacatacttcatttaggggagtctgacagtatttgtagtggcatcaagtcctcattttgtgcaacaaatagaagtgctaatgcctgtaacagaagttcctattttaacgtggggtgtctgacaytaatcaactattttaaaagaattaatgtaaaaataggacccttcaaattaaatatttagttattctcactagtatttttgaagttttcacatcatcagtgcttcagaaaatgacattcatatgaaactgtgaaaaatgtcacttaaattgaaagtgatttttaagtcaacataaataccacatcagaacacattttctcttttttgatctcacagaacacccaaaggatcagtagttctcaagccactcaacctcttgctaccccagtcgtgtctgtgacaaccccaagcttgcctccgc

SEQ ID NO: 32748 - DNA, 601 bp, Human
atagacgtacaatccctatatatacagatgacctttgccatcatcaggtatttaaaacctacacatacttcatttaggggagtctgacagtatttgtagtggcatcaagtcctcattttgtgcaacaaatagaagtgctaatgcctgtaacagaagttcctattttaacgtggggtgtctgacactaatcaactattttaaaagaattaatgtaaaaataggacccttcaaattaaatatttagttattctcactagtatttttgaagttttcacatcatcagtgcttcagaaaatgacaktcatatgaaactgtgaaaaatgtcacttaaattgaaagtgatttttaagtcaacataaataccacatcagaacacattttctcttttttgatctcacagaacacccaaaggatcagtagttctcaagccactcaacctcttgctaccccagtcgtgtctgtgacaaccccaagcttgcctccgcaaggacttgtgtactcagcaatgccgactgcctacaacactggtgagcctgctctggtgccttccgtaggttttaccgctctctgttttgtgatcaacgtgtgcttctgtgatttt

SEQ ID NO: 32749 - DNA, 601 bp, Human
catcaagtcctcattttgtgcaacaaatagaagtgctaatgcctgtaacagaagttcctattttaacgtggggtgtctgacactaatcaactattttaaaagaattaatgtaaaaataggacccttcaaattaaatatttagttattctcactagtatttttgaagttttcacatcatcagtgcttcagaaaatgacattcatatgaaactgtgaaaaatgtcacttaaattgaaagtgatttttaagtcaacataaataccacatcagaacacattttctcttttttgatctcacagaayacccaaaggatcagtagttctcaagccactcaacctcttgctaccccagtcgtgtctgtgacaaccccaagcttgcctccgcaaggacttgtgtactcagcaatgccgactgcctacaacactggtgagcctgctctggtgccttccgtaggttttaccgctctctgttttgtgatcaacgtgtgcttctgtgattttttttaagtatatttattgaaataaactatttccagttttttagatttaaattaggatgtatttttcaatgtgctagccttgaaaaaattacaaacaaaatgg

SEQ ID NO: 32750 - DNA, 601 bp, Human
ttgtctttatgctgtgttaacctgctttgggaaagacatgaatccctttggacctgagacttcaggaggtggccgacgtttggctgtgtcgaacaggctgttttcctccctgtaaccactagcttggtccatgtcatgtgcacctgaggggcaaaacaagggctgttctgatttctcctcggagccagtcactctgcctttgaggggagcttttccttcatttatgtttatttaggcatttcatcttaaaatgccctaatttggggttgtattaggaaagtttaagaatattacagtgatygtaggagtgcttttagccaagcagactgtatggagaatcgagggcagctggtttcatttaaatttaccaatctaagaaggagtggaaaacacatgtggtttcgctttctcatcagctgagccaaacacctgatgcttcagaggaagacggcagtagttcaattctcccttgcccattactcagagactgcaatgcagagaagttattatgattctcctgagtgtcataagtagactgtggtaaagatggtctgattttagccttcagggtaaatgctttggcacagaactttgaaactgc

SEQ ID NO: 32751 - DNA, 601 bp, Human
ctttctcatcagctgagccaaacacctgatgcttcagaggaagacggcagtagttcaattctcccttgcccattactcagagactgcaatgcagagaagttattatgattctcctgagtgtcataagtagactgtggtaaagatggtctgattttagccttcagggtaaatgctttggcacagaactttgaaactgctgtccgcagctacgtgaggggacagagcgttgataacatttgattgccacttgaattctaagaagttcttttaaaacagaatcaacaataaaaggttttattgaaaaaaaaaaagcctcttaggaaatatccattacttttccaaccgttagtgtgaaaaataatgcccaaatttgtcagctgcatactatcttagggattgtgaatcatagcctgttattagtgccttgcacagaacaaggttccagagtaaagccagggatgaagcattcatagaaattctgtttcgacgcattgatcacctgctctgtgagagactgtactagggacatagctttctccaagtttattccaagtgaggaggcaggacatacctaagtgggtaaccgtggaggggaagtcct

SEQ ID NO: 32752 - DNA, 601 bp, Human
tagttcaattctcccttgcccattactcagagactgcaatgcagagaagttattatgattctcctgagtgtcataagtagactgtggtaaagatggtctgattttagccttcagggtaaatgctttggcacagaactttgaaactgctgtccgcagctacgtgaggggacagagcgttgataacatttgattgccacttgaattctaagaagttcttttaaaacagaatcaacaataaaaggttttattgaaaaaaaaaaagcctcttaggaaatatccattacttttccaaccgttagtrtgaaaaataatgcccaaatttgtcagctgcatactatcttagggattgtgaatcatagcctgttattagtgccttgcacagaacaaggttccagagtaaagccagggatgaagcattcatagaaattctgtttcgacgcattgatcacctgctctgtgagagactgtactagggacatagctttctccaagtttattccaagtgaggaggcaggacatacctaagtgggtaaccgtggaggggaagtcctgaattgttgtgattgtgaatttatactctgagaattgagaagggagggca

SEQ ID NO: 32753 - DNA, 601 bp, Human
tcagagactgcaatgcagagaagttattatgattctcctgagtgtcataagtagactgtggtaaagatggtctgattttagccttcagggtaaatgctttggcacagaactttgaaactgctgtccgcagctacgtgaggggacagagcgttgataacatttgattgccacttgaattctaagaagttcttttaaaacagaatcaacaataaaaggttttattgaaaaaaaaaaagcctcttaggaaatatccattacttttccaaccgttagtgtgaaaaataatgcccaaatttgtcarctgcatactatcttagggattgtgaatcatagcctgttattagtgccttgcacagaacaaggttccagagtaaagccagggatgaagcattcatagaaattctgtttcgacgcattgatcacctgctctgtgagagactgtactagggacatagctttctccaagtttattccaagtgaggaggcaggacatacctaagtgggtaaccgtggaggggaagtcctgaattgttgtgattgtgaatttatactctgagaattgagaagggagggcaaagctatactgttcaaaggtgtattg

SEQ ID NO: 32754 - DNA, 601 bp, Human
tgtcataagtagactgtggtaaagatggtctgattttagccttcagggtaaatgctttggcacagaactttgaaactgctgtccgcagctacgtgaggggacagagcgttgataacatttgattgccacttgaattctaagaagttcttttaaaacagaatcaacaataaaaggttttattgaaaaaaaaaaagcctcttaggaaatatccattacttttccaaccgttagtgtgaaaaataatgcccaaatttgtcagctgcatactatcttagggattgtgaatcatagcctgttattwgtgccttgcacagaacaaggttccagagtaaagccagggatgaagcattcatagaaattctgtttcgacgcattgatcacctgctctgtgagagactgtactagggacatagctttctccaagtttattccaagtgaggaggcaggacatacctaagtgggtaaccgtggaggggaagtcctgaattgttgtgattgtgaatttatactctgagaattgagaagggagggcaaagctatactgttcaaaggtgtattggctgagaagagggagcttgaactgggtgtcagattatggttt

SEQ ID NO: 32755 - DNA, 601 bp, Human
ctttcttctctttctcgtaacacttactctgtttgaagtttaccatgttgtttttaacttatttccacatctattcagcaaatatttatcaggcagctgctgtgtggcaggcactgtgccaggcactggaaatgcaggagtgcagtcagcagtgaagcctggggggaaggcacaagacacacagctctagggataagctgctgcagttgtgtcaagggctgtgtctcagctcggacaggaaggaacatgcgtgactcagccaggcagaggaggcagagtgctcttgggagagggtgtgccygtacaaaggctaggagtttgcgggcgggacggggctgaaggaatggggacagagcgtgggtggttagaattgagactagagaggtaagtaatgatttgtagactatgtcaaggattttggaaactgtccggagagcattggggagccataaaaaacttttgaagtagaggagtgccatgaccatatttgttattttaaaaagatgtctttgctgtatatagggttaaaaggcaatgccaggaagccacatcagaggctactgtagtggtccaagcaatgggtgctgatagcatagactag

SEQ ID NO: 32756 - DNA, 601 bp, Human
gagagcagatagaattgctcagacctggaaattgatgttgggagtgagagggaagggaagtagcaaggataacacccatgggcttctgcacgagctgctgggtgcatgttggtgccatgtactaagagtacttaaggaggaacaggtttgcaggaaaggatgggccatgtcagatgtgtggcgtttggagtggcgtccaaatggacatggcactaggtcgtttaaaagatctagaggtcgaaggagactgtgggccggagggagcactggggaaggcgtcagtgtgacgggtccttgcccsagcccatgggagtgtatagaatgacaagggcagagtcaggacagccctgagcaccagctgtgtcgcttcaactccgttccttttttaaaatgttaattcactaggaagaccaatttctttaaacacctctcttgagacatgagaaagaagataaaagtagaagagttttgccacctctctttggaaccaagtgagaaagacaagtgttaatgatgagctgaaataactccccgtgtgagtgataactaacgtcctaaatcttggtcccagtgattacgactgaagcattcatatgatatg

SEQ ID NO: 32757 - DNA, 601 bp, Human
tgggattactggcatgagccagcatggctggcctcaatgtaggaacttttgcagtagctacgtaaaaaatagattccgtatggaccttccatcatatgcagagccctcttgtcttcctttgtagattattcactgaccagcgctgacctgtcagcccttcaaggcttcaactcgccaggaatgctgtcgctgggacaggtgtcggcctggcagcagcaccacctaggacaagcagccctcagctctcttgtgtgagtaactagaagttttccctgcatctttactcctggcctacacactstcttttcctatcagtgacagccttttgctctgttgagtttcgtgtgaggaatcctgtaatgattccttttcaggtagatacaagtgtcgggagaaaatattttcttacatggctctagacagtagcttggatactgacaaactaggcattccttgaagggatttggggagcaaggcttctcccatagggacatcctgaggtagagagactcaaccaggatctgaaggggtctgaaggcacagataccacccgcatgcaccatccttctgccctctgaccagtgatgaagctgcctactgc

SEQ ID NO: 32758 - DNA, 601 bp, Human
cttttccatcaggcagtgtctctactgtatcatcccagttttgcagaggtacttgcaagccatctgacctctctcttttttttccttcagtgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatgggkcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatat

SEQ ID NO: 32759 - DNA, 601 bp, Human
ttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttg

SEQ ID NO: 32760 - DNA, 601 bp, Human
tgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaakagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatctt

SEQ ID NO: 32761 - DNA, 601 bp, Human
taaataaataggcagaaagggtcacatacggttctggttcaacacacaaacaactctagatgtgcagatatttttaagttgcacgcataggttactctggagaacagaggcaatcctgtatttcctattcaaaccccacgattttttttaaaggacctggctagtttggaaaagggaacgggcccgcgtttaaagcgagtgtaaataaacaaacacgtggtctgcggaggaacacctttaggcaccagcaggatgactgaaaatagccaggtttggggaagagtggctgccaccgcgagamaacccccaccacatctggagctccagattccgtcgggattccaagcctcaacacgccctcaccgcagggaacctcggaatcagaacgctgagcccgccaggacccctcccctgcccactcggcccgctcttcccgaggttccagttaactctgggcttccgcctgggaacctgcagaaacaggagacgaatgcgattcctaaattaccccactgctggactcttcgaagccccacaatcgcgacccaaggctgtcttcttttcgggaagaaagggcaggatccgtgaaaagaaaacaaca

SEQ ID NO: 32762 - DNA, 601 bp, Human
accaagatgattaaactcctattttcctttcccgtgctcttatgggaaattaatgtatgctaaataaataggcagaaagggtcacatacggttctggttcaacacacaaacaactctagatgtgcagatatttttaagttgcacgcataggttactctggagaacagaggcaatcctgtatttcctattcaaaccccacgattttttttaaaggacctggctagtttggaaaagggaacgggcccgcgtttaaagcgagtgtaaataaacaaacacgtggtctgcggaggaacacctttargcaccagcaggatgactgaaaatagccaggtttggggaagagtggctgccaccgcgagacaacccccaccacatctggagctccagattccgtcgggattccaagcctcaacacgccctcaccgcagggaacctcggaatcagaacgctgagcccgccaggacccctcccctgcccactcggcccgctcttcccgaggttccagttaactctgggcttccgcctgggaacctgcagaaacaggagacgaatgcgattcctaaattaccccactgctggactcttcgaagccccacaatcg

SEQ ID NO: 32763 - DNA, 601 bp, Human
agtgtacatcctgtttcctagtttcaccaagatgattaaactcctattttcctttcccgtgctcttatgggaaattaatgtatgctaaataaataggcagaaagggtcacatacggttctggttcaacacacaaacaactctagatgtgcagatatttttaagttgcacgcataggttactctggagaacagaggcaatcctgtatttcctattcaaaccccacgattttttttaaaggacctggctagtttggaaaagggaacgggcccgcgtttaaagcgagtgtaaataaacaaacasgtggtctgcggaggaacacctttaggcaccagcaggatgactgaaaatagccaggtttggggaagagtggctgccaccgcgagacaacccccaccacatctggagctccagattccgtcgggattccaagcctcaacacgccctcaccgcagggaacctcggaatcagaacgctgagcccgccaggacccctcccctgcccactcggcccgctcttcccgaggttccagttaactctgggcttccgcctgggaacctgcagaaacaggagacgaatgcgattcctaaattaccccactgc

SEQ ID NO: 32764 - DNA, 601 bp, Human
tcgattccaaattctagaaattctaaaaacaaaattacatcataaaacacattttttaaaagcctgcacgtatttaaccaacatgatttacgctgcacaaggtacagacgtcttaattagactggcaaatttagaagtctcattttcatctaagcacccactatacttttttttaatgaactgagcatagaaaataatatatctccagtgtacatcctgtttcctagtttcaccaagatgattaaactcctattttcctttcccgtgctcttatgggaaattaatgtatgctaaataaatrggcagaaagggtcacatacggttctggttcaacacacaaacaactctagatgtgcagatatttttaagttgcacgcataggttactctggagaacagaggcaatcctgtatttcctattcaaaccccacgattttttttaaaggacctggctagtttggaaaagggaacgggcccgcgtttaaagcgagtgtaaataaacaaacacgtggtctgcggaggaacacctttaggcaccagcaggatgactgaaaatagccaggtttggggaagagtggctgccaccgcgagacaacccccac

SEQ ID NO: 32765 - DNA, 601 bp, Human
gagaactgctgacttgcccaaggtcacacagctagtagggtccaaggacttgaaactagggtaaaagactccaagtctaaagtctttcccacataactttttttttttacgatctcggctcactgcaacctccgcctctcgggttcaaatgatactcctgcctcagcctcctgagtagctgggattacaggcatgcgccaccacgcctggctaattttgtatttttagtagagacggggtttcaccatgttggtcaggctggtctccaaatcctgacctcagatgatcccgctagcctcgrcctcccaaagtgcacataacttttacagtccttttatttattcccattccattcaaattcatttccagcttatttaatactagaggaatttactctaaaaatcttaaacagaactgcattgactaataagaatttgtcaggaaaattcaagaatatttatcacttcaataatttaagatgaagcctaagaacataaacaatactatatcaatatatcaaattactgcaagactccaatctatagctgcatattagcttccagttaacaaacagataaatatttaaaacattccaaatacc

SEQ ID NO: 32766 - DNA, 601 bp, Human
ctcatctcaaccctcacagataaagagtcaggcattattatctctgacaaatgagaaggctaaacccagagaaattaactgctttatcacataactagtgacagaaacaggactaaaacccatgatgaaaactcaggctattttcaataaaccacaatgaatttttaaaaaatctctgtatatatctccaaaattcaaatctttacaaacaaaagatatttccacaaacgatttctcttcaaaaacttcaaaaatgatatgcacacagttctcactgatatatccaagaaggtaggtcagaatacttttcaaatcataatactacatgtttctgtagcaatttatgaagtattttctcatgaattctctcatttaagcctcaaaattaatctgaaaaaggtataattattccaattataccaatggcaaaattgaggcaaggctcagagaactgctgacttgcccaaggtcacacagctagtagggtccaaggacttgaaactagggtaaaagactccaagtctaaagtctttcccacataactttttttttttacgatctcggctcactgcaacctccgcctctcgggttcaaatgatac

SEQ ID NO: 32767 - DNA, 601 bp, Human
agttggccaacacagaattgtttcaatttgaatttggtaatattcaaaggtactttaatgtgaagtagcaatgtaatagttattaatactcttacactaaatttaattgtatgaaatacttttatttttatgatctcatctcaaccctcacagataaagagtcaggcattattatctctgacaaatgagaaggctaaacccagagaaattaactgctttatcacataactagtgacagaaacaggactaaaacccatgatgaaaactcaggctattttcaataaaccacaatgaatttttwaaaaatctctgtatatatctccaaaattcaaatctttacaaacaaaagatatttccacaaacgatttctcttcaaaaacttcaaaaatgatatgcacacagttctcactgatatatccaagaaggtaggtcagaatacttttcaaatcataatactacatgtttctgtagcaatttatgaagtattttctcatgaattctctcatttaagcctcaaaattaatctgaaaaaggtataattattccaattataccaatggcaaaattgaggcaaggctcagagaactgctgacttgcccaa

SEQ ID NO: 32768 - DNA, 601 bp, Human
gtgcacaaatacaaaccacactcacttcattttcctgggcaagtcttaaaatttcatcgagtgttacaaacgtatcatttcctctgactgcatctttctccataaatccaagatgaatatctgttgcaactaatattttaaatgtgttttcatcatcactatattaagaaagaagaaacatttcaatatattaataattcattaaaggatattcaaacaaattgagacaaacttataaaataaataataacagttatagagtaaaatcattttttttagccttagagttcatctgaaaatstgaagtattcaacgttatcattaacattacagttttcctaaccactagttcaatacagaacaaatgtacataaatctttacaaggttctataactgcttcaaaaatttataaccttgttataaccagttttacaaactcatgtaacccaggcccaaaagtttgcttgttttcctcagataaataaacttgttatttatctgacttcgtactcttccaggaaaatcgaagttaatttaaaaagccttcctctaagtttatgagtcaattttatactaatatgcaataatttacattcaggg

SEQ ID NO: 32769 - DNA, 601 bp, Human
tagatgtgcaagggcctcagagtagaacatgccggtgtggatgtagcactgtaaatcaggcagagagtagtaggagatgaagtttcatggcaggggtcaagatcaagtcgaaccttgtagtttgaattttatactagattcaatggaaggacacttggaaaattttaggcaacagagtgccatgatctgatttattattttaaaagttcactttggctgctatgctgagtagatgtagcagaaaagaatagaagcagaaagatggaaggggacctcctgcaggccatgtgaaatgtgatcattttggactaagtttattagtgtgaaaagagtagtagagaggaaccatatatatttgggaggaagaactaaggacctagcagataaacttaagagaactctccagaaaagtcaaggctggcggtgttaatttgcaagtcaatttttacatttattctccaactctctcctgggctggcgtgttaactgcctgctgaaatttttccctgaatgtcccattgcagtctccaactctaagtttgtcgaaatcaaacaaagaatttgtcaccttcccacatgaagcagtacctcttccttatct

SEQ ID NO: 32770 - DNA, 601 bp, Human
ggtacttcacttcttgaatattctcccccaaaacctgtaatcccaatctaatcatagaaagcaggagaaaataccaaattgagggacgttctacaaaatacctgacctctttataagtatcagggtcatgaaagacaaggaaagacagaaaacctgacatgggctgaagaaattaaggaaacgtttctactaaatgcaatgtgagatcctgtacaatgtttaagacatgatgggccagaagcggtagcttgcgtctataatcccagcactttgggaggccaaggcaggtggattacctgargtctggagttcaagaccagcctggccaacatggcaaaaccctgtctctactaaaaatacaaaaaatttgccgggcgtggtgatgggcgcctgtaatcccagctactcacctgtaatcccaactactcgcctgtaatcccagctactcaggaggctaaggcagggagaattgcttgaacccaggaggcagaggttgcagtgagccaagctcatgccactgtactccagcctgggcaacagagcaagactccatcaaaaaaaaaaagaaaaaacacatgatgatatttttataatataggga

SEQ ID NO: 32771 - DNA, 601 bp, Human
cttttgtgaactgcccagtcttggcgggtatgtctttatcagcagcatgaaaacggactaatacagtggcacatgcatatagtcccagctacttgggaggctgaggcaggaagatggcttgaacccaggaggttgaggctgcagtgagctatgatcatgccactgcactacagcataggaaagagagccagaccctgtctcaaaagcaaaaattaaataaataaataaataaataaataaacatgagtatgtctattctcatgggttagtatgtacacatatttttcttagctctgtccastgagagcctagaagcaacaatacaatagtaatgtgcacatgtaacatccagatcttggtttccaaataccattctccaaaaggaaccagggttccttgaagaaatggctgagtctgaagacaagaaagacaaagtaaaaaatcagaagaaaaggtgggatatatcaaaaggatacaggagccaatctcaaaaggagcccaatggctaaagctggaacaatttaagccacaagtaaattatgatagtaataaattataacccaaaggaaaaaaaaatgggtttctactgatatagacaatt

SEQ ID NO: 32772 - DNA, 601 bp, Human
agtcttcttttttgggatttccctatctttgcctattttctacatgaactgtgaactggaagattaaattatccaaaatgaaacacaaagaggtaaagttatgggcaatattttttttaatagtatgctatataaatgatattcagaaagagaaaggaaacaatatttgaaaacataatgaatagaatgggaatttccccaagttgctgaaaaacaatattacattagaatatatgataaagcccacgcggaacaaacagaattaaatccacagctaaataagactgcaacatgttaagamcaatgagaaaatcttaagttacccaagtattgtctttatgctggtcactactctagccatttttcttatcatctcaatcttctcaactctgtaagattggcacatttctttcccatgttatgaaggacagaactaaggtagagtagttaagtgactaacataattttacaactactaaatgacagaaccaggatttgaactccagctgttttataccggaacccatgctcttaatcactatgctaaactttctagcaactcacctaacagtagactcctcaacagcaacaaaaaataaga

SEQ ID NO: 32773 - DNA, 601 bp, Human
ttatttattactaactcatgaattttattgtcttgaaagaactgcttattggggaattcaaccttaatttgcaattggttgcaaatattcttcctgattgaactgtgacttctggctttgcttcaggcagtttttggcatgcagaaatttatttttgcaaagacaaatgtatgaatcttttatgacttctgggtcttgtgtcatacttagaagccttccccacacctagatttttaaaatatgtgtaacagtttctcctagcagttttactgaatccattatttcccctacattgtgagayggtgaccttcatcaaatactcaattcctacatgtatttgaggctatttctagagtttctattctctttcacttacctatctactaattcatgagccataccacattttcaattattgtagcattgttatacttcaaatctaattggctactaactccttagtagtcttcttttttgggatttccctatctttgcctattttctacatgaactgtgaactggaagattaaattatccaaaatgaaacacaaagaggtaaagttatgggcaatattttttttaatagtatgctatataaatg

SEQ ID NO: 32774 - DNA, 601 bp, Human
ggatcaccacaatgtgtttgagcagttccctaccaatggacatttagattcttggcagtcttgttttacaaacaatgctacagtcagtaatcttgtacaaagtaatcttctacagcgagtaatcttgttgccctggtgagtcgacctgtaaaggaatacctggaagggaattgttaggtcaaagagtacatgtatttgtaattttgataggtgctgccaatttcccaccatagagatttacacataatgcaatggcagtgcacaagagggacagttttcccctacctcactaacacagtakgtcatccagctcttaaatctatgctagcagttcttaatgctagcagcatgttggaattatcttggggatctttcaagaaatgccaatgcccatgacatacttggagagactctaagttagttggcctggagagggggccatccatattttcaaaggttcttaggtaactgtactgtgcactcaggattgagagtcacagacctatgccaaccttataggagaaaaatatttcagtatagctctgtctttttcttatgagtgaaatcaaacttttaaaaataggtttaggccggatgcggt

SEQ ID NO: 32775 - DNA, 601 bp, Human
aggatcctatacctatccacacaaataaacagatttttctttctccttacataaatgatagaaaaatatacatttctgcatcctgcttttatcactcaacatattttagaaatcattccacatcagtacatgaagacctttcttctgctctgtcagccacacagtactccattgcatggatcaccacaatgtgtttgagcagttccctaccaatggacatttagattcttggcagtcttgttttacaaacaatgctacagtcagtaatcttgtacaaagtaatcttctacagcgagtaatyttgttgccctggtgagtcgacctgtaaaggaatacctggaagggaattgttaggtcaaagagtacatgtatttgtaattttgataggtgctgccaatttcccaccatagagatttacacataatgcaatggcagtgcacaagagggacagttttcccctacctcactaacacagtaggtcatccagctcttaaatctatgctagcagttcttaatgctagcagcatgttggaattatcttggggatctttcaagaaatgccaatgcccatgacatacttggagagactctaagttagttg

SEQ ID NO: 32776 - DNA, 601 bp, Human
atttgctacatttttgtactacaaatcacctacagcaactggaatcacatgccaaaggcaaggttaatatctcatcaaaacttatgatgtcttggccacaaaaaaataaaaattagccatgagataaatgctttgtaatattaagcaaccgtcttaaagcctggggaaaaaagaccatagataatcagtgattcataatattaatgaccagataaaatgaaaaaatacttgtaggatctctagtcttacttccatatcaaacaggtaataagataatctaatttagatttaaagatggtcwtgaacaatcatttcctaaaagtgagattttataagatagttataaaaacactgacaaactgtaaaccactatacagatgttaggtgttcactcctactcctggcttcttattgttaacatcagtattaatgaaataaaagcatagctcatacaccaattcttatttcagatttttaaaaaatctaaaaagcagtataaaagcttgtatgaatgtgaaaagtcaacttgacttttgactcaatttgactacacaatgagaaaaagggaaggcatgctttccacagacaaactaaactgatc

SEQ ID NO: 32777 - DNA, 601 bp, Human
attgtttaaagaatcacacatggacataaacagtaaaataaaactgtcttacctaaaccatatagcgcaatctttgtgcttcctttttgaagcaaaaccggactaatgtctatcttctccacagacattgaacgtccaaagtgatttacaaatccagcacaacttaaaatgtccaaggcacaaagtgcatctgcctatgcaaaataatttcaaagaatgttagtgtgtatgtaaaagtaggtatctgcatgaatatcgtatcacctgttaaaagcatactccatattctacttacaaaaayatagatgaggatagtgtcttctcaaaacaaaattacaatagtaaaagtatttgctacatttttgtactacaaatcacctacagcaactggaatcacatgccaaaggcaaggttaatatctcatcaaaacttatgatgtcttggccacaaaaaaataaaaattagccatgagataaatgctttgtaatattaagcaaccgtcttaaagcctggggaaaaaagaccatagataatcagtgattcataatattaatgaccagataaaatgaaaaaatacttgtaggatctctagtcttacttc

SEQ ID NO: 32778 - DNA, 601 bp, Human
ctgcattcaataaatgtgttcaataaatatagctggccctctgtattggcagattcgtggattcaaccaactaaagatcgaaatattcaggaaaaaaacaataaaaaataacaacgaaaaatataaatttttaaagcaatacagtataacaactatttaaacagtatttacattgtatcaggtattacaagtaatctagagatgatttaaagtacataggaggatatatgtaggttatatgcaaatgctataccattttattcaagggatttcagcatcccaggattttaggtcctggacygaacaccccccgtggataccaagggacaactgtaataaattatataatcaggccccaaatcctttgagttcttccctgacaacttctccggtgtgtccctcccatttctgtttcattgccatcactgtcaccacctcacatttttactgcagtgatcagataataaatcttgcttcttcaagtctgtcttcttttcaatcaatcctataccctgccaacagattaaatttcttaaaactactaacaaaagaaaggtaatctagctatatttgtatatcctggaagaacacttgcatatat

SEQ ID NO: 32779 - DNA, 601 bp, Human
aactactaaagaaaagcagaataattcccaaatacaacatgatgccattgtgccttcattgagtgctggttctttcccggaagaagaagggaggatgatgctggtaggctgactgtaatttgtgacctagaagtgatcacaatatccttgttgaaagattttgcatgaccaagtcatctccaaattcagattctttcttctttgaaacaagagaaaaaaacagttgatgtagagaaacaaatgggaaataaggcaaaatgcagaaggctcaagattctcacccaatctgtgaaaaccttctttgttttaaatatgaaagcagaagtatcttgagaatgcacagggtgacaaatgaatctaacagcattaccaaagaaccacataaccacagtgaagggggtggggagaaaatgagctaagtaagtttgaaaaattaggtttcaactagatacagaaaggctaaagactaaaataacttacacaaacattgtaacctagttgggaaagttgttttgcacaggggtatgagttagcaattttgaaattactttataatttcaaattataccaggattggaaatataattaaaccaagattgaa

SEQ ID NO: 32780 - DNA, 601 bp, Human
attacttaattgaaggtgaataattcttcaactaaagtagatctcattgactttatcaaaaagaattaccttctccaaacagaagctttgtatggcttgggttactttaggattatctgggttaaaaatgtctggatgattagctagaacaatatcctccatgaaaaactgccgcactgtgtgaagaggaattttatgcatattcatcttcctccctttaatacgcagcaaaccaacatgtctgaagtggagagaaatgaacaccgagtcacagtgtaaatttcctcagggtgatgtgcawacgaaagctttcatatttcttagtttctaaaaatgcttctttataaaatcatactcttaaaaataaatgtttctgctaatttaaccttaatgttatcatcacaggaaaagatggtagacattttccttccccagagtaaaatcaactcatccattattatccctgtctgatcagtcttgtaagatagacataataagcataaaaaaatgttaacaggactatgatggtagcatatgtagactatagtattacatctatatacctatgtatatgtacatacatgtacacatatagacaaaa

SEQ ID NO: 32781 - DNA, 601 bp, Human
gccacatgtgctagtgaatacatatcagacagcacagagaaaatctataagaatatgatctcctaggtcaattatttcaatccaacaagcatttatagagcatcattttgccaggtactaggtcaagtgctgagacagaaaagtaagatatgggtcctgtcctcaaagagttcagaagacactcacatgcttataaaaaataatataacttaactaagtacaataacagaaatgtacataaaatacagagataacagaaagttatgtgcacacctggtgtttaaaatgaacctctattactttgtgtcaccagcgtctactttcctctctggattcatgtcaccaaagcccacaggatttaggtgaagttcatacagtagacctcaaccagaggtgactttgcttctctaaggacatttggcaaggtctgtaaacatttttgatcatcacgaccagttagaaggggtactactggcatctagtgggtacaaaccagggagaatactgctaaacatcccagagtgcacagaactgcctcccacaacaaagaattattagtacaaaatgtcaactaagccaaagttgaaaaacccaggtctga

SEQ ID NO: 32782 - DNA, 601 bp, Human
accttttcaaatataccttcttgtaatgctcctttaatactattccttaatgttttcctttcatgaaagttcttcataatttttcaatctctaaaataattcttttagaataaaacttaaaatattactactcatgtttcaataaggctttcctcagcttaccaacttaaaaccaagtaagtctagtttttgcagtcatatgatccatgggagactcaccagaagatttagggatcaataagcaaggactttagattatttatcttggaagagttcaaggtaaaagaaaataagactgatrttttcaaatatgtggagttgtctcatactctgagaggataagattataacatcttagacttgaaagagttctgaagacaaaagcacttgttctatattgttcttaagggtaaaaccaagttacaaggagacagcactagattattttcataaatggctgtgtgcacagtgattagatatctccagatggccaacttcatagctgaacaattctagttcttagaaagttcttgtattggaacaaaaactgccttcctataacttggtcctgatctcaagaacaatacagaacaagtgtttt

SEQ ID NO: 32783 - DNA, 601 bp, Human
gcttattaccacaggaattttcctgaactacataatcatctttatttcctaggtcatttatgacaccttttcaaatataccttcttgtaatgctcctttaatactattccttaatgttttcctttcatgaaagttcttcataatttttcaatctctaaaataattcttttagaataaaacttaaaatattactactcatgtttcaataaggctttcctcagcttaccaacttaaaaccaagtaagtctagtttttgcagtcatatgatccatgggagactcaccagaagatttagggatcwataagcaaggactttagattatttatcttggaagagttcaaggtaaaagaaaataagactgatgttttcaaatatgtggagttgtctcatactctgagaggataagattataacatcttagacttgaaagagttctgaagacaaaagcacttgttctatattgttcttaagggtaaaaccaagttacaaggagacagcactagattattttcataaatggctgtgtgcacagtgattagatatctccagatggccaacttcatagctgaacaattctagttcttagaaagttcttgtatt

SEQ ID NO: 32784 - DNA, 601 bp, Human
actgagtttaacttggctgaatagcagcttattaccacaggaattttcctgaactacataatcatctttatttcctaggtcatttatgacaccttttcaaatataccttcttgtaatgctcctttaatactattccttaatgttttcctttcatgaaagttcttcataatttttcaatctctaaaataattcttttagaataaaacttaaaatattactactcatgtttcaataaggctttcctcagcttaccaacttaaaaccaagtaagtctagtttttgcagtcatatgatccatggsagactcaccagaagatttagggatcaataagcaaggactttagattatttatcttggaagagttcaaggtaaaagaaaataagactgatgttttcaaatatgtggagttgtctcatactctgagaggataagattataacatcttagacttgaaagagttctgaagacaaaagcacttgttctatattgttcttaagggtaaaaccaagttacaaggagacagcactagattattttcataaatggctgtgtgcacagtgattagatatctccagatggccaacttcatagctgaacaat

SEQ ID NO: 32785 - DNA, 601 bp, Human
aattaagttatttttagcagaaaagacatgcaaaactgtgttttacaaagatcattttggcattagtgtggagagagaaggaaactggaggcagagtcctggtaggaggctgcagcaataggccaggaagtattaataagggcttcactatgccagcgacagtgggataaagaaacgggaacagattacctactgtgcaacagacactatttaatccatttagatctcataaatctacgaagcatttggttggtgcacaagtaactgcagtttttgccattactttctacgacaaaacccrcaaatacttttgcaccaacctaatacaaaccaagggataagggatgcggttgctcaaggtcatacaactagtggttgggccagaatgaagctcaggaagtctggctctacactgtactctttacctccacagtctacatcccagtacttctcaaattttcatgaacatatacatttcttggagatttttgttaaaatacagtgggttctgatgcagggtctgaggctctgcatttttaacaatttcccaggcaacaacaacactgctggtttaaagactacactcctcagtaccaggcct

SEQ ID NO: 32786 - DNA, 601 bp, Human
tgctggggaataattaagttatttttagcagaaaagacatgcaaaactgtgttttacaaagatcattttggcattagtgtggagagagaaggaaactggaggcagagtcctggtaggaggctgcagcaataggccaggaagtattaataagggcttcactatgccagcgacagtgggataaagaaacgggaacagattacctactgtgcaacagacactatttaatccatttagatctcataaatctacgaagcatttggttggtgcacaagtaactgcagtttttgccattactttctaygacaaaacccgcaaatacttttgcaccaacctaatacaaaccaagggataagggatgcggttgctcaaggtcatacaactagtggttgggccagaatgaagctcaggaagtctggctctacactgtactctttacctccacagtctacatcccagtacttctcaaattttcatgaacatatacatttcttggagatttttgttaaaatacagtgggttctgatgcagggtctgaggctctgcatttttaacaatttcccaggcaacaacaacactgctggtttaaagactacactcctca

SEQ ID NO: 32787 - DNA, 601 bp, Human
aattttattggatgtcctcaatgttctaagtatgctgttcagggccagggatacaaccataaataaatacaatcttggctgtcaagaaattcacaaactgactgggaagaaaaacatgtaaacagatcactggaagcagactgtgagtggtgctataagaggtatgtacaaagttggatgaggacacaaaggaagaagcatgttctctgtgggcaggtcaagaaaggcttctttgaagacagaggctttaggtgggtgctgaagaaggtatagagaaaggaggagagaagtatgtcccacrcaacaggatcaacatggacaaaggttccagtgaaataaactccactgcacccaggggacggcagcttttttggtttagaccacatcatgtagacccctgaatgctaacctaaaaaagtttagactttttcctgttagtgctggggaataattaagttatttttagcagaaaagacatgcaaaactgtgttttacaaagatcattttggcattagtgtggagagagaaggaaactggaggcagagtcctggtaggaggctgcagcaataggccaggaagtattaataagggcttcactatg

SEQ ID NO: 32788 - DNA, 601 bp, Human
caccatgcccagccttacccagatcatctctacagctaccatgttataaaagacaaaatactaaatgctaaagctattaggtctctccttcaaacttctcatttataaatgtttggtcataacaaattttattggatgtcctcaatgttctaagtatgctgttcagggccagggatacaaccataaataaatacaatcttggctgtcaagaaattcacaaactgactgggaagaaaaacatgtaaacagatcactggaagcagactgtgagtggtgctataagaggtatgtacaaagttgratgaggacacaaaggaagaagcatgttctctgtgggcaggtcaagaaaggcttctttgaagacagaggctttaggtgggtgctgaagaaggtatagagaaaggaggagagaagtatgtcccacacaacaggatcaacatggacaaaggttccagtgaaataaactccactgcacccaggggacggcagcttttttggtttagaccacatcatgtagacccctgaatgctaacctaaaaaagtttagactttttcctgttagtgctggggaataattaagttatttttagcagaaaagaca

SEQ ID NO: 32789 - DNA, 601 bp, Human
tagtggtaaacagacctttacaaagacaaataccacctttctttctcagagatatgttcttctcaactagctgttcccaaagtacgctatggggaccagcactgcaccacctcacagcttatccagaatgctccctaactaaagtgctcccactttcactcatcatcactatctgctaaggttttttgttcatttatttgatatttgtgtatcatgtctctctttgcacctccacctcctgtaagctcgacgaattcaaaacctcatctgttttatcatccctatatcctgcagcatccayaatagcaggtactcagtaagatttagtcaatgaattaatgaatgtcttttagtcagtacaatgtagttttgtaatattacttatatgacaatatgtgctgttttatgaatgaattcgtaatttactgtgcttaggaaaagaaatgccaattttctattaaagtctggttagttttaatgctgtgaggcagacacagatgagaaaattgggatcttttgccataatgaagagaactatgtgattcccttaaagtaattatttttgtattacccagaccatctctctctctctctttttttt

SEQ ID NO: 32790 - DNA, 601 bp, Human
aggattcattttgtttaaactatcaactaaacatatcctaaattaaaatctgttactataaggtagccattattcaaaatgtgaactgtaagaaattaccttctctgcggtttgaaagtactgttttacaagatcttctacccttaaagttgttccttctgaaggctttgtgataagtttcccaaagttgatctcttctcctagaaaaaaagaagtatatcaaaaaatagcttctatcataatgttaaaatgtgcatactcattgcaagttgtcagtggagaaggtaaggccaaactttakcaactgccagcttgctcaacatggtaaattttgaggcaaaacaagccatttttgttaatagccacggtcttttccccacagtcagtatttctcgttcatacctccaggataggtgtcttgtagctgttctcactgggtgaagcacagacttctggaggtcctcaagacccattcagggagtaataacgtcaaaaatactttcataataatcctaagatgttatttgccattttgccatctgccatcattgctacactgacgatgcaaaagcaatcatgggtactgctggtgccttgtgac

SEQ ID NO: 32791 - DNA, 601 bp, Human
ctctgccaaactgcttttcagtaaagctattcaaacgtaatactactaccagcagtgtgctagatactatttttctcaaattgctgccaatttgacaaacaaaagatgtatttgagtttctttgattatcctaggctaaacaccattttcatatgcttattagctatttatatttcttttatgaaccacctattcatgtcctttgttcattattctatcaaatgtttaattatttttaagatttctaagagctcattaatattaagaatattaaacttttttctgcccacatacaaatatkttcatgtcaatatcttttaattttgttttttgacaatgtgatatgcaaacatttataatttctatgtagtcaagtctagacagcttttcctgtaatttttccactgcttcttgcttagcagaaattttctaaatgaaattcaagatctcaatcaaaacttactaaaaaaattaaaatgaacaaaaattaccatcctacaaggttcactttaaagccctttcaaaggatctttaagagaagatactatccatggggaacaaaacactttagtaccaaccatatgcaagactctgttctagg

SEQ ID NO: 32792 - DNA, 601 bp, Human
tagttaaaaacaaaaatatctccttgacaaggcttgaaatatttattacattgcaaatcactcttgtgcaccttgctgcaagacatccaggaggctctgtgaaatgggatctgaagtgggtggcccctgaagatccatttttattaagagtcaactcatgaaggtttgctgagcatggtcctggtatcaagaaggagactacaggtttcttttttaatggttcctgctcacaaggctcttattatacagctatgtatatgttctttaagcccatttatttaataatctactcagcacatayttactgagcaccttcaatgtgccatatattatcgtagaaactgagaatacagttattaacaaaacagacaaaaagctgctctcatggaatctataatcaattgatgatatgggagagggaacagcaaataagactccaatgtaagaggctggagcaattagaggaatcaacaaaagacactgaaaatatgcagccagtgaggcaggaagataacaagagtctggtatcctgaaatccaataaaaaacatgtttcaaagaaggtcaagtgagatgtaagatagaaaactgacagtggattt

SEQ ID NO: 32793 - DNA, 601 bp, Human
ccccaaatttaagtaaatggttgctaacttgtagattcaaacctgcaatgagactgagaagacagtgatgatggtgcttaagctaattttaatattttagaatagataatagaaattgtctatttgcccatgcttgcttacttatggttaacattgctaaccaaaacactttaagtttcttttttgcccaaaataatatcagctcagtaagataagattttatctataagatgctctgctaacaaagagatattattttgagtaataggggcttttgttgtatatatccccacacacatamaattaaatgggttttatttatttttatttatttattttagagacagggtctcactctgttgcccaggctagagtgtggtggtgcagccatagttcactgcagccttgaactcctgggctcacgcaatcccctccaaccttagcctctcaagtagccaagactacaggtgtgagtcactgcacttgctaaacaggttttagacaagaacaaaatggaaaaaaagagcaatgagcagaatatttgtaggctgaactgaaatcaaccaaaagcagccatcctaagccaaccccagctcactcc

SEQ ID NO: 32794 - DNA, 601 bp, Human
attttaaatgcaccttataagataaatagaaatataataaacgtgttaagccatttctaatctatagcttcttttccttagcttccaaaaaacaacctgtaaaagatacagtggttgcaactatgtgtatttcaacagtgattctgatgtgttgcatgacacttttagaagtttttcatttttagaaaaccatccatttgcaatgcaccgaattaatattataataatctaaaattttgataggacacaggatgatagaaaagtctacacttggagtcagaaatatgttcaaattctagcsccactccatgaccttgagtctggtctgtctcctcatttataaaatgggcacctaggaaaaataattcaataaatatcttccttacacaaatgtctcttatctactaaattgagaaaatcttgtggctacagacctcagcttttttatatgtacagtcctaatataaagcagaatatctaacccataacagggacaatataaaatgtttgctgaatgaaagcaatcaagacaaaactaacagtacatagtttataacttttaaatactagatagcaatcataaaacactaagggcaatcag

SEQ ID NO: 32795 - DNA, 601 bp, Human
tggtgttttaataacagccatcctaatgggtgtgaagtggtatctcactgtggttttgatttgcatttctctaatgtctggtgatcttgagtgtcttttcatgtgctataatttgtaaagcttctttggagaaatgtctattcaagtcctttgcccattgtaaaaattgggtttttttgttattgttactgttgagctttagaagttttaaaaatatattctgcttattaatcccttatcagatgtatgatttgcaaatattttctctcattctgtgggtcacttcttcactattgatagygcctggtattatattttgaaagagggtatcaacccacctcaaattgaggtagaacataagaaatcagaggccaggtaaactaacgactgtgggtaagactaagaatagtttttatatttttaaagggccattaataaaaaaacaaacaaacaaaaaaacacaagaatatgtgatagagaccacacatgtcccgcaaagcctaatggttactgtttgctcttttattcaaatatgaatttatcattaaagaaaagatttgagagtttttctatgtgaacaaaagatttttttttttttttt

SEQ ID NO: 32796 - DNA, 601 bp, Human
ttctccacattcttgccgaaacttgttattttatggtgttttaataacagccatcctaatgggtgtgaagtggtatctcactgtggttttgatttgcatttctctaatgtctggtgatcttgagtgtcttttcatgtgctataatttgtaaagcttctttggagaaatgtctattcaagtcctttgcccattgtaaaaattgggtttttttgttattgttactgttgagctttagaagttttaaaaatatattctgcttattaatcccttatcagatgtatgatttgcaaatattttctcycattctgtgggtcacttcttcactattgatagtgcctggtattatattttgaaagagggtatcaacccacctcaaattgaggtagaacataagaaatcagaggccaggtaaactaacgactgtgggtaagactaagaatagtttttatatttttaaagggccattaataaaaaaacaaacaaacaaaaaaacacaagaatatgtgatagagaccacacatgtcccgcaaagcctaatggttactgtttgctcttttattcaaatatgaatttatcattaaagaaaagatttgagagtttt

SEQ ID NO: 32797 - DNA, 601 bp, Human
ggagtttgagaccagcctgaccaccatggtgaaaccctgtctctactaaaaatacaaaaattagctgggcatggtagcgcgcgctagctactcgggaggctgaagcacgagaatcacctgaacccaggaggcagaggttgcagtgagctgagatcacaccactgcactccagcctgggtgacagagtgagactttgcctcaaaaaaaaaaaaaaaaaagagaaagaccaataccctactcgaaagagaaaatgtggccaaacaaaatgaccatgtgtttcatataaatacaaatgatttawaaacataaaaattaggcagactcattagtaaaaaaaagtagtatgaactgaaaacaacagtaggaaataatttcttaccccttagacttgtaaagatcaaaagatacagtaatacatcacgatggtaaagatgtgaggaaacaagcactcccaaatactaatggtgagaatataaactagttaagacatctttggactaatgtggcagtatgtagcaaaatttaaaataaatatgccctattatgattacttcttggaatcaattactaaccatcatttctaaactttgtattttccctt

SEQ ID NO: 32798 - DNA, 601 bp, Human
tcccagctgaggctgaacaatgagccactctgccttcttgtttccacttgtgtactttaaagtgtcctttctgtgatagtcatgcattgcttaatgatggatgcctcatgagaaatgtgtcatcaggtgatttcattattgtgcaaacatcatagtgtgtacttacacaaagctaaatggtacagtctactacaaacccagactataggagatagcctattgctccttggctacaaacctgtacaacatgttactgtactgaatactgcaggcaattataacaccatagctatgtatttgkgtatctaagcatatcttaatagaaaagatatagtaaaaatatggtattataatctcatgggaccaccactggatatgcagtctgacatcgatcaaaatgttgtatgtggcacatgactacatatttattgcattttctgcatttttgtacttttgctttggtaatgtggtgttttcaaatgaccccctcaacatgtttagtgttcattcctacatgcaaaaaggctgcaatatgacttttggagaaaaaatgtatattagataaacttaattcaagtataagttaaagtgctactggcta

SEQ ID NO: 32799 - DNA, 601 bp, Human
gaagttgcagtgagctgaaatcgcaccattgcactccagcctgggcaacagagcaaagacaagactccatctcaagaaaaattaaaaaacaaaaataaaaatttttaaggaaaaattttgtaaatgtaagaatagtgaaaataatcatcattaaaagatgaggatttctctccctggagattttaaaccaaattaatattcatttcaccagcttaaaattcctatggatgcatatttaataaaaacaattttaaaaaatctttagagatgaactgacataatgtgtgagaaagtcactgartgaccaatttctattggcgtgaactattcaatgacaatagtctcacagtaaatacaatgttgactatgttaatgactagttttaggaatcaaattggggggcagttttctttcttaaactgactttataaagactacttgataagcatatgtgtatttgtatcttatgacagtaacaaaaataataattgtatgatctggagttttcctcctgttgccaaaggcttttagctattttctttaacaactcatatttgcctattactttgcacatgtgaaaatacatatgacattaaatgta

SEQ ID NO: 32800 - DNA, 601 bp, Human
ccatccccattgggccaggagttcttaagctggaaaacacgaatgcgcctcatgggagtggctgaaccctttgaaattgggtgcaattgcatgtgagtacttatttaaggagagaagacatagctttcatcagatttttagagaatccataagccaaaatagattaaaaagcattgcctttgggactaaacagatcaaatctattcattccacattttacacgatagaacataatctacataaagatctgaatgtttcccaggttagatatcctaaatcctaagttccttcaaccaattgttttttttttttttttttggagacgctccgtcacccagttcagtggcatgatctcggctcactgcaacctccaccttctcggttcaagtattctcctgcctcagcctcccaagtagctgggactacaggtgcacgccgccctgcctggataattttttgtattttcagtaggggacagggtttcaccttgttgcccagactggtttcgatctcctgagctcaggcaatccgcccgcctcagcctcccaaagtggtaggattataggcatgagccactgcgcctggccaaccattttttata

SEQ ID NO: 32801 - DNA, 601 bp, Human
tttaagagtcatttaatcaacctgattttgtatcttttcttcaatgtcagctgtcatttgataaatgttgaaaattcctttaatggagtgatacttacttccaaggcaaattagtccatctttatattaattacataggttattctgcataatgcaaaaattattctatggagaactagtagctaggtctctaatcttaccttgctctggaaactagtacagtggtcaactactggttgtagagtgcagagaatgtgagatcattcccagatctggtactgacaagttatgagatctaggrtaagctacctatctttttaaagcctgtttccttttctgtaaaacagaaataatatagtaagtacctaccccacagacctgttaagaggcatgcagtttcataaatattagctattattgctactattagtggttttatcaactcagggcaaaactgcttggcttagttccctcacatataaaacaggggaacaaagttgttcttaaatcttccaggtccattctatcagatgagaaacttaaatcagtatgtttctagctattcccatccatccccattgggccaggagttcttaagctg

SEQ ID NO: 32802 - DNA, 601 bp, Human
ggtttaacatggaagtgttcattattttattcactctttttctatgttcctgttttctcatttttaaaagaacacttgataaatgcctactgtgccaggctttttgatcatttaatcttcagaataacccaatacaatagagattattatttccaatcatatctaaacaaactaggagagtgactgatttgtctcaagtcacaaagctgtcatttgttgaatgcaaggttgaactcagcatgaatcctttacaattttccaggctgccttttctctctttcttcctctctgcttttatatyaaacctaccaagaatggaacagcatctttccagataccactccctaaatggcaataaagacaacatgtttgtgaagcaaaaagctaaggatcttagctagctcttctgaagtactaaataatacttgagtaaaaatatagcaatggaattttttgtaaggtttaagagtcatttaatcaacctgattttgtatcttttcttcaatgtcagctgtcatttgataaatgttgaaaattcctttaatggagtgatacttacttccaaggcaaattagtccatctttatattaattacataggt

SEQ ID NO: 32803 - DNA, 601 bp, Human
agtcattgtcaagtatttaacaagcatctactatgttatgtgccaaatatagtggatacagtgatgaggaggaatgatgcagacccctttctcacagcacttacagtgcaagggtgctaagccagcagtaaagagctggctgtgactgacccaatggacctgactccagagcctgcattcttaaccatcatgctctgctgcaaaaggtaccataataagatttttgcttacaacataattcaggaaatctgacgtttcgtatttagtttatttacatagcctcttttcatagatgaatacygtttccttaaaaaaattagtcaagccattctgtaaaacttttaaggcatcataactggtctccagtctttctacacaaatagaagctttattctatgttgtcaatgggtaacagtcattgcaggctaggttattcagacaaaatgacctctcattgtcttcaaactcacttctgctgacaacaatccaaattagtacctcaaacatttaaaaaaaaaaaaaaattctcaatggcattgaagagctgatcacataccaaggaattaccaggccaaaactgaagaaaagctagaactcagag

SEQ ID NO: 32804 - DNA, 601 bp, Human
cttgactatggccaagctccttggcttctttaaaactcaatttcctcgcctgtaaaacagtgttaatacttcatgcagaaaactgctgagagggtaagaggaagtgtctagcagatagaaagcattcaaatacatgtagctgtttgggtagcaaacatagtagcagcagtggtacccatagtggtataaatgaaatgtaaaggccgtgacttcagaggtacttttattcacctagccactatcctctgctgactaacttcaatggaaaaatctgggctgtcaactcctatttacaactccygtggctacaagtgtaatttttatcttttccaataaaattgcagcacaataataaatttccatactccatggaccttgttataagagaatttgacctttatttatctcttcactcctccatttaaaacagagatctagaagttacagtcttaatttgttgcttctgtcccaaagtgatgacaagtatagttactacttcacaggtattctgtcagagacttaaaaaaaaacccaccaaatccaacctgataaaaatgtttcacaaatttatacttaaaaaatcagttcatttttcaaaaaa

SEQ ID NO: 32805 - DNA, 601 bp, Human
gaggagaattctagaaaacagcattctatgataaaaattcctttgtatccataccttttttccttttaaacttggttagatacttgaagtttagctagctctttatctttccctttctttttccttgacatcgaaacctacaataaggccaggcgcagtggctcacgcctgtaatcccagtgctttgggaggctgaggcgggcggatcacttgaggtccagagttcaagacaagcctggccaacatggtgaaaccccaactctactaaaaaatatataaaaattagccaggcatggtggcrggtgcctgtaatcccagctacttgggaggctgaggcaggagaatcgcttgaacccaggaggcagaggttgcagtgagccgagatcgtgccactgtgctccagcctgggcaacagagcgaaactccgtctcaaaaaacaaaacaaaacaaaacaaaacaaaacctacaataaatttcaaacgtctaatttaggtttattttctcctatgccttaccagtttgctaatatcaaaaatatcttccccaagataactcacaaactaaatagggcacagaaaaacaaacaaatactcaaaaaatc

SEQ ID NO: 32806 - DNA, 601 bp, Human
gaaggctgctgtcttgtagatttaaaggctagaatgaaaaagatgaaatgtgcattatgttattcttaaaataacttagaaaaacttgcatacttctttagctaaagattttctgagtcctatctgcaaaactgaatgatgcctaattataaaactatttgatatttttaaaaatctaaagggagatagaattataggtacgcataactcaatgcccaactgtcagtctcattatttcccagcttattgagatactgtagtgtttataaatacacacactaaaaatatttcatagaaaaayacctgaaggataaaatctaatcacctaaccaaatgaactacaaatgtattgaaggaaagcctcctaatcccttctttgttgttgacgatacctttatccctgttgctacattaggagccatggggttccagtagtttctcattttcctctaccttagtagccatattcaatatctaagaaatattccagaggagaattctagaaaacagcattctatgataaaaattcctttgtatccataccttttttccttttaaacttggttagatacttgaagtttagctagctctttatctttcc

SEQ ID NO: 32807 - DNA, 601 bp, Human
tgttccataatttttcttcttttatttactttgtaaatcagagagttgacaattcataatgcagaaaacataaattattaatacacaaccataaaactttttttcttacctctgaataattcttagtagtgacatttcgggaaggctgctgtcttgtagatttaaaggctagaatgaaaaagatgaaatgtgcattatgttattcttaaaataacttagaaaaacttgcatacttctttagctaaagattttctgagtcctatctgcaaaactgaatgatgcctaattataaaactatttsatatttttaaaaatctaaagggagatagaattataggtacgcataactcaatgcccaactgtcagtctcattatttcccagcttattgagatactgtagtgtttataaatacacacactaaaaatatttcatagaaaaatacctgaaggataaaatctaatcacctaaccaaatgaactacaaatgtattgaaggaaagcctcctaatcccttctttgttgttgacgatacctttatccctgttgctacattaggagccatggggttccagtagtttctcattttcctctaccttagtag

SEQ ID NO: 32808 - DNA, 601 bp, Human
catacatttgccatatcttcatctaacttaagtacagatgaggatgaagccaaagaccaaatactgaacgaacagcccctgaggctaaggatgctgttaaatatcctacaatgcataggacaacccttcacaacaaagaattatctagtccaaaatgtcaacagtgctactatggagaaaccctgatgtaaagggaagagtattggctcgggagttaagacacacagttttgaaagtgaagtaataagagaatcaagcccatattggactcttcttggaatcgaaaggaagagcagaaggmccaggctaaacctagggcaaaccacatggatcgctggactccagccttttcattcatcttaagtctagcaacagctgttaaggcacagctagtattttgggaagataagtaacaaaaggaaatccagcatagaaaaaacctctataaccattgaactcaccttcaatattagtattccatgtatgagctcttttggttcaacactgttatccttgaaaacattactgtatacataacatttatggatttctataataaccattatttaaaaaaagagagcaaccaagaaaaaaaaaatca

SEQ ID NO: 32809 - DNA, 601 bp, Human
aagctacggtttttggccctctcagactcaaccatacccaaaaaaatttcattctttaagtatttaatttctaacgttagggagaaattgacttacatctaagttacttaattcttctccttggataatcaagaaatggctgagataatggaaaaaaagcttgagaaacactgatataaggctttttcctcaatcacccttctttctggagttcctgctcatgcccttattctcagctgggaccaccattttccaccctactaagccaaatcttatctttgaaacctcaggtcaattttaytccctccatgaagctgcttcttctagcccacattccttgttccttttttcaccagcccataagcactcacacttatgggtctgtaatataaaattctacacctaattatgtactaattcattctttgatgaattcaaatatgttcatttctcttttccactataattgaagttacctgaaggcagaggccatattaaaacattcgttatgcccctccctcatcagacctaatataatgctcaaacagaaaataagtacaaaataaggcagttgattactttattaagtagaaattctcat

SEQ ID NO: 32810 - DNA, 601 bp, Human
ggtcagtatcataaagaacaaaaattggctccaggggatagagtgggatgaaaaagctacggtttttggccctctcagactcaaccatacccaaaaaaatttcattctttaagtatttaatttctaacgttagggagaaattgacttacatctaagttacttaattcttctccttggataatcaagaaatggctgagataatggaaaaaaagcttgagaaacactgatataaggctttttcctcaatcacccttctttctggagttcctgctcatgcccttattctcagctgggaccaccrttttccaccctactaagccaaatcttatctttgaaacctcaggtcaattttactccctccatgaagctgcttcttctagcccacattccttgttccttttttcaccagcccataagcactcacacttatgggtctgtaatataaaattctacacctaattatgtactaattcattctttgatgaattcaaatatgttcatttctcttttccactataattgaagttacctgaaggcagaggccatattaaaacattcgttatgcccctccctcatcagacctaatataatgctcaaacag

SEQ ID NO: 32811 - DNA, 601 bp, Human
acattgaaatattttctattcaaatctcagttaataagaaaatcataattcctactctttttactcttttttttttttttgagatggagtctcgctctgtcaccaggctggaatgcagtagcaccatctcggctcactgcaacctccacctcccagttcaagcgattctcctgcatcagccccctcagcatgccaccatgcccagctaatttttgtatttttagtagagacggggtttcaccaggttggccaggatggtctctatctcctctatctcttgacctcgtgatccgcccacctcggcctcccaaatgctaggattacaggcgtgagccaccacgcccagccgattcctactcttacaaagcttaacttgcagtaaattcctatgtcttttaattaataagaaatttaagtcactttagatcggggccagtaagcaaatctagcccaccaccaggttttgttttttttatggcctataagctaagaatggttttcacattttgaaatggttacattttaaatggttatacaagtgtctacctacataatatccccggttttgcctcttgacctgccgagcctaaaatactcccta

SEQ ID NO: 32812 - DNA, 601 bp, Human
ggaacattgaaatattttctattcaaatctcagttaataagaaaatcataattcctactctttttactcttttttttttttttgagatggagtctcgctctgtcaccaggctggaatgcagtagcaccatctcggctcactgcaacctccacctcccagttcaagcgattctcctgcatcagccccctcagcatgccaccatgcccagctaatttttgtatttttagtagagacggggtttcaccaggttggccaggatggtctctatctcctctatctcttgacctcgtgatccgcccacctcggcctcccaaatgctaggattacaggcgtgagccaccacgcccagccgattcctactcttacaaagcttaacttgcagtaaattcctatgtcttttaattaataagaaatttaagtcactttagatcggggccagtaagcaaatctagcccaccaccaggttttgttttttttatggcctataagctaagaatggttttcacattttgaaatggttacattttaaatggttatacaagtgtctacctacataatatccccggttttgcctcttgacctgccgagcctaaaatactcc

SEQ ID NO: 32813 - DNA, 601 bp, Human
gacactataaagcaactacataatcaagtctacaaaacaaccagctaacaatacgatggcaggatcgaaatctcatatatcaatactaactctgaatataaattgtctaaatgtcactacttaaaaggaatacagtggcaagttggataaaaggacaagacctgactgctgtcatcaagagacccatttcacatgtaatgacacacacaggctcaaagtaaagggatggagaaagatctaacatgcaaatgaaaaacaaaaaagggcaggagtcacaattcttttatcagatatagccgaytttaaaccaaccaacagtaaaaagggacaaagaaaggtattatataatgataaacggtttgattcaacaggaagacctaactatgccaaatatatacatgcccagattcataaatcaagttctgcttaacctaaaaaaagactcagacagcaacagagtaatagtgggaggcttcaacaccccactgacagtgttagaaagaacatccaggcagaaaactaacaaattcaggacttaaacttgacacttgaccaatcagacctaattgaaagctacaaaatacttcatccagtaactgca

SEQ ID NO: 32814 - DNA, 601 bp, Human
gattcaggagaaagttaaaacccaatccaatgaatccagtaaaacaattttacaaaggtaaaatagccattttaagaaagaaccatactgaacttctggaattgaaaatttcactacaaggatttcataatacaactgaaagtattaacaacataacagaccaaactgaggaaagaatctcagagcttcaaaaccagttcttcaaatctacttggtcagagaaaaataaaggaaaaagaatgaagaagaatggaaaaaaaaaacctctgagaaatatgagattatgtaaagaggcaaaacytatgactcattggcattcctgagagagaagagagaataagcaatatggaaaacatattcgaggatacagtccagaaaaatttctccaatcgtgctagaaaggttgacatgcaaattaagaaatacagagaattcctatcagacattatataagatgaccatccccaaggcacagtcatgagattcaccaaggtcaacatgaaagaaaagatcttaaaggcagctagacagaagggtcaggtcacttacaaagggaaccccatcaggctaccagcggacatctcggcagaaaccttacaag

SEQ ID NO: 32815 - DNA, 601 bp, Human
gaaaggggaagggcagtatccttcagtcatgtagttttatttaaacttaattgaaacagcaaattaataaaggcaagaggtaagtcctgacttataactcttcctcttcctcctcctcctcattcatggtggggagatttcatggttgcagacgcgatctggaactggagttttttccagacatcctcccagagaacatttcggacaatgcctgaatacctgtatgtcatgaaatcaccaccatgcgccaccctctacatgacacatgtagagcatatagtgagtacttaataaatattcrttaaagtaatattaaaagctcttgggatatcatcatcatcatcatcatttctccaaatataagtaaatggtagaagctaaaaaaaattccgatcccactgttaactgggcaaataagaactgagtgaatatcatattttaaaaatctacaggacttttatatctgaggtattacactgatgggcactcaacatatgttacttgttaactcttaacattaactatagttcaaaggaaggttatcaatgaaactattttttttttttgagatggagtttcgctcgtgttgcccaggctggag

SEQ ID NO: 32816 - DNA, 601 bp, Human
tttcaagcaaatcaacaaaaactagcaaaggcccttcaaatggcagccttgaaggaaaggggaagggcagtatccttcagtcatgtagttttatttaaacttaattgaaacagcaaattaataaaggcaagaggtaagtcctgacttataactcttcctcttcctcctcctcctcattcatggtggggagatttcatggttgcagacgcgatctggaactggagttttttccagacatcctcccagagaacatttcggacaatgcctgaatacctgtatgtcatgaaatcaccaccatgcrccaccctctacatgacacatgtagagcatatagtgagtacttaataaatattcattaaagtaatattaaaagctcttgggatatcatcatcatcatcatcatttctccaaatataagtaaatggtagaagctaaaaaaaattccgatcccactgttaactgggcaaataagaactgagtgaatatcatattttaaaaatctacaggacttttatatctgaggtattacactgatgggcactcaacatatgttacttgttaactcttaacattaactatagttcaaaggaaggttatcaat

SEQ ID NO: 32817 - DNA, 601 bp, Human
aatatggatctatttaacactactgaactgtacacttaataatggttagttttatgttatgcttttgctacaattaacaattttttaaataaaaaaataaatgaaaggggtcatgggcctaagagaaacactttcaagcaaatcaacaaaaactagcaaaggcccttcaaatggcagccttgaaggaaaggggaagggcagtatccttcagtcatgtagttttatttaaacttaattgaaacagcaaattaataaaggcaagaggtaagtcctgacttataactcttcctcttcctcctcytcctcattcatggtggggagatttcatggttgcagacgcgatctggaactggagttttttccagacatcctcccagagaacatttcggacaatgcctgaatacctgtatgtcatgaaatcaccaccatgcgccaccctctacatgacacatgtagagcatatagtgagtacttaataaatattcattaaagtaatattaaaagctcttgggatatcatcatcatcatcatcatttctccaaatataagtaaatggtagaagctaaaaaaaattccgatcccactgttaactgggcaaata

SEQ ID NO: 32818 - DNA, 601 bp, Human
ccagagacaaatccaaatgaagtctaatagataatttgctaatagtttgtctttgcagttaacatgaactagtatacaaatttttaactgtaacatataaccgcatatatatccagatgttttggaataaacaataattgctcacttccctcctggaagcaacatgttagtatttaataggtagaatgagctcttgctgccatttttcttggcagcctgagttgagtcctctcaagctgttttaaaccacagcttaaatacagggaacatggcagcagcagccaaagctaaaaatgaaagrtgtaagtcacaggctacaacgtagataaaccttcaggtacttacgctatgtgaaataagccagtcacaaaaaggcaaatactatatgattctacttctatgaagtacctagagtagttgaattcatagaaagagaaagtggaatggtagttaccaggggatgaagaaggggaaacagagacttgttatttcagggatatagattttcagttttgcaaaatgaaaaagtgctgaagatctgtttaatatggatctatttaacactactgaactgtacacttaataatggttagttttatgt

SEQ ID NO: 32819 - DNA, 601 bp, Human
aactattaggtacttctaatcatttagtcttataagaagcattggaaaaaaacatacatagtaacaaacagtgaatttagacataggttcgcataaattgttttactttcagaaaacccagaacctctaggaaattactaaaattatgaagaagttaaattttataagctctttccctcaactttggctaaatgtaaccatattaaaatactgacatagtttttcattatgaaatagaaatgtaaaatggtagctttattttaatctttactcaagagtgatattgaaacaaagctcttaytacaacaaccaggttaaaaaaacaaggtgaatcaatgctattgtatgtctgtgaactagaaatttcttacttatggagttatgctcaggaaacaatacttaaaatcttaaactgtaaactcttagcttgtaacattttcatttttcctgtatcttgcatgtttctcagtgccattaaatatattatcttctatttcttcttaaagaactagtgttcataaaaggatcatcatcatcatcctgaaatgagatacaaatgttgtattagtgattgttccctgcttcactgaaacaagacaga

SEQ ID NO: 32820 - DNA, 601 bp, Human; identical to SEQ ID NO: 32761

SEQ ID NO: 32821 - DNA, 601 bp, Human; identical to SEQ ID NO: 32762

SEQ ID NO: 32822 - DNA, 601 bp, Human; identical to SEQ ID NO: 32763

SEQ ID NO: 32823 - DNA, 601 bp, Human; identical to SEQ ID NO: 32764

SEQ ID NO: 32824 - DNA, 601 bp, Human; identical to SEQ ID NO: 32765

SEQ ID NO: 32825 - DNA, 601 bp, Human; identical to SEQ ID NO: 32766

SEQ ID NO: 32826 - DNA, 601 bp, Human; identical to SEQ ID NO: 32767

SEQ ID NO: 32827 - DNA, 601 bp, Human; identical to SEQ ID NO: 32768

SEQ ID NO: 32828 - DNA, 601 bp, Human; identical to SEQ ID NO: 32769

SEQ ID NO: 32829 - DNA, 601 bp, Human; identical to SEQ ID NO: 32770

SEQ ID NO: 32830 - DNA, 601 bp, Human; identical to SEQ ID NO: 32771

SEQ ID NO: 32831 - DNA, 601 bp, Human; identical to SEQ ID NO: 32772

SEQ ID NO: 32832 - DNA, 601 bp, Human; identical to SEQ ID NO: 32773

SEQ ID NO: 32833 - DNA, 601 bp, Human; identical to SEQ ID NO: 32774

SEQ ID NO: 32834 - DNA, 601 bp, Human; identical to SEQ ID NO: 32775

SEQ ID NO: 32835 - DNA, 601 bp, Human; identical to SEQ ID NO: 32776

SEQ ID NO: 32836 - DNA, 601 bp, Human; identical to SEQ ID NO: 32777

SEQ ID NO: 32837 - DNA, 601 bp, Human; identical to SEQ ID NO: 32778

SEQ ID NO: 32838 - DNA, 601 bp, Human; identical to SEQ ID NO: 32779

SEQ ID NO: 32839 - DNA, 601 bp, Human; identical to SEQ ID NO: 32780

SEQ ID NO: 32840 - DNA, 601 bp, Human; identical to SEQ ID NO: 32781

SEQ ID NO: 32841 - DNA, 601 bp, Human; identical to SEQ ID NO: 32782

SEQ ID NO: 32842 - DNA, 601 bp, Human; identical to SEQ ID NO: 32783

SEQ ID NO: 32843 - DNA, 601 bp, Human; identical to SEQ ID NO: 32784

SEQ ID NO: 32844 - DNA, 601 bp, Human; identical to SEQ ID NO: 32785

SEQ ID NO: 32845 - DNA, 601 bp, Human; identical to SEQ ID NO: 32786

SEQ ID NO: 32846 - DNA, 601 bp, Human; identical to SEQ ID NO: 32787

SEQ ID NO: 32847 - DNA, 601 bp, Human; identical to SEQ ID NO: 32788

SEQ ID NO: 32848 - DNA, 601 bp, Human; identical to SEQ ID NO: 32789

SEQ ID NO: 32849 - DNA, 601 bp, Human; identical to SEQ ID NO: 32790

SEQ ID NO: 32850 - DNA, 601 bp, Human; identical to SEQ ID NO: 32791

SEQ ID NO: 32851 - DNA, 601 bp, Human; identical to SEQ ID NO: 32792

SEQ ID NO: 32852 - DNA, 601 bp, Human; identical to SEQ ID NO: 32793

SEQ ID NO: 32853 - DNA, 601 bp, Human; identical to SEQ ID NO: 32794

SEQ ID NO: 32854 - DNA, 601 bp, Human; identical to SEQ ID NO: 32795

SEQ ID NO: 32855 - DNA, 601 bp, Human; identical to SEQ ID NO: 32796

SEQ ID NO: 32856 - DNA, 601 bp, Human; identical to SEQ ID NO: 32797

SEQ ID NO: 32857 - DNA, 601 bp, Human; identical to SEQ ID NO: 32798

SEQ ID NO: 32858 - DNA, 601 bp, Human; identical to SEQ ID NO: 32799

SEQ ID NO: 32859 - DNA, 601 bp, Human; identical to SEQ ID NO: 32800

SEQ ID NO: 32860 - DNA, 601 bp, Human; identical to SEQ ID NO: 32801

SEQ ID NO: 32861 - DNA, 601 bp, Human; identical to SEQ ID NO: 32802

SEQ ID NO: 32862 - DNA, 601 bp, Human; identical to SEQ ID NO: 32803

SEQ ID NO: 32863 - DNA, 601 bp, Human; identical to SEQ ID NO: 32804

SEQ ID NO: 32864 - DNA, 601 bp, Human; identical to SEQ ID NO: 32805

SEQ ID NO: 32865 - DNA, 601 bp, Human; identical to SEQ ID NO: 32806

SEQ ID NO: 32866 - DNA, 601 bp, Human; identical to SEQ ID NO: 32807

SEQ ID NO: 32867 - DNA, 601 bp, Human; identical to SEQ ID NO: 32808

SEQ ID NO: 32868 - DNA, 601 bp, Human; identical to SEQ ID NO: 32809

SEQ ID NO: 32869 - DNA, 601 bp, Human; identical to SEQ ID NO: 32810

SEQ ID NO: 32870 - DNA, 601 bp, Human; identical to SEQ ID NO: 32811

SEQ ID NO: 32871 - DNA, 601 bp, Human; identical to SEQ ID NO: 32812

SEQ ID NO: 32872 - DNA, 601 bp, Human; identical to SEQ ID NO: 32813

SEQ ID NO: 32873 - DNA, 601 bp, Human; identical to SEQ ID NO: 32814

SEQ ID NO: 32874 - DNA, 601 bp, Human; identical to SEQ ID NO: 32815

SEQ ID NO: 32875 - DNA, 601 bp, Human; identical to SEQ ID NO: 32816

SEQ ID NO: 32876 - DNA, 601 bp, Human; identical to SEQ ID NO: 32817

SEQ ID NO: 32877 - DNA, 601 bp, Human; identical to SEQ ID NO: 32818

SEQ ID NO: 32878 - DNA, 601 bp, Human; identical to SEQ ID NO: 32819

SEQ ID NO: 32879 - DNA, 601 bp, Human
taaagacatcaaacacagttttgattaaatttgagtttcaatatttgattataaatataatctatcacacaagaaagctcaaaattttaatgagttattttaaacaaccaaaattcaaatttgaaggttgaatttgaaaattcttagcaaatgcacacagtttttaaacgttcctttgactttgctgtcaatgctgccaatattgttttaaaacatgctcttttttttgagaaataaaagtagcaaactttctcaggctgccagtttgccttattgatatcgttcagggtttcactattaygtgaattcaagtgaagcacttatttgacaaggggacatatcctccaaaaatgactgtaaattgaggtttgctgtaagtcgcatatatttctgtattaacatgcctaaatgtcatctcccaagtgtgactgtttcctaatgctgagtaacactagagtcttaaagattatgagtgacatgaatatggaacataataactgtcctgatacaaaaatatttttttaaaaggtgattaaggttttcaaatatcctaactagtagtggattattacaatagcattaagcaatcataaattcttta

SEQ ID NO: 32880 - DNA, 601 bp, Human
ggaaatgtggacttaaatgtgctttggaaactcacttcctataatcttttactacgatttattgatatgactaaaaaacacacatatatgcactcacaaaactaaaaccttgagaatgtaaagagcacatgaggtggagtgggtgggctctgtctcactcattttacccttgccatgctttttaaaatgcaatattattttataaatattaagccatgtggtaacacgtaagtacttacaccttaagtactatgttcagtgacatttcattttcttataaagacatcaaacacagttttgrttaaatttgagtttcaatatttgattataaatataatctatcacacaagaaagctcaaaattttaatgagttattttaaacaaccaaaattcaaatttgaaggttgaatttgaaaattcttagcaaatgcacacagtttttaaacgttcctttgactttgctgtcaatgctgccaatattgttttaaaacatgctcttttttttgagaaataaaagtagcaaactttctcaggctgccagtttgccttattgatatcgttcagggtttcactattatgtgaattcaagtgaagcacttat

SEQ ID NO: 32881 - DNA, 601 bp, Human
atcccctttaggaatatatgcaaaaggaaagcctgctcaaggaaatgtggacttaaatgtgctttggaaactcacttcctataatcttttactacgatttattgatatgactaaaaaacacacatatatgcactcacaaaactaaaaccttgagaatgtaaagagcacatgaggtggagtgggtgggctctgtctcactcattttacccttgccatgctttttaaaatgcaatattattttataaatattaagccatgtggtaacacgtaagtacttacaccttaagtactatgttcagtracatttcattttcttataaagacatcaaacacagttttgattaaatttgagtttcaatatttgattataaatataatctatcacacaagaaagctcaaaattttaatgagttattttaaacaaccaaaattcaaatttgaaggttgaatttgaaaattcttagcaaatgcacacagtttttaaacgttcctttgactttgctgtcaatgctgccaatattgttttaaaacatgctcttttttttgagaaataaaagtagcaaactttctcaggctgccagtttgccttattgatatcgtt

SEQ ID NO: 32882 - DNA, 601 bp, Human
agaaattcgaagttttaatgctacagactgcaacatgttagctgtttgcacttcagatatggaaggagtacatgtcccatccaatcaataatgtagttatcaagtgttctaacattgctgtaagtgttccttcaccagaataagtatgaatcaaaattttataacaatacagaatgctgatgattacatcacagcatgaggcatacccaaatgccatagaggaaatcattaaaccgatcagtagtttccagcagagatttgaacaattcagttactatgcgagcacattaaactaggccayggaaagagttaaaccacaatctgttctttgtgtgggaaggcagccctgctcacagcaaccacatcccatgataagacctccctatctccatacactttctgatgccatgcttttagctttcactgtaactacaaaaactttgtttatcccctttaggaatatatgcaaaaggaaagcctgctcaaggaaatgtggacttaaatgtgctttggaaactcacttcctataatcttttactacgatttattgatatgactaaaaaacacacatatatgcactcacaaaactaaaaccttgaga

SEQ ID NO: 32883 - DNA, 601 bp, Human
acacacacttgcactctcctgctttctcacacacactcttgcatttttaaatagaagttttcaaactggaaaacaaaaattacatgaatgttcttccatcagcttccctatagaatatgcagccccacagagtccgttaatttgttcaccgatcacatgagtatagcaattattctaaacctcttaaaaatcaatctgaggtgaacaatgaaaaatggcaacttggcaccaactttacattctttgtgtctctgcatgctgtggtggggtgacactgctggtcagttactgcttttgtggmatctatacaattcatttgccatgtagatgaattatcagttagaactgtgggtgcatatatgcatgtgcatgtgaatttgcagatacatagattatagagtaccaatcttttgaattaagtagtttacctttaggctcctgcatttttcctgcctgtttcatccaagccctttttttaagggaggggatcagtgaggaatggtggataatctttacctacagatatttcaagttacttcccagtgcagtcagtttcgttacttcctgatttaggtaaaacctgtcttataagcttaggcct

SEQ ID NO: 32884 - DNA, 601 bp, Human
acaaagcatatagatgctcagtgtaatgccacacagttcccgcttttggagcatgctctcagcaagaggctgctggtggcacaaagagcatgcgccattaaacttgatccattttcttatcaaacgtccaacattccaacactgaaacagcaccattccaaaagtggtaactagagaaaccggtatacagtgagggaaagtgggcaaaggacacagctcgtcgtatcagtgtcctgaacagaaggtttccatactttgagcagtgcattctctccccacactaccaacgccagctcccaaaacacacacacacacacttgcactctcctgctttctcacacacactcttgcatttttaaatagaagttttcaaactggaaaacaaaaattacatgaatgttcttccatcagcttccctatagaatatgcagccccacagagtccgttaatttgttcaccgatcacatgagtatagcaattattctaaacctcttaaaaatcaatctgaggtgaacaatgaaaaatggcaacttggcaccaactttacattctttgtgtctctgcatgctgtggtggggtgacactgctggtcagttactgc

SEQ ID NO: 32885 - DNA, 601 bp, Human
tgattgaccaactaacactatgcagtaccattttacaaagaacacagtgagattttttttttttaatcggagtagagctgttcagaaggcaggagcgatgccacagttcatttctcttctctgtggcacagaaacacaaagcatatagatgctcagtgtaatgccacacagttcccgcttttggagcatgctctcagcaagaggctgctggtggcacaaagagcatgcgccattaaacttgatccattttcttatcaaacgtccaacattccaacactgaaacagcaccattccaaaagtrgtaactagagaaaccggtatacagtgagggaaagtgggcaaaggacacagctcgtcgtatcagtgtcctgaacagaaggtttccatactttgagcagtgcattctctccccacactaccaacgccagctcccaacacacacacacacacacttgcactctcctgctttctcacacacactcttgcatttttaaatagaagttttcaaactggaaaacaaaaattacatgaatgttcttccatcagcttccctatagaatatgcagccccacagagtccgttaatttgttcaccgatcaca

SEQ ID NO: 32886 - DNA, 601 bp, Human
ggtgaaattcatcctgtggaagacagaggggtgaggaaaagatgtgcatagtcagtttaattttaaaagctcaaaaaataagaaaagaagaccacaacccgtttccaattcagtacaaaaagttatacatgaaaataacattcctttcttatttaaaattatcaaaataacaggacaagaagaaagtaaagtatgcccagctgtcccctttccaccaaaattcacaggtcaattctccctcctataaaggaaataaggtttatattttgtattacactctggccccatcccccttgtttcyaccccaatgccatgcattctacattctttaaaatataggcaactaactaaggtgcttggcacctaatatagtatttcaatatttgattgaccaactaacactatgcagtaccattttacaaagaacacagtgagattttttttttttaatcggagtagagctgttcagaaggcaggagcgatgccacagttcatttctcttctctgtggcacagaaacacaaagcatatagatgctcagtgtaatgccacacagttcccgcttttggagcatgctctcagcaagaggctgctggtggcac

SEQ ID NO: 32887 - DNA, 601 bp, Human
gcttagcctagaaaaatctgatccagcctgctaagaatggtgtctcaggtgaagtggccagttaaaacaattggacattgttttggataacaatgctttctatctatatccaactacaatctgcaaagttaatttctgcatccctctacactctgcacgttagtgtgtatatcctgtgcatctccaacccccaccaaaatgttagtaaaatgaaaaagcacttatctacaggaaacttatgtgggttatcataacaacatagagtacatttaattaatcacacttcctttgatataaatgrccatctatggtcatgcagagaacagtgaattaaatgaataccaataacatggcaatcagaaaaaccccaaaattatttttgtacaacaaaaagttttgatgatttgaatgcaaacattttagaaaatcaagcaaaatatattgttatttcatcaaaggttttaagattttaattcaaattttcctaatatgtggtcactctttatactacatttaaggttcaaaatacaaagtattttaaatcatactgcatgcttaagtagtaacaaaacaatttacttacttctggatactcttacaa

SEQ ID NO: 32888 - DNA, 601 bp, Human
tcaccttctttaacataattagtacatatagatctgcatcttggatatgtttgtacatgctagtaataagtaaaagagttaatcaaggtaacgtcccctttgcttaggtagcctgccaggtgagcttagcctagaaaaatctgatccagcctgctaagaatggtgtctcaggtgaagtggccagttaaaacaattggacattgttttggataacaatgctttctatctatatccaactacaatctgcaaagttaatttctgcatccctctacactctgcacgttagtgtgtatatcctgtrcatctccaacccccaccaaaatgttagtaaaatgaaaaagcacttatctacaggaaacttatgtgggttatcataacaacatagagtacatttaattaatcacacttcctttgatataaatggccatctatggtcatgcagagaacagtgaattaaatgaataccaataacatggcaatcagaaaaaccccaaaattatttttgtacaacaaaaagttttgatgatttgaatgcaaacattttagaaaatcaagcaaaatatattgttatttcatcaaaggttttaagattttaattcaa

SEQ ID NO: 32889 - DNA, 601 bp, Human
cacaccccttcagataacccctgtcttacctgatgctacaaagtgctactggtaagtcaggcatatttcttcccaaattaaaagtgaaaactttcaaatgttggatacctttggatatcacatattgatctggaaaaacacattaaggtacactgccttggacaatctccttgcccatcgaatacacaccctggggctaccagaatacaggatatttgtgtttcttctcctacactgccaccatgtaaaaagacccatgagagaagtcttttgggcatacatttatccactctagaattayaccagaaaggataaactacttaagatcttaaacgttcatatgtatcactccctgctatacatgctatttgcactgttcactttagaaatgtgagctatttgaggaactacggttcaaaagacagtcagtgatagcgtgaagattcctttactgaacaacaagactctaaaacactgcttattcttatcctcagtaactcgattactctttgttctttctggatcatcataattcttattcatgacctctaaatatgacccaaatgagaaacacaacttaggcaggtatcagagtgtgact

SEQ ID NO: 32890 - DNA, 601 bp, Human
aaatgtgaggtaagaaatcccacagtaaccgcatgttttataatttattattagaaccatgttctatatgacactggcagtggggtacatgctagaaggagtatttcaggggctcaagtgaagtaaacaatctgtctggcttcctatcacagtaatggatacaattcatagacctgagttattaacaggaaacttagaggttccaccttacataaactattttcaatttattaagctcatgcaatatttaggcaaagatttatagtttctattgaatacatatggctccatagttaacatmatttgcttacccataaataaactagatgtaatttgtagtaaatgataattttaaaatcttcagaaattgtttttttctaaattttgttccagaaagattattccgcagtgtcaagacagcaataaaaacgacaaatatagcatgttctcactcatacatgggagcttaaaaagttgatctcatcgaaggggttgtcagaggtgggggagggtggggaggtgaggagatgaagagagattggttaatgggtaaaaacatacagttataatagacagaaagaataatttccagtatttgata

SEQ ID NO: 32891 - DNA, 601 bp, Human
ttcagtacctgcttggtggagaagacagagacctctgaagattgacccccgagttcatgtcatgatagtatggttggcttgggatttctccaattgggaagttgactccagttccctgggttatgggcgctgaggaataagacaaagaagcactgggaatgacattcgtatttctgacctctattcaaatgtaataatcgagaatctttcatgcctctggtcaaagatagagagaactttcttcaccttaagcctctaatacccaccatacaacctgggtaggacctgaaaacttgctcaycttagcaacgttcaagcttggaaatttgaggcaatcagattataatcactggttaccaatttcccgaatcctattcctcaaccttctttactcactcctttatattagttgacattacatctgtcactctgctagttaaaaatgccttggaggaaacagaatatacgagtcctatcactcagcaacaccaaacaagctgctttgcactacctaggctctcgaaaaccaaatcattgttaaataaataaacagagaaccgtttcacaaaaaaaagcaaaaatcattattcacagcctccca

SEQ ID NO: 32892 - DNA, 601 bp, Human
aagtaaatgtctttctattttaatatttcccaattcaaataataggaaattataaacgataaatgtctaatgttttatgagacaacttaaagaatatgaaaaaaaataaattttagccataacctacaaagggaaatcacctagaatgatttatttccaactttgaaactatgtgggtgggggggtgggacctatttatgggatgtattgcttacctctcccaaaaaaaactttttcagaagatataagaaattaagaatgtatagaatagaaaaaacataaattcaattttatagtcacractttgttctctgaacgtccagagcactgtttctgaaattctctgtattgttcttacaatgcagatcccttggtctacacacagacctaggggatcaggacctctaggggtaaggcaccaaaatgtatattttaaataagtgtccatgtaatcttcctacatactgaagtttgagcatcctccatcaaatgtatgcatttcagagaacaaatgcgtatttcttaaaacaaaactctttactgaagtattactttatttaagaagtatacccatttgaaagtatcatttaaggaaatacaa

SEQ ID NO: 32893 - DNA, 601 bp, Human
caagtcacagcattaagtagagggcaaaagagccaaaaattttctaccaaaattaaaaacaaaagtgaaattcaatttcaaataaaacgtttccctgtacatcctacctggcaattgtttagaaggaaagacaataactaatacaacatcatctcatgtcatttataattgtctggtcatggtataaatgcttatgaacattggaacatagagctagaaactctcctaatgaaaatgtttctttcaaaaccaaaagagctctattctgcaactatttttctttctactttaacttttactrtatgtagtttaaaagatattgttaatataaaaccaagaataaaacacacagcaatgaaaatttaagctttcatataggtaagtatattactttacccatatatcacatattttataataattttataaagggaaatactatataaaacacatgcaatgtggacaatgttcaattttactataacttctcaacattagtattcttataatttattgttcagtttttgaaatataaatcttaagtttgaaagatggagaaagagtgtaatcgtatgatcattatctctaaaatgttgagaga

SEQ ID NO: 32894 - DNA, 601 bp, Human
ttcaggtggggaggatatctgattgttggatgagaaaagtagctcgatggggctggaggaaggatagcttgtgttggaaatggcaacggtgaaggtggaggtggagttcgagttgagatgactgcagaagacagaaaaggaaagattgactcgtcagctggttaccttattgctccattctgatcctgaagaatgctgtgaaactacaaaactggtaaccattcatttttgtccccatgatttaaccaagctctcctaaatcaacagttactttttcatttttattctcaacaccagtackgctaactacacagagataaaacatcactctagaaaattaacaatcttgcttcctggctctgtgagtggttacaaaatcagtttctcttttataggttatgtcaatacttgataaaacacttctttgagcaaagatatatcccgttgaaaacatattctttgattataaaatctttaggccgggtgcagtagctcacacctgtaatcccagcactttgggcggctggggcaggtggatcacctgaggtcaggagttcgagaccagcctggctaacatggtgaaaccccatcgctactgaaa

SEQ ID NO: 32895 - DNA, 601 bp, Human
aaaccaataaaactagcttatcatgcaaatattaaggcatctagaaagtcagttaaaatatattgtcatagagacagaacatctatttcccagcggacttcatgtaacaaaggctacgttgcaggggctgcgatctaccatcagtgaaatatcatcgaccctttttatgtcattacagtttcaaccttaagggaattagtgattgtaagtgctgcaattgctggtctattatcttctttcttcagtttctttcctttctgcctttgtgttgttttgtccagtcttcctcttttcctttttwtttatttaaaaaaaaaatttcttaaactattgttgtgtttctttttccctcagttgcttgtttctgcttgaaggaaaggttctccaattatgttcaaaccgtaattttggacattggccggtaagatgggtgtcctatttgacacttggaaaggaaccaagctagcccaggtaccaggactgttgagaggagagaggcagcagggagggaagaaaaaagaaaaaaatacaatgttaaaatctacaacaatatgagaaatataaattccagatgcatcaaattattgctatccctattttc

SEQ ID NO: 32896 - DNA, 601 bp, Human
ttatattaatttttactgttgcatgcagagagaacacttcacctacatagaggcatttcttccatagagcctttgtgttcaaactgtttttttccttttttctttttttcctttttttttcattttttctttttttaagatttcaaactgggttacacactggaaaaggctgggttaagggccgaaatttaataaatctgtactgataactaaaggctacagagatttcatatattttttttaacttttagaaatcagagtgcttataaaatggctggctcatggctctgtcacccagcayctctgacgccgcctcctagccttcgttggtgagataaccaggaatagtgattccatgcgtaaacaacaagaatactaaaccaataaaactagcttatcatgcaaatattaaggcatctagaaagtcagttaaaatatattgtcatagagacagaacatctatttcccagcggacttcatgtaacaaaggctacgttgcaggggctgcgatctaccatcagtgaaatatcatcgaccctttttatgtcattacagtttcaaccttaagggaattagtgattgtaagtgctgcaattgctgg

SEQ ID NO: 32897 - DNA, 601 bp, Human
gaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtkcagccgcaccacattggcgtggccgtcaaggagctggacctctacctggcctacttcgtgcgtgagcgaggtgaggtgtggtggcctgagcggagcggccagcggggagggtgtctgatggtggtgacacggggccaggagggcctgagggaggaggccagtgcgtgtgggtatgatgtggtggtctgagaggggaagtgggccttggagagtgcccaatggggcgacacggggcacggagcatctgagggaggaggctggtgggtatagatgtgatgtggtggtctgagaggggaggcg

SEQ ID NO: 32898 - DNA, 601 bp, Human
ccggctaatttttgtatttttagtagagacggggtttcaccatgttggccaggtcggtcttgaactcctgacctcaggtgatccgcctacctcggcctcccaaagtgctgggattacaggcatgagccaccgtgcccggcctgtttgtttgtcttagaaacggtctcacgctgctgcccaggctggagtgcagtgacaccatcctagctcactgcagcctggaccagctaggctcaagcgatcctcctgccttagcctctcaagtagctgggactacaggtgtgcaccaccatgcctggcytttttttttttttttttttttttttttttttgagatggagtatcactctgtcgcccaggctagagtgcagtggcgcgatctcggctcactgcatcctccatctcctgggttcaagcaactctcctgcctcagcctcctgagtagctgggattacaggtgtgtgccaccacggctggctaatttttgtatttttagtagagatggggtttcaccatgttggccaggctggtctcaaactcctgacctcgtgatccacccacctcggcctcccgaagtactgggattacaggcatgagccac

SEQ ID NO: 32899 - DNA, 601 bp, Human
acagggaggctggaaggttctcggaggttcacaggcctgaggccactcctcactggcccccggtgactcctccgtctgtgacccgggtcctccgcggcctcctgtgatccccagacgcctctctccaagccagatgttggagggaggtgggggcagcggcgcttggcctggtcccctggggagcttgggcgtctggtagaggaaatcacgtcctcccagctcgccagggagtcccccagagatggagctgagcaggcgctgcacaaacaggaaaccccggtcgggggaggcggagggggcstgctgacaccagctggccagctgggtcagcaggaaacggctctggccacttctcctggacactcgggggccaccgctctgtcctcttcagaatgcgtggccctgaacctcccagcgcggggcagggttggttcattgccttcactcagcaaatgactgtaacagggggccgggtgcggtggctcacgcctgcaatcccagcactttgggaggctgaagcgggaggatcgcttgagcccaggagttcaagaccagcctgggtaatatagcaagaccctatctctacccaaaaaaaaaatat

SEQ ID NO: 32900 - DNA, 601 bp, Human
gtgctgacaccagctggccagctgggtcagcaggaaacggctctggccacttctcctggacactcgggggccaccgctctgtcctcttcagaatgcgtggccctgaacctcccagcgcggggcagggttggttcattgccttcactcagcaaatgactgtaacagggggccgggtgcggtggctcacgcctgcaatcccagcactttgggaggctgaagcgggaggatcgcttgagcccaggagttcaagaccagcctgggtaatatagcaagaccctatctctacccaaaaaaaaaatayacacacacacacacacacacacacacacacacacacactagccccaggagttcaagaccagcctgggtaatatagcaagaccctatctctaccccaaaaaaaaaaaaaaaaatatatacacacacacacacacacacacacacacacacacacacacactagccaaacacggaggtgcatgcctgtaatcccagctacttgggaggctgaggtgggaggatcgcctgagcccaggagtttgagaccagcctgggtaacatagcaagaccctatctctacaaaaagtaataataataatac

SEQ ID NO: 32901 - DNA, 601 bp, Human
agaactggacacagccctgagctccctgcagtccgtgctgccccctgggggccgggagaggaactgctcccaccgccacccaaaagccaagagcctgtcccacctccaaacctaccaggctccctggctctttccactccaaccctgctggcctgcaacttgccaagtgcatttctacccggaggcctttgcacgggctgttcccagtgccgggaacatcgtggccctcagggaggtgatgaaacatcatccccatcggagaagccaacagtcacggggcggttgccaggcgctgttctcrgagctttgcagattttaacaagttccttcctcttatccagtctcatcttgaggtctgtaaaatgccaccatctcggtcaggctttctctgagccctgggtgtaaaatagcctccctccccaccctagctagttccccaccagccgcctgccttaccacaggctgatgcacctcgcatttgacttaatgagcttttaatttgtagtaaaatgtgcatgatgtacaatgcatcattttagccatttttaagtgtccaagtcaaagtgcactaagtacattcacctctatctaattccagaac

SEQ ID NO: 32902 - DNA, 601 bp, Human
taatcttggctgctgtctgtcgctcacactggactttgagtctcacaggggcaactgcttcagcctgtatcatctcctgctgtgccggggcccagctcagaatcagacactgtggatgcttagtaaacgcctgttgagtccatgaatccctcctacaagggcgtccgagggcaggacagggctgtccccaagctgtctgaggttggccaaggctcccgacctctcggggacaacttcgatttccaaatctgtgaaatgggtccaaaccactccagtcgagaggacagtctcccttcctttratattaggtaggagcaatgctggggacactgagggttttaactgcggcttgtgggcctcccattcaaccccccattttaactgacccattgctgggtgccaagctctggtctaggcacgaaggacactgcagggtcggggcagacagacatccctgcccacacggacctcccagtctgaaggggagaagaacaagaagccagagtatctcgaagggtgacagtgtgtaaagcaagccagctgcccctcccaggcagttggatacagatctcacgacaaccccgatgatgggattgatggt

SEQ ID NO: 32903 - DNA, 601 bp, Human
actttgagtctcacaggggcaactgcttcagcctgtatcatctcctgctgtgccggggcccagctcagaatcagacactgtggatgcttagtaaacgcctgttgagtccatgaatccctcctacaagggcgtccgagggcaggacagggctgtccccaagctgtctgaggttggccaaggctcccgacctctcggggacaacttcgatttccaaatctgtgaaatgggtccaaaccactccagtcgagaggacagtctcccttcctttaatattaggtaggagcaatgctggggacactgrgggttttaactgcggcttgtgggcctcccattcaaccccccattttaactgacccattgctgggtgccaagctctggtctaggcacgaaggacactgcagggtcggggcagacagacatccctgcccacacggacctcccagtctgaaggggagaagaacaagaagccagagtatctcgaagggtgacagtgtgtaaagcaagccagctgcccctcccaggcagttggatacagatctcacgacaaccccgatgatgggattgatggtttcacttttgcaattagggaaacttggaggct

SEQ ID NO: 32904 - DNA, 601 bp, Human
ttttttttttttttttgagatggagtcttgctctgttgcccaggctggatggagtgcagtggcgcaatctcggctcactgcaagctccacctctcgggttcacaccattctcctgcctcagcctcccaggtagctgggactacaggcgcctgccaccacgcccggctaatttttgtatttttaggagacagggtttcactgtgttagccaggatggtctccatctcctgacctgtgatcctcccgcctcggcctcccaaagtgctgggattacagacgtgagccaccgcacccggctccaytcgttttttaagagagggtgtcgccctgtttcccaggctggagtgcagtggcacaacaatggttcattgcggcctccacctcccaggctcaagtgatcctccagcctcagcctcctgagtagctgggactacaggcacggaccacaacacctggctaattttaacactttttgtagagatggggtctcgctgtgttccccaggctggtcttgaagtcctgagctcaagcgttcctcctgcctcggcctcccacagtgctgggattacaggcatgagccactgcgcccggcctgctgttca

SEQ ID NO: 32905 - DNA, 601 bp, Human
gggaggtggccaggcccttcccagagcccaaggtcagggctccctcccacctctccaggaaacagaatctaaatgctggatggcaactaaggaaacttctgccccagcatccctcctcctccctggggcctccactgtcctgtcccaggagaccccaaaggaccccgcccctcctgtccccttgctttctctgctgacctgctggggacccagcacattccgtcacacactgtctgaatcccaccccagcgagtcctgggcgctgtccttctttagccctgactgacaccttccctgtccmgatcagcagagcctggcctccagctttggctacacctctgcctcacagtgtgctcttggcctctccccatggccttggtcctctgatccatagaataaaactggtttcagccaccctaggaaccgggccaatatgggaagggggtccccctttggactgcacccagtggctttccctacctctctaaagcaaaccgcagcactgggcactgcttcctgcctcactctcctctgtcaccctctgcagcacccgtggtgactggaacaggacccaacttctccctgggggagctgcaggggc

SEQ ID NO: 32906 - DNA, 601 bp, Human
tacacctctgcctcacagtgtgctcttggcctctccccatggccttggtcctctgatccatagaataaaactggtttcagccaccctaggaaccgggccaatatgggaagggggtccccctttggactgcacccagtggctttccctacctctctaaagcaaaccgcagcactgggcactgcttcctgcctcactctcctctgtcaccctctgcagcacccgtggtgactggaacaggacccaacttctccctgggggagctgcaggggcacctggcatacgacctgaacccagccagcastggcctcagaagaacgctgcccagcacctcctccagtgggtaagtacccaggtccccacctctgggcatttcatgaccccattcatcaacccatcccctctggcccgagctgactcattcctctccctggaatacctcttttcacgattcacctggcctgagaaactcctactcatctcatccttcaaaacccagccagccccacgtgcctcttcccctagccctgacagcccaccgtgggctcccccagcctcaagtcctgccggctcagccagcccttaggaccctccccacccagaa

SEQ ID NO: 32907 - DNA, 601 bp, Human
gatccatagaataaaactggtttcagccaccctaggaaccgggccaatatgggaagggggtccccctttggactgcacccagtggctttccctacctctctaaagcaaaccgcagcactgggcactgcttcctgcctcactctcctctgtcaccctctgcagcacccgtggtgactggaacaggacccaacttctccctgggggagctgcaggggcacctggcatacgacctgaacccagccagcactggcctcagaagaacgctgcccagcacctcctccagtgggtaagtacccaggtscccacctctgggcatttcatgaccccattcatcaacccatcccctctggcccgagctgactcattcctctccctggaatacctcttttcacgattcacctggcctgagaaactcctactcatctcatccttcaaaacccagccagccccacgtgcctcttcccctagccctgacagcccaccgtgggctcccccagcctcaagtcctgccggctcagccagcccttaggaccctccccacccagaagaatgcagacacaggttgttgctgagatatgctttgtgacctcgagcaggtcac

SEQ ID NO: 32908 - DNA, 601 bp, Human
ccacctctgggcatttcatgaccccattcatcaacccatcccctctggcccgagctgactcattcctctccctggaatacctcttttcacgattcacctggcctgagaaactcctactcatctcatccttcaaaacccagccagccccacgtgcctcttcccctagccctgacagcccaccgtgggctcccccagcctcaagtcctgccggctcagccagcccttaggaccctccccacccagaagaatgcagacacaggttgttgctgagatatgctttgtgacctcgagcaggtcacaytgtgtgtgccccagtttccccatccataaaatgggatcatacccctaacaggcagttctgaggactacaggtggccaggagattagccaggctgcctgggttttggtctccaccatgctagcttggtgtccgacctgtgttgagaccctccctgcctctggcccgggtgtcccatccaagcaatggacaggttggaacaggcgttcgtagggaacgggctgaacgcccgcggctcccgcgatgtctcgcgatactacctccctcgcccccgctcacttaaggaccggaagtagcaaagcc

SEQ ID NO: 32909 - DNA, 601 bp, Human
cccttaggaccctccccacccagaagaatgcagacacaggttgttgctgagatatgctttgtgacctcgagcaggtcacactgtgtgtgccccagtttccccatccataaaatgggatcatacccctaacaggcagttctgaggactacaggtggccaggagattagccaggctgcctgggttttggtctccaccatgctagcttggtgtccgacctgtgttgagaccctccctgcctctggcccgggtgtcccatccaagcaatggacaggttggaacaggcgttcgtagggaacgggcygaacgcccgcggctcccgcgatgtctcgcgatactacctccctcgcccccgctcacttaaggaccggaagtagcaaagcccgccgtcgcgccccccgccccgcgtctccctggtaaccagcctctccccttccctcgcccataaggagcaagcggcacaaatcgggctcgatggaggaagacgtggacacgagccctggcggcgattactacacttcgcccagctcgcccacgagtagcagccgcaactggacggaggacatggaaggaggtagggctggtggcgggggcggagccggcc

SEQ ID NO: 32910 - DNA, 601 bp, Human
ctcaggattctggggtaagaggaggcggggtgatgaggcttcctatcccttcggaggctggctttggggaaggtccagggctcatggggtgtgaccagcctgtgactctctcgtcccatcccctccacaggcatctcgtccccggtgaagaagacagagatggacaagtcaccattcaacagcccgtccccccaggactctccccgcctctccagcttcacccagcaccaccggcccgtcatcgccgtgcacagcggtaagcgccacgggcccctggcggggaggggcggcgggccctcckatcaggcctctcacagccggggaagtcccactggatgtctgaccatgagtcctattgctgtagccttctaggtgggcaaaaaaccatagaggtgccgtagtggagagcgcccagggccttgttccagcccggctgagaggttggactcagtccctttgggcctcagtttcccccctgtataacaaaaggctgcaacctaacttcacctcactcccctcacccccgtctcaatctaatccccccattccaaccccagacactgatggacaggcaggatcagaagctgccaatgaggccagg

SEQ ID NO: 32911 - DNA, 601 bp, Human
ttacacctgtaatccccgcactttgggaggcctaggagggaggatcgcttgagcccaggagttcgagacctgcctgggcaacatagcaagacccccacctctacaaaactaaaaaattaaattaaaacacaaggataatatcacagccccagtggggttgccgtgggagtcggggaatttgggtgtcaatgtggtcagtgctgctgggtttttttggtggttattgttactaaacgcactgagatgccggcaggaatgacacccacagacacacagtcacacggtcacagagcagaccggstggagcccccaagtaacccccgcttcccactgtctccgcagggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccggtgagttgggcggggcgcgttcgggcctctcctggcggctccaggtgacctcccgggggccacgtgctcacacg

SEQ ID NO: 32912 - DNA, 601 bp, Human
ggcaaaaggaaagcaactaagacactggactatcctttaaaggtagcaggtgtaatgatgtgttttgacctttgcaggcgagtaaccaggcaatggagtggagtgtctcctggagagagtgaggagagtgtgtgatagctagaaagagagagagacagagagatggcaagcactgagataaatacctggcaaaactaaataaattaccaaaaaggaaaaaaaatccaccaaaccatgataaacacaaaatgcagcttcctgatgcttagagttggcacatgctgctgtgtttatttattgyggattcccatcaggaaagaggaaaaaatacacatgttctttcatataggcaaaatttaaccacataaatttgcactgcaagaaaattgaagtttacgtgaacaaattcatgagcatattttctctttctccccaccgttaatttgggagttgccgttttgggggattttgttttgctttgctttattcatcggagagagttgaagccagctcttggccactctccatttctaatgttcttgtgttgccccttcttcgtactgtttgtgaactttggttaccttcacattccccttacgag

SEQ ID NO: 32913 - DNA, 601 bp, Human
aggagagaaggggccggctgcggggagggctggctgagaagaagcgaaaatgggcggttagcagcagggacccggagccggaggagccgagagcagcgcgtgcgccgagctctactgcctcgcgggaaggcggaagggtggggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgmggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccga

SEQ ID NO: 32914 - DNA, 601 bp, Human
accaccacacctggctaatttttgtatttttagtagagacggggtttcaccatgttggccaggctggtcttgaactcctgacctcaactgatctgcccactttggcctcccaaagtgctgggattacaggtgtgagccaccgcacgcctggcctaaaatttgtttcttattgcagtcaaccaatatatctttagctgaaatctttaaaatatagataatgaaaagtaagaaaatggaagttacctctgatttcatcactataactactgttaacattttgatatgtacctaccacaaattrtaatttttaatgagctctatgtttttaccaactagaaagctaacattcttgtagtatagtcctgaaactttgaattatatcgcagtgcaaaaggaaggaaaccagggttctaatcacagtcctgccattaactgtgtaaccttaaccaagttattgaacctcttagtcacatttcttctctatgaaatgaggaagttggaagggatggtctgaggacactgccagctccgaaatgcattggctttgacattttagatgataacggtttcattgttttacttgccttccttggtgattatt

SEQ ID NO: 32915 - DNA, 601 bp, Human
agtgatagatactcatcctctcttacaggtactgagactaaaaatttttctgtttataaaactattttctctgaagaaagtctcctcagggtaagagggtgtacctatatgtactggctttcctcttgccttactgtcttttaagtaaccagcatttctcttttacatagtaaaatatgaattttataattctgaatcaattgtatcaataaaaagctctttcacgcagtagaaattctcttcttggcattcagctattctattacttgttttctcttggtttttatgctttcaactaaarcagcagtgactaaaggcttaagttaataactcatattgaaatacctcaactgcatagactggaaaggataaatgcccttacaaaattagcattctttaaaataaagaaatctccactggaatgaggtttgcaatgaacagaaccattgtaaaacatttctgctgtcatggtaacattggctcacctagacaaataaaattaattttatatagtcatagtctttctaaaatagtatatctctatagtggttgatttcacatttgaattaaattagcactgctttacgattaggatgtaaga

SEQ ID NO: 32916 - DNA, 601 bp, Human
acatagtaaaatatgaattttataattctgaatcaattgtatcaataaaaagctctttcacgcagtagaaattctcttcttggcattcagctattctattacttgttttctcttggtttttatgctttcaactaaagcagcagtgactaaaggcttaagttaataactcatattgaaatacctcaactgcatagactggaaaggataaatgcccttacaaaattagcattctttaaaataaagaaatctccactggaatgaggtttgcaatgaacagaaccattgtaaaacatttctgctstcatggtaacattggctcacctagacaaataaaattaattttatatagtcatagtctttctaaaatagtatatctctatagtggttgatttcacatttgaattaaattagcactgctttacgattaggatgtaagagggtcttttactacagtatggttagatgacagggatgtttataaaaatttattgcagaccgggcgcggtggttcacgcctgtaatcccagcactttgggaggccgaggagggcggatcacctgaggtcaggagttcgagaccagcctgaccaacatggagaaac

SEQ ID NO: 32917 - DNA, 601 bp, Human
agcagtgactaaaggcttaagttaataactcatattgaaatacctcaactgcatagactggaaaggataaatgcccttacaaaattagcattctttaaaataaagaaatctccactggaatgaggtttgcaatgaacagaaccattgtaaaacatttctgctgtcatggtaacattggctcacctagacaaataaaattaattttatatagtcatagtctttctaaaatagtatatctctatagtggttgatttcacatttgaattaaattagcactgctttacgattaggatgtaagagrgtcttttactacagtatggttagatgacagggatgtttataaaaatttattgcagaccgggcgcggtggttcacgcctgtaatcccagcactttgggaggccgaggagggcggatcacctgaggtcaggagttcgagaccagcctgaccaacatggagaaaccccatctctactaaaaatacaaaattagccgggtgtggtggcacatgcctgtaatcccagctactagggagggtgaggcaggagaatcgcttgaacctgggaggcggagtttgcggtgagccgagatcgtgccattgc

SEQ ID NO: 32918 - DNA, 601 bp, Human
tatagtggttgatttcacatttgaattaaattagcactgctttacgattaggatgtaagagggtcttttactacagtatggttagatgacagggatgtttataaaaatttattgcagaccgggcgcggtggttcacgcctgtaatcccagcactttgggaggccgaggagggcggatcacctgaggtcaggagttcgagaccagcctgaccaacatggagaaaccccatctctactaaaaatacaaaattagccgggtgtggtggcacatgcctgtaatcccagctactagggagggtgasgcaggagaatcgcttgaacctgggaggcggagtttgcggtgagccgagatcgtgccattgcactccagcctgggcaataagaacgaaactccgtctcaaaaaaaaaaaaaatttatttcagaaaaataataaaaattatgtatctaaaattgttaagtgttccttttcttgcaggaaagtcctttaggggcacactggcttctctcctaatacattcttgtgggtgaaaggggtttttctttgacacatactagtttccaagaagccttttgctctcctgatttttttcttttggctttt

SEQ ID NO: 32919 - DNA, 601 bp, Human
agaccagcctggccaacatggcaaaaccccatctctgctaaaaataaaaaaattagccagatgtggtggcaacacgcctgtaatcccagctaattgggagacttcaggcaagagaatcacttgaacctgggaggtgtaggttgcagtgagccaagattgtgccactacacaccaacctgtgcaacagagcaagactctgtctccaaaaaaaaaaaaaaaaaaaaaaaggaagacataagagaagttggaaatctaaattatttttaatcccagtattttattgtggcaaataatacatatrtttatttccctaaaaatctctgttaattggctaagataatgtgttcattagaatacacacatgcacacacacatgaaactttgatttcgccattacttttagcattcttctaaacaacctttttttctttaaaaaaatattttttaaaatttttgtgggtacatagtaggtatatatatttatgggttatatgagatattttgatatagtcatacaatgtataataatcacatcaaggtaaatgagttatccatcacctcaagcatttatcctttgtgttacaaacaatccaattattac

SEQ ID NO: 32920 - DNA, 601 bp, Human
gtgctgcaataaacatgaaagtgcagatgtctcttcaatatactgatttcctttcttttatatacatacatagtagtgagattgctgaattacatggtagttctgtttttagtttttttgaggaactccaaactgttctccatagtagtgtactaaacattcccaccaataggatatgagggttcccttttctcgacatcctcaccagcatttgtcattgcctgtcttttggataaaagtcattttaactgggtgagatgatatctcattgaagttttgatttgcatttctctgatgatcrgtgatattgaataccttttcatatacctgtttgccattttatgtctccttttaagaaatgtctattcagatattttgctcatttttaaattggattattggatttttcctattgaattgtttgagctccttacatattctggttattaatctcttgtcagatggatagtaaaaagtctttttttctttcttcttcatttattttattttatttatattttattttattttgagacaaggtctctctttgttacccgggctggagtgcagtggcaccataacagctcactacagcctcaac

SEQ ID NO: 32921 - DNA, 601 bp, Human
aataaacatgaaagtgcagatgtctcttcaatatactgatttcctttcttttatatacatacatagtagtgagattgctgaattacatggtagttctgtttttagtttttttgaggaactccaaactgttctccatagtagtgtactaaacattcccaccaataggatatgagggttcccttttctcgacatcctcaccagcatttgtcattgcctgtcttttggataaaagtcattttaactgggtgagatgatatctcattgaagttttgatttgcatttctctgatgatcggtgataytgaataccttttcatatacctgtttgccattttatgtctccttttaagaaatgtctattcagatattttgctcatttttaaattggattattggatttttcctattgaattgtttgagctccttacatattctggttattaatctcttgtcagatggatagtaaaaagtctttttttctttcttcttcatttattttattttatttatattttattttattttgagacaaggtctctctttgttacccgggctggagtgcagtggcaccataacagctcactacagcctcaaccttctgg

SEQ ID NO: 32922 - DNA, 601 bp, Human
ttttgtgcttttcatgagtgatttcactgtttagaatggccaccaagtgtagtgctgaagtgctgctgtctagggtccctaagcacaaaaaggctgtggtatgtcttacagagaaaatatgcgagtgttagatataagctttgtttaggcatgagttatggtggttttggccatgagttcaatgttaatgaatcaacagtgtaaatgacctaaagtattattacacagaaacacatctgaaacaaggttatatattaattggtgggtgaaaatgttatgaccggagcctcacaggaacttyaccctgtatttcccttagcagtagtgtttcattatttgctaattctgtttttgcagcaacattatagaatgtagctactgggaataatgagataaaaaatttgactcacccagcacacatgttcccagctgaggctgaacaaagtgatactctgccttcttttatcccagggataaatcccatttagccacagtatataatacttttagtatgttgttgagtttggctttctagtgttttatggaggatttaaaaatctatgttcatcagagatactcacctgtacttttctttcttctg

SEQ ID NO: 32923 - DNA, 601 bp, Human
aaggttatatattaattggtgggtgaaaatgttatgaccggagcctcacaggaacttcaccctgtatttcccttagcagtagtgtttcattatttgctaattctgtttttgcagcaacattatagaatgtagctactgggaataatgagataaaaaatttgactcacccagcacacatgttcccagctgaggctgaacaaagtgatactctgccttcttttatcccagggataaatcccatttagccacagtatataatacttttagtatgttgttgagtttggctttctagtgttttatkgaggatttaaaaatctatgttcatcagagatactcacctgtacttttctttcttctggtgtctttggctttggtatcagagtgatgctggcctcataatgtgagtttggaagaattctctcttctattttttggaaggtttaagaaagattggtattaattcttttttttaatgattaatagaattcacccatgaaaccatctggtcctgtgcttttctttgttgagagctgtttgattactgattccatctccatatttgctattggtctgtttgggctttctatttcttcatgattca

SEQ ID NO: 32924 - DNA, 601 bp, Human
tcacccagcacacatgttcccagctgaggctgaacaaagtgatactctgccttcttttatcccagggataaatcccatttagccacagtatataatacttttagtatgttgttgagtttggctttctagtgttttatggaggatttaaaaatctatgttcatcagagatactcacctgtacttttctttcttctggtgtctttggctttggtatcagagtgatgctggcctcataatgtgagtttggaagaattctctcttctattttttggaaggtttaagaaagattggtattaattcttttttttaatgattaatagaattcacccatgaaaccatctggtcctgtgcttttctttgttgagagctgtttgattactgattccatctccatatttgctattggtctgtttgggctttctatttcttcatgattcagttttggcaggttgtatatttccagactctatccatttcttctgggttttccagtgttttggtgtgtgattattcgtaatagtccgttatgatcccttttatttctgaggcatctattgtaatgtctcctctttcattttttgttttatttatttgagtatct

SEQ ID NO: 32925 - DNA, 601 bp, Human
acagtatataatacttttagtatgttgttgagtttggctttctagtgttttatggaggatttaaaaatctatgttcatcagagatactcacctgtacttttctttcttctggtgtctttggctttggtatcagagtgatgctggcctcataatgtgagtttggaagaattctctcttctattttttggaaggtttaagaaagattggtattaattcttttttttaatgattaatagaattcacccatgaaaccatctggtcctgtgcttttctttgttgagagctgtttgattactgattccatctccatatttgctattggtctgtttgggctttctatttcttcatgattcagttttggcaggttgtatatttccagactctatccatttcttctgggttttccagtgttttggtgtgtgattattcgtaatagtccgttatgatcccttttatttctgaggcatctattgtaatgtctcctctttcattttttgttttatttatttgagtatctctttttttcttagtcttgctaagggtttgtcaattttgtttagtttttcaaaaaccaactcttagttttgttgacttttttctg

SEQ ID NO: 32926 - DNA, 601 bp, Human
gtatataatacttttagtatgttgttgagtttggctttctagtgttttatggaggatttaaaaatctatgttcatcagagatactcacctgtacttttctttcttctggtgtctttggctttggtatcagagtgatgctggcctcataatgtgagtttggaagaattctctcttctattttttggaaggtttaagaaagattggtattaattcttttttttaatgattaatagaattcacccatgaaaccatctggtcctgtgcttttctttgttgagagctgtttgattactgattccagctccatatttgctattggtctgtttgggctttctatttcttcatgattcagttttggcaggttgtatatttccagactctatccatttcttctgggttttccagtgttttggtgtgtgattattcgtaatagtccgttatgatcccttttatttctgaggcatctattgtaatgtctcctctttcattttttgttttatttatttgagtatctctttttttcttagtcttgctaagggtttgtcaattttgtttagtttttcaaaaaccaactcttagttttgttgacttttttctgttg

SEQ ID NO: 32927 - DNA, 601 bp, Human
ccatctccatatttgctattggtctgtttgggctttctatttcttcatgattcagttttggcaggttgtatatttccagactctatccatttcttctgggttttccagtgttttggtgtgtgattattcgtaatagtccgttatgatcccttttatttctgaggcatctattgtaatgtctcctctttcattttttgttttatttatttgagtatctctttttttcttagtcttgctaagggtttgtcaattttgtttagtttttcaaaaaccaactcttagttttgttgacttttttctrttgtttttctattctctatttgattcatttctgccctaaactttcctttcttctgcttactttgggcttatttgattctcctttttctagtttcttgaagtgtaaaataaggttgtttaattcagatcttttttgttttttaaatcggcatttattactataaactttcctgtaggtactgcttttgctgcatcccatacattttgatatgtatatttttgttttcatttatcttgaggtttttttttttttagataggatgttttgctctgtcacccaggctcaatgcagtggcacaat

SEQ ID NO: 32928 - DNA, 601 bp, Human
ttctagtttcattccattatggtgggaaaagatacttaggacgatttacatcttcttaagtttgttgatacttctttgtgattatatagcctaaagaatattctgtgtacacttgggaagaattctattcttctgttatttggcaaaaagttttgtatatgcgtattaggtccattgggttcatagtgttgttcagttctgttgtttgcttattgatttctgactggatgatttatccattacagagaatgatgtattgaagttacttgctattattattattattttgagatggagtctsgctctgtcgcccaggctggagtatagtggcgcgacctcggctcactgcaacctccgcttcctgggttcaagcaattctcctgcctcagcctcccaagtagctgggattacaggcatgcaccatcacgcccagctaatttttgtatttttagtagagacggagtttcaccatgttggccaggctggtttcgaactcctgacctcaggtgatccacccacctcagcctcccaaagtgctgggattacaggtgtgagccactgtgcccgtcctacttgctattattttattactgtcaatgtt

SEQ ID NO: 32929 - DNA, 601 bp, Human
gtagctgggattacaggcatgcaccatcacgcccagctaatttttgtatttttagtagagacggagtttcaccatgttggccaggctggtttcgaactcctgacctcaggtgatccacccacctcagcctcccaaagtgctgggattacaggtgtgagccactgtgcccgtcctacttgctattattttattactgtcaatgtttgccttcagatctgttgttgctttatatatttaggtgctttgatgttgggcacatatatatttataattgttacatctttctgttgtattgaccctyttatcattatataatgacttttgttccctcttgtgatgatttctgacttaaagtttattttgtctgataaaagtttagccactcatgttctcttccggttacttacttgcatggaatacctttctctacccttttactttcagcttatgtgtgtctttaaatctaaagtgagtcttttgtagacagcatgtagttgggtcttgttttcatccattcactcatactatatcttttgatttgagagttaaagtaatgattgataggtaaggacttactattaccattttgttggttgctttc

SEQ ID NO: 32930 - DNA, 601 bp, Human
cacacctaatgtaattaatttcaggttttactttatttttgagacagggtcttgctctgtcacctaggctggagtgcagtggtgcgatcttggctcactgcagcctctgcctcccgggttcaagtgattctcctacctcagcctcctgagtagctgggactacaggcacacaccaccacacctggctaattttttatatttttagtagagatggggtttcaccatgttggccaggctggtctctaactcctggcctcaagtgatctgccttcctcagcttcccagagtgctgggattacaggcacgagccactgtggccagctgcatcttttagtttctacttgaacttcctttagttgctctcataaggctggtgtagtcatgacaaactccagtttttgtttgtctggaaaagtctttatctctccttcattcttaaagggcaattttgatgagtaaagtattcctggttggcaggtttttttttctttcttttagtactttgaatatattatctcccgctttcctggcctgcaaggtttcagctgagaaattcactgatagtcttatagaagcttccttgtatattatatgacaagta

SEQ ID NO: 32931 - DNA, 601 bp, Human
ttaacttatttggagacctttgggcttcatgaattgaaatgtcccttttcctccctagatttgttaaactgttagcctttagtttttaaaaataagaagctttctgcccctttttcttctccttaactcccatatgcctgtattattttcacttgatgttgtcccataagtcctgtatactttccacattcttttttattcttttttctttttgtccctctaatgctatcatttcaaatgacctgtcttttaagtttcccagttcttttcttctgcctgagtctgctgttgaagctgtctyttgagcttttcagttgagtcattgtattcttcagctccaggatttctatttgcttcttttttatggtttctgtttctttattaaacatctctctttattcatttatttgctttcctgattttgtttagttgtagttcattgagcttctttaagatgattattttggattctttgtcatgcaattcatacatctctatttatttagggccagttactagaggtttattagtttcctttggtggtgtcatttttgcctggttctttataattcatatagccttgcaatggagtctatgcatt

SEQ ID NO: 32932 - DNA, 601 bp, Human
ctccttaactcccatatgcctgtattattttcacttgatgttgtcccataagtcctgtatactttccacattcttttttattcttttttctttttgtccctctaatgctatcatttcaaatgacctgtcttttaagtttcccagttcttttcttctgcctgagtctgctgttgaagctgtctcttgagcttttcagttgagtcattgtattcttcagctccaggatttctatttgcttcttttttatggtttctgtttctttattaaacatctctctttattcatttatttgctttcctgrttttgtttagttgtagttcattgagcttctttaagatgattattttggattctttgtcatgcaattcatacatctctatttatttagggccagttactagaggtttattagtttcctttggtggtgtcatttttgcctggttctttataattcatatagccttgcaatggagtctatgcatttgaaggagcaggggccttccagtttttatggactcgttcgccaagtaaataccttctcctattgagtccctgggttgatgggattgcctgtggtattgtgattaagcagggctgaagc

SEQ ID NO: 32933 - DNA, 601 bp, Human
tattcttttttctttttgtccctctaatgctatcatttcaaatgacctgtcttttaagtttcccagttcttttcttctgcctgagtctgctgttgaagctgtctcttgagcttttcagttgagtcattgtattcttcagctccaggatttctatttgcttcttttttatggtttctgtttctttattaaacatctctctttattcatttatttgctttcctgattttgtttagttgtagttcattgagcttctttaagatgattattttggattctttgtcatgcaattcatacatctctrtttatttagggccagttactagaggtttattagtttcctttggtggtgtcatttttgcctggttctttataattcatatagccttgcaatggagtctatgcatttgaaggagcaggggccttccagtttttatggactcgttcgccaagtaaataccttctcctattgagtccctgggttgatgggattgcctgtggtattgtgattaagcagggctgaagctagattatggggctacattagggttcacagtcagtgggcgtaccactaggggcatggacaagtatgtcccatggatgg

SEQ ID NO: 32934 - DNA, 601 bp, Human
aaagtagttaccttgggaggctacacacctattccaacaatgctgtccttgttcaaaaacatttttggaactcctcttttggcattgccttcagagtctgcgacacattcttttgattatcctcaatgatgggaaatcttcgtcctttgagggtggatttgatttttggacagccaaaagtcattcggagtcaagactgataaataaggtgagtgatcaagctagatgataccatttggggtcagaaacaaggtatgattataaggtaatgagactggtttttctcgtgttgctgatacartggctctggaggcacttccaaaagaggagttccaaaaacgttttgagtaatggcagcatctctggattaattatatggtaaggcaacaagttgtgctgaaaagaacacaaagcaaggagtcagtctagtcctgcttcacttttaagtgtgtcacatttaacaagatacttctctgagcctcatctttaaaatatctgtcatatggggttgttgaagataagttggaataaggaaaatggatattaaagtgttgttcaaaatataaattactataataatacagattttactgttattgta

SEQ ID NO: 32935 - DNA, 601 bp, Human
gcctcatctttaaaatatctgtcatatggggttgttgaagataagttggaataaggaaaatggatattaaagtgttgttcaaaatataaattactataataatacagattttactgttattgtacctgatgtgataatatcaaaggaccacactcatctgataaaaaggtctggtgtgtttgtagctggtggtttcttaagtctcattactttatagttataccttgtatatgcagttggggagataagtttcaaagatggccaaaatataattaatatttactctatttaaaagtaaacyatggaatggcacatctcatttaaatccgatttgggtcagtcattttagtgtgtcctccagtgacttgtctattttaaaaagcatgtctttaacttaagttctgtcctagtcttatgttttcatttaacttagcattcttctctgagccttatctgtcctacaatgctctgcttctccctaagttcatttgttatttcctttttcctgatatttccagtatattagcaacttaggttttattcttatttattctcttatcaatggtgtggactgtttgtgttgttaaacgtcttcaaggac

SEQ ID NO: 32936 - DNA, 601 bp, Human
aaaatatctgtcatatggggttgttgaagataagttggaataaggaaaatggatattaaagtgttgttcaaaatataaattactataataatacagattttactgttattgtacctgatgtgataatatcaaaggaccacactcatctgataaaaaggtctggtgtgtttgtagctggtggtttcttaagtctcattactttatagttataccttgtatatgcagttggggagataagtttcaaagatggccaaaatataattaatatttactctatttaaaagtaaaccatggaatggcrcatctcatttaaatccgatttgggtcagtcattttagtgtgtcctccagtgacttgtctattttaaaaagcatgtctttaacttaagttctgtcctagtcttatgttttcatttaacttagcattcttctctgagccttatctgtcctacaatgctctgcttctccctaagttcatttgttatttcctttttcctgatatttccagtatattagcaacttaggttttattcttatttattctcttatcaatggtgtggactgtttgtgttgttaaacgtcttcaaggactcttgtggccc

SEQ ID NO: 32937 - DNA, 601 bp, Human
tgaaaaagggaactctattattctttttcttcttccttttcttctactgttgctcttctttctctttctctcttttcttttctctctctttctctctctctttcttttctttctttttctttctgcttccttttcttctttctttctttctttctttctttctttctttctttctttctctctctctctctttctttctctctctctctctttctctcggtctctgtcacttaggttggagcacagtggcaggaacttgattcactgcagcctcgacttcctgggctcaagtgatcctccmacctcagcctcccaactagctgggaccacaggtgcatgccgctacacctggctaattttaaaatattttttatagagatagggtctcgttatgttgcccagactggtctcaaactcctgagcttaagcagtcctcctgcctcggcctcccaaagtgctggtattacaagtgtgtgccaccacacctggcctctttcatattattttttttttttcagagacagagtctcactgtgttgcccaggctggagtgcagtggtgcggtcttggctcactacaacctctgcctcccgggttcaag

SEQ ID NO: 32938 - DNA, 601 bp, Human
ctactgttgctcttctttctctttctctcttttcttttctctctctttctctctctctttcttttctttctttttctttctgcttccttttcttctttctttctttctttctttctttctttctttctttctttctctctctctctctttctttctctctctctctctttctctcggtctctgtcacttaggttggagcacagtggcaggaacttgattcactgcagcctcgacttcctgggctcaagtgatcctcccacctcagcctcccaactagctgggaccacaggtgcatgccgcyacacctggctaattttaaaatattttttatagagatagggtctcgttatgttgcccagactggtctcaaactcctgagcttaagcagtcctcctgcctcggcctcccaaagtgctggtattacaagtgtgtgccaccacacctggcctctttcatattattttttttttttcagagacagagtctcactgtgttgcccaggctggagtgcagtggtgcggtcttggctcactacaacctctgcctcccgggttcaagcaattctcccgcctcagcctcccgagtagctgggactacaggt

SEQ ID NO: 32939 - DNA, 601 bp, Human
tcttttctttctttttctttctgcttccttttcttctttctttctttctttctttctttctttctttctttctttctctctctctctctttctttctctctctctctctttctctcggtctctgtcacttaggttggagcacagtggcaggaacttgattcactgcagcctcgacttcctgggctcaagtgatcctcccacctcagcctcccaactagctgggaccacaggtgcatgccgctacacctggctaattttaaaatattttttatagagatagggtctcgttatgttgcccagrctggtctcaaactcctgagcttaagcagtcctcctgcctcggcctcccaaagtgctggtattacaagtgtgtgccaccacacctggcctctttcatattattttttttttttcagagacagagtctcactgtgttgcccaggctggagtgcagtggtgcggtcttggctcactacaacctctgcctcccgggttcaagcaattctcccgcctcagcctcccgagtagctgggactacaggtgcacgtcgccacgcctggctaattttttttattttagtagagacggggttttaccatgt

SEQ ID NO: 32940 - DNA, 601 bp, Human
ctctctctttctctcggtctctgtcacttaggttggagcacagtggcaggaacttgattcactgcagcctcgacttcctgggctcaagtgatcctcccacctcagcctcccaactagctgggaccacaggtgcatgccgctacacctggctaattttaaaatattttttatagagatagggtctcgttatgttgcccagactggtctcaaactcctgagcttaagcagtcctcctgcctcggcctcccaaagtgctggtattacaagtgtgtgccaccacacctggcctctttcatattattttttttttttcagagacagagtctcactgtgttgcccaggctggagtgcagtggtgcggtcttggctcactacaacctctgcctcccgggttcaagcaattctcccgcctcagcctcccgagtagctgggactacaggtgcacgtcgccacgcctggctaattttttttattttagtagagacggggttttaccatgttgcccaggctggtctcaatctcctgagctcaggcaatctgcccacctcggcctcccaaagtgctaggagtgctctttcatattctttagacttcttggtat

SEQ ID NO: 32941 - DNA, 601 bp, Human
catctgccctttacctagtcaagtcctgactttacaaatggaaagttctcgaattctgtgtagcaggtacacagctgtacaaagcataccacttgccatgccatgttcctctgtgccagattttcttgcttttttcctttttagctgctgtgttgaaatatgaaaacaatgtcatgaatatcaggcagtttaactgttctccacacccctactggcttccaaactttatggatgttttcacatggtctttgccttttgttggggaaaaaggtaagagaactaaagcacatgtctcatcagytgtttggtgactgagcataccttatatttgcatgagcccctccatgattcagaaatgttttctaattttgtttgttctctacatagattttttttttttttttctgagatggagtctcgctctgtcacccaggctggagtgcagtggcacgatctcagctaactacaacctccgcctcccaggttcaagcaattctcctgcctcagccttctgaggagctgggattataggcacgtgccactgcacccggctaatttttgcattttagtagagacagggtttcaccatattggccaggct

SEQ ID NO: 32942 - DNA, 601 bp, Human
cttattaaaaataaagttagttcattgtagaaaaataaaatttgaaaaatacgagaaaccataaataaggaaaaaaagtcacccataatcccatcatcttatagatatccacagttaacatcttaatgtatactgtgttaattgtcttttatctttgcacatagctttcctctgtagtacactatttttgtggagtttctttgtagactagtttctaatggatctgtagttgtccatgttgatcagtgttgtaactaatcccggtggtgttggttattggagtttttcccaagtttttgcygacaaaacccatatagttttgaacatttgtttagataaaaatgtgcacattctcttaaccaatatttattacatgcttgatatataccaagtactgtattgtttaggtccttgctctcaataagcttatttgctagtgtagggaggaaaaacagtaaataaatatgtcagatgaaaggaagtaaagcaatattagaaaatcaggaataacacttcttgattatttccataggatgaatttgtagaaattgaatatctgtgtcaattagtacttaaaattacaattctgatacagatagaa

SEQ ID NO: 32943 - DNA, 601 bp, Human
ttatttatggtataggagatgactacaaggaaccagttcttcttgaggaaatagtgcagccaagtgaaaaacaaaagaaaaaccgaatatccccctgggcaacatggtgaaaccccatctctactaaaaatgcagaaatcaaccagatgtgatggcgagtgcttctggtcccagctacttgggggcctgaggtgggaggattacttgaacctgggaggcagaggttgcaatgagcggagatcttgccactacactctagcctggccaacagagggagaccctgtctcaaacaaacaaacaraaacacatatatttcctattctttcccaccacaaacataaaaataaataaataaataaataaataaataaaaaggaagaatgggccgggcatagtggctcacgcctgtaatctcagcactttgggaggctgaggcaggtggatcatgaggtcaggagatcgacaccatgctggccaacatggtgaaaccccatctctactaaaaatacaaaaattagctggggtgtggtggcacacacctgtagtcccagctactcgggaggctgaggcaggagaattgcttgaacctgagaggcggagg

SEQ ID NO: 32944 - DNA, 601 bp, Human
accagttcttcttgaggaaatagtgcagccaagtgaaaaacaaaagaaaaaccgaatatccccctgggcaacatggtgaaaccccatctctactaaaaatgcagaaatcaaccagatgtgatggcgagtgcttctggtcccagctacttgggggcctgaggtgggaggattacttgaacctgggaggcagaggttgcaatgagcggagatcttgccactacactctagcctggccaacagagggagaccctgtctcaaacaaacaaacagaaacacatatatttcctattctttcccaccmcaaacataaaaataaataaataaataaataaataaataaaaaggaagaatgggccgggcatagtggctcacgcctgtaatctcagcactttgggaggctgaggcaggtggatcatgaggtcaggagatcgacaccatgctggccaacatggtgaaaccccatctctactaaaaatacaaaaattagctggggtgtggtggcacacacctgtagtcccagctactcgggaggctgaggcaggagaattgcttgaacctgagaggcggaggttgcagtgagccaagatcgcactactgcact

SEQ ID NO: 32945 - DNA, 601 bp, Human
ggttataccataagcggggaaatgaatcttcacccctacttccctccatacagaaaacctaaatcagaatggcttattataacttcagtgtaaaaagcaaaacagtaaaacaagaagaaagtatggagagtagacactggggtagacagagtccttaagtaggacacaaaaagtactaaccttaaaaagccagttgaatttcattaaaataaagaacttctcttcttaaaaatacatgattaagagaggaaaaaggcaagacacaaaatggaagaaaattttttgcaatacacgtctcacmaagcccttgtatccagaatatataaagaactataaatcaataggaaaaaacaaatttcaaaaatggtcaaaagatttaaacaggcacttcacaaatgaggatatcaaagtggccaataggcctggcacagtggctcacgcctgtaatcccagcactttgggaggccgaggcgggcggatcacctgaggtcaggagttcgagaccagcctggccaacatggtgaaactccgtctctactaaaaatagaaaaattagccaggtgtggtggtgggcacctgtgatcccagctactcggttgcc

SEQ ID NO: 32946 - DNA, 601 bp, Human
tcaaaaaaaaaaaaaaaaacaaacaccacagtgaggtaccattacatacccactagaatggctaaaaattaaaagtttgggccagggcatggtgacttacacctgttatcccagcactttgggaggctgaggtgggaggatcacttgaggccaggagtttgaggctgtagtaagttatgattgtgccactgcactccagtctgggcaacagggcgagaccctgtctccaaaaaaaaaaaaaagagtctgacaataccaagtattggtgtgtttgtggagaactagtactaggtatgttgcyaaagggcttgtaaattgattcaagcgctttagaaaactactgggcagtaaagctaaacatatgtctaccctgtaacccagcagttccacacctggtgtatatccaagagaaactggatgtgttcaccaaaggttatgcatgggaatgttcactgtagctttattcataatagctcaaagctggaaacaacccagatgtccatcagtagcagactacataaataaattgtattccgaaatataaataaataaactgtattctatttatacaatggaataatactcagcaataaaaaataac

SEQ ID NO: 32947 - DNA, 601 bp, Human
ggtagttagacatgcgtatacttatgtaagaatgtgttgagctgtacacttcagatttgtgcacctgctgtgcctcgtgtatattttgtaccttaaagaaaacagtttgagggggttgcagtttctcaatcagagagggagtttgcctctttccctgcagccatattctattccagtgccaaaatcacctcttcaatcagagtaccaattctgaaatttacccaggagctgacttcttaggaaagggctttctggaatcccggaatgaaaaggttgatgttcgtgagaataaacatgcaargggaagagacaggagatcatattactgggtgactaacactaggtatgaaaattggtattgaagcattaatatcttaaactaaagtttaactgctttttttgctccccttgttttgttgaattgtttctatttagtttttttcccacctcatcgttcatctggccttttttctttttctttttttttcccaagagacagagttgcccaggctagaatgtaatggctaggtactgtcatagctcatggcagcgcccggttgctgggctccagcaatccccctgcctcagctactcgagtggc

SEQ ID NO: 32948 - DNA, 601 bp, Human
gtgcctggccatcctgccatttataggagtcctttttcttttgtagaaatttcattgctattgactaacagggacaaacccattttttttcttttcttggagacagagtcttggtctgttgcccacgctggagtgcagtggcacgatcttgcctcactgcaatctccgcctcccaggttcaagcaattctcctgcctcagcctcccaagtagttggaactacaggcgtacaccgccatgcccggataattttttatattttagtagagatggggtttcaccatgttgcccaggctggtctsgaactcctgaggtcaggcaatatgcccgcctcagcctcccaaagtgctaggattacaggcgtgagccaccgtgcccagcccttttttctttttataagattgaattcctccttctctttcaaatagaatactgagatattagagttcagctatttagaaggaagtctgaacattttctctttggaagtatagtttattttcctagttcctttagtttcacagaaagtatcagtaaactatttccgattgaatatttttctcaaataaatgtgcagttttttgtgagcagaatatgttccc

SEQ ID NO: 32949 - DNA, 601 bp, Human
ctgcaaatggtactatcaagaaaatgaaaagacatcccacagaatggttgaaaatgttttcaaatcatatatctcctaagagattggtatctagaaaatatactcttacaactgaataagaagacaacccagttaaaaatgggtaaagaattgaattgacatttttcccatgaagacatacaaatggcacatgaaatgatgtttgacatcattagacattcagaaaatgctaatcaaaaccacaatgggataccacttcacagtcagtaggatggctgtgaaaagacagcagttaataagragtgttgatgagaatgtggagaaattgggaccttcttaacactgctggtggaaatgtaaaatggtacagctgctttggaaaacattctgacaggtcttcaaatgattaaacatagaattgacttattactcagcaattccagtcatagctacataccccacaaagaaatgaaaatatgtcctcgcaaaaacttgtacacaaatgttcataaatggcattcaacataatagccaaaaagcagaaaaaagcaattgtccataaactggataaacaaaatgtggtaaacgcaatggaatacta

SEQ ID NO: 32950 - DNA, 601 bp, Human
gacaggtcttcaaatgattaaacatagaattgacttattactcagcaattccagtcatagctacataccccacaaagaaatgaaaatatgtcctcgcaaaaacttgtacacaaatgttcataaatggcattcaacataatagccaaaaagcagaaaaaagcaattgtccataaactggataaacaaaatgtggtaaacgcaatggaatactattcagccataaaaaggaattaaatgcaggtatacatgtcaacatgactgaaccttgaaaacattatgctaagtgaaagaagtcagtcaytacagaccacatattatatgatgccactcatttgaaatgtccagaacagaccaatctagagagaaagtagattcgtgttcaaccaggattaaggggaagaggtgagggaaggaaatgggaagtgagtgctaataagtgggggatttctcattggggcaatgaaaatattctaagcacagattgtggtgatggttgcacagctctactatattaaaaccattgacttgtatactttaaacaagtgagttttgtggtatatgaattctatttcagttaagatgttaaaaaggaaaacaaaag

SEQ ID NO: 32951 - DNA, 601 bp, Human
ctgtttttctgtagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacstggaggtgcatttataattcagtctgcatttattctgtaaaaaggtggctgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaacctgggtttctgacttgaactagtcagtcttcattattgttttttggaaggtaatgtctttcatgtaagactaata

SEQ ID NO: 32952 - DNA, 601 bp, Human
gagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacgtggaggtgcatttataattcagtctgcatttattctgtaaaaaggtgrctgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaacctgggtttctgacttgaactagtcagtcttcattattgttttttggaaggtaatgtctttcatgtaagactaataacgtttcaaatgcaagaagattttttccttttcatttttttccttttc

SEQ ID NO: 32953 - DNA, 601 bp, Human
ttactctctggcttcctggcctaatctgttgttgaaaccttgagttttagaagaagtcttcatgtttaaattctttttcttgtttttgggcaggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaacygtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcatataga

SEQ ID NO: 32954 - DNA, 601 bp, Human
cattacccattataggttgtctccggatactttcatccaagagttgaatagttgtaacacagattgtgtggcccaaaagctataaagtatttactctctggcttcctggcctaatctgttgttgaaaccttgagttttagaagaagtcttcatgtttaaattctttttcttgtttttgggcaggcagagaacatttataatgatgaagaccctgaaggaagcgtggatccagaaggacaagggtcctagatatgtctttacttgttgtgattttagactccccttttttcttctcaacccygagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagc

SEQ ID NO: 32955 - DNA, 601 bp, Human
cacaatgagactattttagcttccagtggtactgatcgcagactgaatgtctgggatttaaggtaattcttgtattcattcctctctctacataattatttcctttatttacactttgcaaaggtagttactaagggtaaatctgttttaacttttaaaattatgcttttgtactagtaaaattggagaggaacaatccccagaagatgcagaagacgggccaccagagttgttggtatgttaaaagcattggacagtactgaaatagtctgtaatttaatgtcctctatctgcatttcamctctttgttttcttccctctttcagtttattcatggtggtcatactgccaagatatctgatttctcctggaatcccaatgaaccttgggtgatttgttctgtatcagaagacaatatcatgcaagtgtggcaaatggtaagggtttagtcatttattttggggaggtgaaataagtgagacatagaatcaatttacatttgtatattttatgattacagctaccatctctgttcatttcactcccaggtgtgattttaagacttgtctatacattatcattttcagctgcctgctcttga

SEQ ID NO: 32956 - DNA, 601 bp, Human
ctcacaatgagactattttagcttccagtggtactgatcgcagactgaatgtctgggatttaaggtaattcttgtattcattcctctctctacataattatttcctttatttacactttgcaaaggtagttactaagggtaaatctgttttaacttttaaaattatgcttttgtactagtaaaattggagaggaacaatccccagaagatgcagaagacgggccaccagagttgttggtatgttaaaagcattggacagtactgaaatagtctgtaatttaatgtcctctatctgcatttmacctctttgttttcttccctctttcagtttattcatggtggtcatactgccaagatatctgatttctcctggaatcccaatgaaccttgggtgatttgttctgtatcagaagacaatatcatgcaagtgtggcaaatggtaagggtttagtcatttattttggggaggtgaaataagtgagacatagaatcaatttacatttgtatattttatgattacagctaccatctctgttcatttcactcccaggtgtgattttaagacttgtctatacattatcattttcagctgcctgctctt

SEQ ID NO: 32957 - DNA, 601 bp, Human
cctcacaatgagactattttagcttccagtggtactgatcgcagactgaatgtctgggatttaaggtaattcttgtattcattcctctctctacataattatttcctttatttacactttgcaaaggtagttactaagggtaaatctgttttaacttttaaaattatgcttttgtactagtaaaattggagaggaacaatccccagaagatgcagaagacgggccaccagagttgttggtatgttaaaagcattggacagtactgaaatagtctgtaatttaatgtcctctatctgcattwcacctctttgttttcttccctctttcagtttattcatggtggtcatactgccaagatatctgatttctcctggaatcccaatgaaccttgggtgatttgttctgtatcagaagacaatatcatgcaagtgtggcaaatggtaagggtttagtcatttattttggggaggtgaaataagtgagacatagaatcaatttacatttgtatattttatgattacagctaccatctctgttcatttcactcccaggtgtgattttaagacttgtctatacattatcattttcagctgcctgctct

SEQ ID NO: 32958 - DNA, 601 bp, Human
tcgctcacgcctgtaatcccagcactttgggaggctgaagcgggcggatcacaaggtcaggagatcgagaccatcctggctaacacggtgaaaccctgtctctactaaaaatataaaaaattagccgggcatggtggcggatgcccgtagtcccagctactcgggaggctgaggcaggagaatggcatgaaacccgggaggcagaggttgcagtgagccgagattgtgccactgcactctagcctgggcgacagaacgagagtccgtctcaaaaaaaagaaaaaagaaaaacctggatgtrtgagtgggcacacatgtgctttatgccgttgctaaaaatagaaatctatatgcctatgctactttctgtgggaattgttttttctttgttatttctatactttctcaaactggttattgaccacttacattcttcagatattaagaaaactaggccaggtatggtagcttatgcctgtaatcccagcactttaggaggctgagatgggtggattgcttgaggccaggagtttgagaccagcctggccaaccctgtctattttttaataaaaatttacaaagaaaggaaaactagtgcctg

SEQ ID NO: 32959 - DNA, 601 bp, Human
tttgttttaagaaaaacctgctgggcgcggtcgctcacgcctgtaatcccagcactttgggaggctgaagcgggcggatcacaaggtcaggagatcgagaccatcctggctaacacggtgaaaccctgtctctactaaaaatataaaaaattagccgggcatggtggcggatgcccgtagtcccagctactcgggaggctgaggcaggagaatggcatgaaacccgggaggcagaggttgcagtgagccgagattgtgccactgcactctagcctgggcgacagaacgagagtccgtctcaaaaaaaagaaaaaagaaaaacctggatgtgtgagtgggcacacatgtgctttatgccgttgctaaaaatagaaatctatatgcctatgctactttctgtgggaattgttttttctttgttatttctatactttctcaaactggttattgaccacttacattcttcagatattaagaaaactaggccaggtatggtagcttatgcctgtaatcccagcactttaggaggctgagatgggtggattgcttgaggccaggagtttgagaccagcctggccaaccctgtctattttttaataaa

SEQ ID NO: 32960 - DNA, 601 bp, Human
ttgaagcaaatctgggctagttaccagttggtttcttttttggggtgtgtggggaggtgagaatcttccttttatataatggttaattttacatttaagaccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatgtgagtagaatccattcagagtttctaaatatcttgtctamgttttatgtttagtcaccatttcaaggtttttttcctttgtttttttttcactgaagttgggatactcgttcaaacaatacttccaaaccaagccactcagttgatgctcacactgctgaagtgaactgcctttctttcaatccttatagtgagttcattcttgccacaggatcagctgacaaggtcagtttcgtttattttaatagaaaacatgatttctctaggtttttttgaattgcagagatattttacttacagtattttttttttcttaaaaaattgattactcttgcttttct

SEQ ID NO: 32961 - DNA, 601 bp, Human
attcagaacactaaatagtcagttttaatcggccttctctcccactgtgctttcccatatcagaagtcagatttggacttcagcatacttgttacttagtagctgtgtgatcttaggcaaattgtttaattttctttcttttatttatttttttcttttttgagacaggaagtagtctttctctgtcacccaggctggagtgcagtaacacgatctctgctcactgcagcctccgcctttcgggttcaagcgattcttgtgcctcagcctcccaagtagctgggattagccagccgccggttttttttgttttgtttgttttttgagacagagtcttgctctttcgcccaggctggagtgcagtggcaccgtcttggctcactgcaacctctgcctcctgggttcaagcagttctcctgtcgcagcctcctgagtagctaggactacaggcaccgccaccacacccggctaatttttgtatttttagtagagaccgggtttcatcatgttggtcaggctggtctcgaattcctgacctcaattaatccaccctcttcggcctcccaaagtgctgggattacaggtgtgagccaccatgcct

SEQ ID NO: 32962 - DNA, 601 bp, Human
gagaatttgtgtttctaacaagttcccagatgatgtggatgcccttgacccagtatggagtacagaatgccttaagacggcattcagaacactaaatagtcagttttaatcggccttctctcccactgtgctttcccatatcagaagtcagatttggacttcagcatacttgttacttagtagctgtgtgatcttaggcaaattgtttaattttctttcttttatttatttttttcttttttgagacaggaagtagtctttctctgtcacccaggctggagtgcagtaacacgatctctgytcactgcagcctccgcctttcgggttcaagcgattcttgtgcctcagcctcccaagtagctgggattagccagccgccggttttttttgttttgtttgttttttgagacagagtcttgctctttcgcccaggctggagtgcagtggcaccgtcttggctcactgcaacctctgcctcctgggttcaagcagttctcctgtcgcagcctcctgagtagctaggactacaggcaccgccaccacacccggctaatttttgtatttttagtagagaccgggtttcatcatgttggtcaggctg

SEQ ID NO: 32963 - DNA, 601 bp, Human
acatgttgtaaatggaattattccttacgtgaaggccttaccccaactttctctcctgttgttcctatttcttttcatcataattggctttagtttgacattttctctttctccattttataggcagtcaatttataaaccccaatgaattctggttgtgtagcatctttcccatctaggccaggggttctcaaaattttatatgcatcataatcagctggaggtactgtgaaacagttagttgtgccccaccttctagagtttctgattcaatgggtctggagtagatgtgagaatttgygtttctaacaagttcccagatgatgtggatgcccttgacccagtatggagtacagaatgccttaagacggcattcagaacactaaatagtcagttttaatcggccttctctcccactgtgctttcccatatcagaagtcagatttggacttcagcatacttgttacttagtagctgtgtgatcttaggcaaattgtttaattttctttcttttatttatttttttcttttttgagacaggaagtagtctttctctgtcacccaggctggagtgcagtaacacgatctctgctcactgcag

SEQ ID NO: 32964 - DNA, 601 bp, Human
tcggcctcccaaagtgctgggattacaggcgtgagctagtgcacctggctgaaaattgtttttgagacaggatcttgctctgttgcccagactgtgttgcagtggcacgatcagagttccctgcagccttgacctcctgggccaaggaatcctcctgcctcagcctctggaatagttggggctacaggcacacgctaccatacctggctaatttttgaaaaatttttttgctatgttgtccagactgttctttaacttctgggctccagtgatcctcccactttgacctcccaaagtgctrggattacagacatgagccaccgtgcctggccctgtttttgttttttaagatgaggattacttacaagcaagcagccctgatgcagtgtttacttttgtgtgtgttctttttctggtgtttacccagatccgtttcccccctttaaaaagaaagaaaaaccacggttgtagttctgtaacactgtcctctccttcgttctttttctggttcttgtctaaccttctacatacaggtaattccaattttctgttcatatctctcttcatttcttttcagtgtaatgtagaagctctcagagct

SEQ ID NO: 32965 - DNA, 601 bp, Human
tccaggctggtcttgaactcctgacctcaggtaatccacccgcttcggcctcccaaagtgctgggattacaggcgtgagctagtgcacctggctgaaaattgtttttgagacaggatcttgctctgttgcccagactgtgttgcagtggcacgatcagagttccctgcagccttgacctcctgggccaaggaatcctcctgcctcagcctctggaatagttggggctacaggcacacgctaccatacctggctaatttttgaaaaatttttttgctatgttgtccagactgttctttaacytctgggctccagtgatcctcccactttgacctcccaaagtgctgggattacagacatgagccaccgtgcctggccctgtttttgttttttaagatgaggattacttacaagcaagcagccctgatgcagtgtttacttttgtgtgtgttctttttctggtgtttacccagatccgtttcccccctttaaaaagaaagaaaaaccacggttgtagttctgtaacactgtcctctccttcgttctttttctggttcttgtctaaccttctacatacaggtaattccaattttctgttcatat

SEQ ID NO: 32966 - DNA, 601 bp, Human
atattggccatcccatacctactaaacattctagaacccctacttttcagaaacttcccaagtaatataatagaatgactagctaggtttcgaaagcaagaattaaagacttaattccccaaggctgaaatctgtactgtcatcttagtagttttctgcattagcaaatctagataaataatgtgagaattgttttttgttgttgttgttgttttgagacggaggacggagtttcactcttgttactcatactggagtgcagtggcatgatctgagctcactgcaacctccgcctcctggkttcaatcgattctcctgccccagcctcccaagtagctgggattacaggcacccgccaccacgcccagctaattttttgtatttttagtagagatggggtttcaccatgttgtccaggctggtcttgaactcctgacctcaggtaatccacccgcttcggcctcccaaagtgctgggattacaggcgtgagctagtgcacctggctgaaaattgtttttgagacaggatcttgctctgttgcccagactgtgttgcagtggcacgatcagagttccctgcagccttgacctcctgggccaa

SEQ ID NO: 32967 - DNA, 601 bp, Human
ccggggccgacccaggagggcagtgggtgcctgggctgagccgcggcctcgacatggcctaacagtgagggcaggcccgagtttgccgagtgcagtccccggtactgaaggcgtgaagagggaactccccgcggggcgggctaacggctcgccagttccctgggaccgatttcggtcgcagctggcgaagccagcggtggggcccccggccagtgtttgtttctcttcctgcctccgatatcggtttctcggcctctgtcccgagcgtggggacaccgcttcctacccacaaggctcgaarctcgggcctcctcgtcgggcttgtgagtttcggcgcgcacgagcgtgctccgaaggcctggctggccccttggcctggaacgggtaacggagtgtttggcggggatggcccgaggagtttcggcgccgcgaaagtggagagtgtggatgcctctgccgtggggatttagacaaatcacctccatttcatggttaggctgtaggagtcatgcaggtggctttgcagaggattactcggtttccgtttgtttgctaacttaaatttgtttttaaaaattttagcagccttcgacgacgcagt

SEQ ID NO: 32968 - DNA, 601 bp, Human
cgagctcttgcagcctccccgcccctcccgcaacgctcgaccccaggattcccccggctcgcctgcccgccatggccgacaaggaaggtgagggtgccggggccgacccaggagggcagtgggtgcctgggctgagccgcggcctcgacatggcctaacagtgagggcaggcccgagtttgccgagtgcagtccccggtactgaaggcgtgaagagggaactccccgcggggcgggctaacggctcgccagttccctgggaccgatttcggtcgcagctggcgaagccagcggtggggccsccggccagtgtttgtttctcttcctgcctccgatatcggtttctcggcctctgtcccgagcgtggggacaccgcttcctacccacaaggctcgaagctcgggcctcctcgtcgggcttgtgagtttcggcgcgcacgagcgtgctccgaaggcctggctggccccttggcctggaacgggtaacggagtgtttggcggggatggcccgaggagtttcggcgccgcgaaagtggagagtgtggatgcctctgccgtggggatttagacaaatcacctccatttcatggttaggctgtagga

SEQ ID NO: 32969 - DNA, 601 bp, Human
ctcgcgctgggggcgcaggaaacaatagaggccgcgcgcacagagcgagctcttgcagcctccccgcccctcccgcaacgctcgaccccaggattcccccggctcgcctgcccgccatggccgacaaggaaggtgagggtgccggggccgacccaggagggcagtgggtgcctgggctgagccgcggcctcgacatggcctaacagtgagggcaggcccgagtttgccgagtgcagtccccggtactgaaggcgtgaagagggaactccccgcggggcgggctaacggctcgccagttccytgggaccgatttcggtcgcagctggcgaagccagcggtggggcccccggccagtgtttgtttctcttcctgcctccgatatcggtttctcggcctctgtcccgagcgtggggacaccgcttcctacccacaaggctcgaagctcgggcctcctcgtcgggcttgtgagtttcggcgcgcacgagcgtgctccgaaggcctggctggccccttggcctggaacgggtaacggagtgtttggcggggatggcccgaggagtttcggcgccgcgaaagtggagagtgtggatgcctctgccgt

SEQ ID NO: 32970 - DNA, 601 bp, Human
aatttcactcaacatgtccacctgccacagataaaatgcaagaatcacaagcagaatcatttttattagtaaattacatctatgcttaagtggtgggactgtttttctaaaactatatacactataaatgccttgaagagcacagctgccacattttattaatcagtctttctttctttagaagaatcttggttcaaaatgataaaaatttcccactctataatgtatttccttcccagaggcaagataccttttgggcaaaggtctaatttgcacaactaactgatttttcttggacttsggtttcaaaataataatccggaataagattcctcactcaccaagagtctttgaaaagaagccccagcaagaccagacatcacacttactccttaaaaaaaaaaaaaaaaaaaaaaaaaattgaagccgggcgcagtggctcacgcctgtaaacccagcactttgggaggccgaggtaggcggatcacctgaggttgggagttcaagaccaccctgaccaacatggagaaaccccatctctactaaaaatataaaattagctgggtgtggtgcctgtaatcccagctgctcgggagtctga

SEQ ID NO: 32971 - DNA, 601 bp, Human
ttgaagccgggcgcagtggctcacgcctgtaaacccagcactttgggaggccgaggtaggcggatcacctgaggttgggagttcaagaccaccctgaccaacatggagaaaccccatctctactaaaaatataaaattagctgggtgtggtgcctgtaatcccagctgctcgggagtctgaggcaggagaatcgcctgaacccaggaggcagaggttgcagtgagccacagctcgcgccattgcgctccagcctgggcaacaagaacgaaactccgtctcaaaaaaaaaaaaaaaaaaaaaaatgcatgtgtcagaaagagtagagactacatctaaactatagctgggcacttctagtggtgtgcacctctagtcacagctactctggaggctgaggcaggaggacggcttgagcacaggagcctgaggctgaagtgcactatgttcacacctgtgaatagtcactgcccttcagcctgggcaaaacaacgagacccctgtctcttaaacaaactatagtagccatgtcagggtggtgagattttaagtggtcctctctctcctttattccaacaacttacaaaaaaatacagtgggttc

SEQ ID NO: 32972 - DNA, 601 bp, Human
cccagcactttgggaggccgaggtaggcggatcacctgaggttgggagttcaagaccaccctgaccaacatggagaaaccccatctctactaaaaatataaaattagctgggtgtggtgcctgtaatcccagctgctcgggagtctgaggcaggagaatcgcctgaacccaggaggcagaggttgcagtgagccacagctcgcgccattgcgctccagcctgggcaacaagaacgaaactccgtctcaaaaaaaaaaaaaaaaaaaaaaatgcatgtgtcagaaagagtagagactacatytaaactatagctgggcacttctagtggtgtgcacctctagtcacagctactctggaggctgaggcaggaggacggcttgagcacaggagcctgaggctgaagtgcactatgttcacacctgtgaatagtcactgcccttcagcctgggcaaaacaacgagacccctgtctcttaaacaaactatagtagccatgtcagggtggtgagattttaagtggtcctctctctcctttattccaacaacttacaaaaaaatacagtgggttctccatacccttaggttccatatctaattaacct

SEQ ID NO: 32973 - DNA, 601 bp, Human
attagctgggtgtggtgcctgtaatcccagctgctcgggagtctgaggcaggagaatcgcctgaacccaggaggcagaggttgcagtgagccacagctcgcgccattgcgctccagcctgggcaacaagaacgaaactccgtctcaaaaaaaaaaaaaaaaaaaaaaatgcatgtgtcagaaagagtagagactacatctaaactatagctgggcacttctagtggtgtgcacctctagtcacagctactctggaggctgaggcaggaggacggcttgagcacaggagcctgaggctgaartgcactatgttcacacctgtgaatagtcactgcccttcagcctgggcaaaacaacgagacccctgtctcttaaacaaactatagtagccatgtcagggtggtgagattttaagtggtcctctctctcctttattccaacaacttacaaaaaaatacagtgggttctccatacccttaggttccatatctaattaacctcaaatcgaaaatatggggggtgaaggtagaggtagatgatggggtcaataaaaaataatacaacaataaaggccgggtgcagtggctcatgcctgtaatccc

SEQ ID NO: 32974 - DNA, 601 bp, Human
agaaccaatcctccaagaatagcaagggaccaaggaacaactgcacaagtgcacagacacaaaactgtgaaatatggagactatggcagggcgtggtggctcacacctgtaatcccagcactttgggaggccgaagcaggcagattacttgaggtgaggagctcaaaaccaacctggctgacatggcgaaaccccatctccactaaacacataattagccaggtgtggtggcgagtgcctgtaatcccagctacttgggaggctgaggcgggagaatagcttgaaccagcgaaggggaggytgcagtaagccgagactgcaccactgcactccagcctgggtcacagagtaagactctgcctcaaaaaaagaaaaagattacaaaggtctgtttgttctgcaattctttgccatgtggggcacacccagcaaatgactgccccaacacctaagctgtggttctgtaaatagagctaaatttaatatcaaaattaatatgaaaactagcaactagaaaaatgctgtgaaccaatattcaccagcaacagcaatagcaacaatatcataccttctatcaggcttaataacattatttccttta

SEQ ID NO: 32975 - DNA, 601 bp, Human
ccaagaatagcaagggaccaaggaacaactgcacaagtgcacagacacaaaactgtgaaatatggagactatggcagggcgtggtggctcacacctgtaatcccagcactttgggaggccgaagcaggcagattacttgaggtgaggagctcaaaaccaacctggctgacatggcgaaaccccatctccactaaacacataattagccaggtgtggtggcgagtgcctgtaatcccagctacttgggaggctgaggcgggagaatagcttgaaccagcgaaggggaggttgcagtaagccragactgcaccactgcactccagcctgggtcacagagtaagactctgcctcaaaaaaagaaaaagattacaaaggtctgtttgttctgcaattctttgccatgtggggcacacccagcaaatgactgccccaacacctaagctgtggttctgtaaatagagctaaatttaatatcaaaattaatatgaaaactagcaactagaaaaatgctgtgaaccaatattcaccagcaacagcaatagcaacaatatcataccttctatcaggcttaataacattatttcctttaaagagtaccctt

SEQ ID NO: 32976 - DNA, 601 bp, Human
atggcgaaaccccatctccactaaacacataattagccaggtgtggtggcgagtgcctgtaatcccagctacttgggaggctgaggcgggagaatagcttgaaccagcgaaggggaggttgcagtaagccgagactgcaccactgcactccagcctgggtcacagagtaagactctgcctcaaaaaaagaaaaagattacaaaggtctgtttgttctgcaattctttgccatgtggggcacacccagcaaatgactgccccaacacctaagctgtggttctgtaaatagagctaaatttartatcaaaattaatatgaaaactagcaactagaaaaatgctgtgaaccaatattcaccagcaacagcaatagcaacaatatcataccttctatcaggcttaataacattatttcctttaaagagtacccttaactaatagtgtgcgtgttatgttgggtaggaaagtgctgaacagtctacttatcagagaaaggactgaaatattaagacataagttttcctttaactagttggaaccttacctttagattaggagtgaatgggtcggggagcctcatgtttcttggaaaggcactcagg

SEQ ID NO: 32977 - DNA, 601 bp, Human
ttttaaaaaacaagaaaaatatttccacactaaggaaaatggagtaacattttcctattgtaacttaagccccccacccccctcaaaagaatgaagtatactttagtaacatttcttaaaaagttttaggctttaattaacattatcacagatgatttatcaaatatttccatttaggtatcatgaaaaactaggcatcaagagtttacaggctgaaatgaatatgctagaagaggagactggacaaaaaataaaaatacaatgatgtaagcgtctatcttcagaagctaaaaaaaaaaaagaactaatgaaaaccaaagaaagtagagtaaaagcatataataaattttttaaagtactgaaaagggagaaaatcagggcccaagttagttattagaaaaaataaattgataaaccctaaccaaggctgacagagaaaacacaaaaattattaatgtcaggaatgacattacagatcctacagtcataaaaaatagtttcagaacattaaacgactttatgctcataaatctgacaattcagatcagtggaaatagaacaccttagcacactgagacacgcaaagatttcctacacaagt

SEQ ID NO: 32978 - DNA, 601 bp, Human
cattacagatcctacagtcataaaaaatagtttcagaacattaaacgactttatgctcataaatctgacaattcagatcagtggaaatagaacaccttagcacactgagacacgcaaagatttcctacacaagtcacaaaaagcaacttttaatataagtttaaaaatctgcaattttgactacaataaattttaaagcttctgatcctcaaaagacacctcccccttcctttaagggagtaaaagggcaagctgtgagagtgggagatgtttgaatatatagtaacaacaaagggcttgyatttaaaacatataaagaattatttaataaataaaaatacaaacaagagccaaaagactggaagaggagcatcacaaaaaggtgatatccatggctgatctacacatgaaaacctcattaagaagtcatcaaggagggtgggtgcagtggctcacgcctgtaatctcagcacttcaggaggctgaggcagactgatcacttaaggtcaggagtttgagacgagcgtagccaatgtaatgagatcccccatgtatactaaaaatacaaaaaattagccaggcatggtggcacatgcctgta

SEQ ID NO: 32979 - DNA, 601 bp, Human
attaaaggccaggcacggtggctgacgcctgtaatcccagcactctgggaggccaaggccagtggatcacttgaagtcaggagttcgagaccagcctggccaacatattgaaatcctgtctcaactaagaatacaaaaaattagccaggcgaggtggcgggcacctataatcccagctactctggaggctgaggcacgagaattgcttcaacctgggaggcagaggttgcagtgagccgaggtcgtggcactgcactccagcctggacaacaagagcaaaactccatcaaaaaaaaaaaaagaaaagaaaagaaaaaagactggcattaaaaagattaaaaaggaccaagttattatggagatagtgggaaataatatttgaaaaaaactggctccagagatttcaagacataatggtccctgtgtacctgtagcaaaatttaaaaagggagaggagtaaacttctgagagaacacaaaacagtcaactgcagaaactgacaactagaaatgtgttttcttaattccttattaagtctcagccatttcctttctctcttccagctcaactcttcgcaaataaccttgttcagtccacgaca

SEQ ID NO: 32980 - DNA, 601 bp, Human
tataatcccagctactctggaggctgaggcacgagaattgcttcaacctgggaggcagaggttgcagtgagccgaggtcgtggcactgcactccagcctggacaacaagagcaaaactccatcaaaaaaaaaaaaagaaaagaaaagaaaaaagactggcattaaaaagattaaaaaggaccaagttattatggagatagtgggaaataatatttgaaaaaaactggctccagagatttcaagacataatggtccctgtgtacctgtagcaaaatttaaaaagggagaggagtaaacttcygagagaacacaaaacagtcaactgcagaaactgacaactagaaatgtgttttcttaattccttattaagtctcagccatttcctttctctcttccagctcaactcttcgcaaataaccttgttcagtccacgacatgaattctctattttcagccaatgtcagcctgctcaccctcccccaactataccaattatgttcaattaattcttggataattgcatttaatatgttgtgttccttcctcctagaatgcccttctccaccaaacaaaacttcatttaagagctatttcaccttct

SEQ ID NO: 32981 - DNA, 601 bp, Human
aatgaactcttaaatagaacttgatcataatccttcaaaataacatagccagtagtcctcaaccttagtttgagagccttccgcatttaaagtgagtctgtaaaaccaacaagctccagagccctgttacccagagatttattcagatatttatgagggcacacatggatttcaactttaaaaacaacacccctacccccaaaaaaacccttaactgacaaatatgtaaaataaatcattcctgtatataaagaagcaaaacattttaaaagaaagaaaggaaaaaacaataaaaaaaaaacttgagagactgacacaggtggcccacaactgagttgaagcagcaacacctaatcactgaggaatggctttcaggcagaggcagtcaagtaattgacttgagtgaacactaaatagcattcccaactaagtttggaagaagtacaattactactaaatgactaatagaaatctataggcaatgctaataaataagcccaggtagttatagtcttcatctacaggagataaactgcagccacaccttctgctgtggcgtatgtgccagcattcttgcaataaatatccgatgggaaatcag

SEQ ID NO: 32982 - DNA, 601 bp, Human
ctgactgctactttttcacagtagtttattcttttggagttagttgagttcatgcgaaatccaattaagttgaacaattattacaggcttgtactttccagatgtgtttgtgtacttaataaatgcactgaatggcttgtggatttctgggctttctgattcagaccattgaactgttgaaggggggaaaagttgggaggacaataatttactactcatgttttgaatttttaaaataattttaacagtaaaaatgaaggttactttttatccccaccagaacaattaaaagtgcttgagraggcaccacatgccagtggctgaatgatgaatgagttgtgcaaacaattggtagaattgttttatagggatagtagaaatttttttttggtgattgcagtagactattgggaattaacaactattttaaagatttgtttttaataggcgatgaagtttactgagttataaagatcatactggaaaatttttaagttatgaagaattacagcgatgtggttttaagccagtaacagtagtgtttaaactggtgctcttgttttgttttgtttttaattcagaatacagttatggccaccca

SEQ ID NO: 32983 - DNA, 601 bp, Human
tagctgggattacaggcacccaccaccgtgcctggctaattttttttttttgagacggagtctggctctgttgtcgaggctggagtgcagtggcatggtcttggctcactgcaacctctgtctcccaggttcaagcagttctcctgcctcagcctcctgagtggctgggactataggtgcccaccaccacacccagctgattttgtatttttagtagagatggggtttcaccatgttgcccaggctggtcttgaactcctgacctcgtgatccgcccacctcagcctcccagaatgctggrattacaggcgtgagtgccacccctggctaatttttgtatttttagtagagatggggttttgccatattggccaggctggtctcaaactcctgacctcaggtgatctacccactttggcctcctaaattgctgggattataggggtgggctaccgcacccagccgaaactttttttttttttttaatttctttttgtggagatggggggtctcactatgttgcccaggctggtcttgaacacctggcctcaagtgatcctcctgccacagtcttcccaagtgttgggattataggcgtgag

SEQ ID NO: 32984 - DNA, 601 bp, Human
accaccgtgcctggctaattttttttttttgagacggagtctggctctgttgtcgaggctggagtgcagtggcatggtcttggctcactgcaacctctgtctcccaggttcaagcagttctcctgcctcagcctcctgagtggctgggactataggtgcccaccaccacacccagctgattttgtatttttagtagagatggggtttcaccatgttgcccaggctggtcttgaactcctgacctcgtgatccgcccacctcagcctcccagaatgctgggattacaggcgtgagtgccacycctggctaatttttgtatttttagtagagatggggttttgccatattggccaggctggtctcaaactcctgacctcaggtgatctacccactttggcctcctaaattgctgggattataggggtgggctaccgcacccagccgaaactttttttttttttttaatttctttttgtggagatggggggtctcactatgttgcccaggctggtcttgaacacctggcctcaagtgatcctcctgccacagtcttcccaagtgttgggattataggcgtgagccactgtgcatactagtcatt

SEQ ID NO: 32985 - DNA, 601 bp, Human
acttgacaggactgaaccccactggtaaaggggacactgaggaggggaattgatgctgctttaagtggagtggtagacttaatttttgttttgttttgttttggagataggatctccctctgtgccccaggctggagtgcagtgacgcgatctcggctcactacaacctccacctcccaggttcaagcgattctcatgcctcagcctccccagtagctgggattataggtgcccaccaccatggctagctaattttttgtttttttagtagagatggggtttcactatgttggccaggctwgtctcgaactcctgacctcgtgatctgcctcggcctcccaaagtgctgggattacaggcgtgagccaccgcgcctggccagttttttttttgagatagttttactttgtcacccatcctggagtgcagtggcgagatcactgctcactgcagccttgacctcctggacttgtgaccctctcgcctcagtcccccaggtagctgggaccacagacgcatgccaccacacctggctgatatttgtatggtagagacagggtttcgccatgttgcccaggttggtctgtaactcctgagctca

SEQ ID NO: 32986 - DNA, 601 bp, Human
ttttgagacagttttactcttgtcgcccagggtggagtgcaatggtgcaatctcggctcactgcaacctccgcctcccaggtacaagcaattatcctgcctcagcctcctgagtagctgggattccaggcatgcgccaccacacctgctaattttgtatttttagtagagacaaggtttctccatgttgggcaggctggtctcgaactcccggcctcaagtgatccacccgccgcggcctcccaaagattacaggcgtgagccaccacgcctggccaattttgtgtgtgtgtgtgtgtgtrtttttttttttttttttttttttgagatggagtcttgctctgttgctcaggctggagtgcaatggcgtgatctctgttcactgcaacctctgcctccagggcttaagtgattctcctgcctcagcctcccgaggagctgggattacaggtgcgtgccaccacgcccagctaattttttaaaaaatttttagtagagacagcgtttcaccatgttggccaggctggtctcgacctcctgaccttgtgatcagctgacctcggcctctcaaggtgctggaattacaagcgtgagccaccaaa

SEQ ID NO: 32987 - DNA, 601 bp, Human
aggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagcyacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagt

SEQ ID NO: 32988 - DNA, 601 bp, Human
cagtacctggcacaagtcaggcctcaggaaatctagctgctctcactgtgcccactggatctttgctgtttcgtttgctgttacccggcagaaagaggcattgcacctatgtgcacatctcagccccctgttcctctgcttctcctggatcttgtggtcagggtggtgcacaagtggagtctgatggaccagaacctcctgctcacctcattcaagctggaaatgagacccgatgaagaactggagagcccaaagcgcttctcaatggtggtgaggctgctcttgaagtaggcgctgtacaggagttggcagagctgcaggaggccttggcagagcacaaacacctgggggaagagtgatgggcccgtgaggtttctggacgacaagccctggcgccctcccagccatctgttaggggccccggcaggctgacctctgtttcctcgcctgttatctaggagcagttacttcccagggtctccaggatgaaacgtcatcattgcaacattgtgttgcaccctacaggaagcactcctaaagtgctagccattcctgttattactgcattcttatcactgctgtgatatgtggcccagtgaaa

SEQ ID NO: 32989 - DNA, 601 bp, Human
atgaacatagtacctgctggcaaggctgccatgaagaggcccccaggtcaggcatgggaggctttcagctcagtacctggcacaagtcaggcctcaggaaatctagctgctctcactgtgcccactggatctttgctgtttcgtttgctgttacccggcagaaagaggcattgcacctatgtgcacatctcagccccctgttcctctgcttctcctggatcttgtggtcagggtggtgcacaagtggagtctgatggaccagaacctcctgctcacctcattcaagctggaaatgagaccygatgaagaactggagagcccaaagcgcttctcaatggtggtgaggctgctcttgaagtaggcgctgtacaggagttggcagagctgcaggaggccttggcagagcacaaacacctgggggaagagtgatgggcccgtgaggtttctggacgacaagccctggcgccctcccagccatctgttaggggccccggcaggctgacctctgtttcctcgcctgttatctaggagcagttacttcccagggtctccaggatgaaacgtcatcattgcaacattgtgttgcaccctacaggaagca

SEQ ID NO: 32990 - DNA, 601 bp, Human
acagccctgcatacctggagcaagccacttgtactcctgagcctcagcatccttatctgtgaagtgggcatgaacatagtacctgctggcaaggctgccatgaagaggcccccaggtcaggcatgggaggctttcagctcagtacctggcacaagtcaggcctcaggaaatctagctgctctcactgtgcccactggatctttgctgtttcgtttgctgttacccggcagaaagaggcattgcacctatgtgcacatctcagccccctgttcctctgcttctcctggatcttgtggtcagsgtggtgcacaagtggagtctgatggaccagaacctcctgctcacctcattcaagctggaaatgagacccgatgaagaactggagagcccaaagcgcttctcaatggtggtgaggctgctcttgaagtaggcgctgtacaggagttggcagagctgcaggaggccttggcagagcacaaacacctgggggaagagtgatgggcccgtgaggtttctggacgacaagccctggcgccctcccagccatctgttaggggccccggcaggctgacctctgtttcctcgcctgttatctaggagc

SEQ ID NO: 32991 - DNA, 601 bp, Human
aagtcaagggaagacctcatgatgctccagaggagcaacccggctctggggaagggaccactgcctgcctccatccaggaagagtggccctggggagaagatggaagccagcccaggagccctgtctccagactatggagacaggatgaaggggttctgctgcctccgctcactctctctccccagcttccagtggctcctggcaggccctgccctctgacctcccacctcctctggcttctcggcccatcttgtcttcctctaactttgatatgcagtcactgagggatggcaggaaatkctcggaggccatagagctctgatctcttcagggagtcaaggccattaagagctctggctcttgtggccctcataagacaggagatgcctgggcccagggctgctgacccacctgcatgcctggggcttatcctctctagactatgtatggggcaggggccccacaggctggcagattgcacagaactaaattagaagcacagaatttgaaggcggacagccctgcatacctggagcaagccacttgtactcctgagcctcagcatccttatctgtgaagtgggcatgaacatagtacctg

SEQ ID NO: 32992 - DNA, 601 bp, Human
tatatgtggcgaaagagcccatggaggggtgcccatgaagtgaggggcaccaatgaagattccagcgatgtgtgtggaggttgagactggctggagcagtgcttgtgagcaagagactggaggaacggtagagaagacagttaggaatccacagaggaggcctcggcatgcagccctcagacagccctgggctcagaccctggctgcaccatgcacatgacagggggctgacctggatggagtactcaggctttctgatgccgggttccttgtctgagaaacacgactgtgaagagtgcckccctcctaggaccgtagaagggactgtcacaggaaagtggtcctggggtcactgctatgtggaccatcaaggaagggggaggggtgaaagggaaagccttattccagcaggagaaggctggggagaggagatacctgccttcttttacagttctgttttggccagaagctgccacaggacaggggcccgggctctaagtgactgcactgacttgaatttcactaagtcaagggaagacctcatgatgctccagaggagcaacccggctctggggaagggaccactgcctgcctccatcca

SEQ ID NO: 32993 - DNA, 601 bp, Human
tatgtgcatgcatgtcatatatgtggcgaaagagcccatggaggggtgcccatgaagtgaggggcaccaatgaagattccagcgatgtgtgtggaggttgagactggctggagcagtgcttgtgagcaagagactggaggaacggtagagaagacagttaggaatccacagaggaggcctcggcatgcagccctcagacagccctgggctcagaccctggctgcaccatgcacatgacagggggctgacctggatggagtactcaggctttctgatgccgggttccttgtctgagaaacaygactgtgaagagtgcctccctcctaggaccgtagaagggactgtcacaggaaagtggtcctggggtcactgctatgtggaccatcaaggaagggggaggggtgaaagggaaagccttattccagcaggagaaggctggggagaggagatacctgccttcttttacagttctgttttggccagaagctgccacaggacaggggcccgggctctaagtgactgcactgacttgaatttcactaagtcaagggaagacctcatgatgctccagaggagcaacccggctctggggaagggacca

SEQ ID NO: 32994 - DNA, 601 bp, Human
tagggtcaacatgaatgaaaatttaaccatgggagatcacagatttggctaccacctgggctgaggtgaaggagaagattcacctcacatgccagctctgactttgattagtagcaaggcctagaatattgtgttgagaaggattctgaggctgtgcatgaactcagcaggaaagggatggggtgggtaattagggatgcctgccagggtcatgaaacaagaccgtggtgacgcaaatgtcggagatttgttttccctgatatccatcatgagtgaggacaacatgtgccaggggaattamcaaagtcagaggtcaacatcgatgagggtcattctgtgtgaatgcagggcagggacaccagggtgctgtcctggaaaaggaggcaaccacacagtcaggcagacccagtcaccaggcatcaccaggaagctcaggatagcaatacaagcagacagacagagacacaggcacacacacagaccagtacacagacacacacctggcacagaaagcagggaaggcacacacataggcctggaagctcagaggaggaggtctcaggccagcagggatgacttagacaggctgcaggactgtgcg

SEQ ID NO: 32995 - DNA, 601 bp, Human
atttttgttccaagcatagggtcaacatgaatgaaaatttaaccatgggagatcacagatttggctaccacctgggctgaggtgaaggagaagattcacctcacatgccagctctgactttgattagtagcaaggcctagaatattgtgttgagaaggattctgaggctgtgcatgaactcagcaggaaagggatggggtgggtaattagggatgcctgccagggtcatgaaacaagaccgtggtgacgcaaatgtcggagatttgttttccctgatatccatcatgagtgaggacaacaygtgccaggggaattaccaaagtcagaggtcaacatcgatgagggtcattctgtgtgaatgcagggcagggacaccagggtgctgtcctggaaaaggaggcaaccacacagtcaggcagacccagtcaccaggcatcaccaggaagctcaggatagcaatacaagcagacagacagagacacaggcacacacacagaccagtacacagacacacacctggcacagaaagcagggaaggcacacacataggcctggaagctcagaggaggaggtctcaggccagcagggatgacttagacag

SEQ ID NO: 32996 - DNA, 601 bp, Human
acacaaatactcagacatacacagacacagatacacacacacagagggttataaggtcagaggagtgaactatctgatgatatttgcttcaaatcatgcccacaggcatgagctgaattcagattcttgaaaagttcatctgagactgggaaagattttaatgggtgaattatttttatttctgattgaactccatccctgggaaaatattaagctctttcattgcctaatcaacctcctgtcttaagcagatcctgctacaagtcctagctagctactcccagcccattgaggaatccarttgtttccgggcccacatttttgttccaagcatagggtcaacatgaatgaaaatttaaccatgggagatcacagatttggctaccacctgggctgaggtgaaggagaagattcacctcacatgccagctctgactttgattagtagcaaggcctagaatattgtgttgagaaggattctgaggctgtgcatgaactcagcaggaaagggatggggtgggtaattagggatgcctgccagggtcatgaaacaagaccgtggtgacgcaaatgtcggagatttgttttccctgatatccatc

SEQ ID NO: 32997 - DNA, 601 bp, Human
gaccctgccttcacccatgtcctgctactgttcattctccacccagcagccagaagggtcctgctgaactatcagaccatgttccctcagctcaaaccctccagtggaaaaaggcaaaggctgtcccagagcctcccgagtcctacacagcctgccccctggtcacctctcaggtctgcactcttctgctcctctccctccctccatccagccatactgcccccagctgttctttgaccacaccaaagaacaaaggcattcccccagccccttttgttcttgctgctccttctgactttaygtcctcaggactccattcttaaccagattcaggcctctgctcagattgaatcatctcaagaaggtctttctctgacctcgtcatttaaaatacacctacatccccaacactgaggccccgtataccttttcccatccatgactctctctcttcattgcactcatcataacctgatctacagtatgttttatttccataaatactatatttatccttagaatgatatatgagcagagatttttgtctgttcattcctgtttccccagcacctagaacagtgcctaatacttggtgctcgtt

SEQ ID NO: 32998 - DNA, 601 bp, Human
aatggtaaggggatgctgccaggccttctgaccacgtctccaccaaagatggtcctctcctcagagcacagttcacctggactggaggagctctgtaaatctgcagccatagccctgccttgttacaccccactttcctcctgggtggagaaacgggtactcctatgtcaggaaacagaggctagagcctcagaacatggctgtcactaaggtcaccagtggcctcctcattggcaaatgtactggtcaatgctcagttccatttgactcagttgaccatttcttttttcctgaaacactyctttcagaattcccatgacaccatcctctcctgcttcccttcccctgtctgctccttctcggtcttcttggcttattcctctttatctccttggactctcaacattgggcccagagctctgcccctaagtgtgtccagttccatggctatttatgctctgcgtgtgcttctaagtcccacagtctcagctcatctaaactctcactcttcttccttcctccaaaaccccagtcccctgtcctggtcctccttgtctcagtaaatggcacctccatcctcccagtggctcacacaaaacat

SEQ ID NO: 32999 - DNA, 601 bp, Human
cggagaggaagtgtgggagggtgaggatgaaggcacctgcagccaggaagagacctccgatgccaatcagacgtggacggtgcacccggctgccaaagtagctgacaaagatgatgaggatggcattgctgatctgagaagagagcagaagggctgagtgagacaagaggccctgtcctcacccacccacagagaagacccgatcatacttcatccaggaaaactggaaagggagggggctgcccagtgtcagctggggcccagacagagttacagtgtcagcttttcccagagagcttcmcaaggggcaagcataagcaattttggttttccctctgttatcagaaacccttctgggtctccatctcctagaccagaccaaaggaagtatctggagattatgaaacactcaaaacctaaactttaaccatcttagaaccaaacctttttgggaaaaagccaaagaaacctccaattctggctggctcctaggaataaaacacattccctaattaagcttgagagtttgtacctaaagtttaggcaaaatcccaagtttaattaggtacaaattaaaggacccaaggaccttggcttggtg

SEQ ID NO: 33000 - DNA, 601 bp, Human
cactaactttgtgagatgttcacccattccttaccccttgaggcaggggttggaagccactcaccagtgctggccaaggtgtactggtagggctcggagaggaagtgtgggagggtgaggatgaaggcacctgcagccaggaagagacctccgatgccaatcagacgtggacggtgcacccggctgccaaagtagctgacaaagatgatgaggatggcattgctgatctgagaagagagcagaagggctgagtgagacaagaggccctgtcctcacccacccacagagaagacccgatcayacttcatccaggaaaactggaaagggagggggctgcccagtgtcagctggggcccagacagagttacagtgtcagcttttcccagagagcttcccaaggggcaagcataagcaattttggttttccctctgttatcagaaacccttctgggtctccatctcctagaccagaccaaaggaagtatctggagattatgaaacactcaaaacctaaactttaaccatcttagaaccaaacctttttgggaaaaagccaaagaaacctccaattctggctggctcctaggaataaaacacattc

SEQ ID NO: 33001 - DNA, 601 bp, Human
agagaagatatgtgtgtcctggcctgtgcctgaaggactagtcagagagcaacagtaggtgctgttggtttagggtccatccagtgcccaacaccagctaagtggttacatatgccatctcatgtatcccacagccatccagcgcacagataatatcagcctcctcctggaggtgagaaacctggggccctggggttcagccatttgcctcagatcacacagctgggaggtaatggagctgacattcaaaccaagtctgtcggatccccaggcctctgaactcatttgctgggttgtaagyaaagagggtgggacctcagtttagtgccccagggcctcatcaagtgctacatcaggacctcacccctccccaaagccctcttcaagccggtgactcacagatgtacaggggcgagttgctgggctctgagaagtcatccacataggagatcccaaatggctgaataggcactgtcccgatgccagccagcagctgggcaaccaccatcaggccccacatgctgctggtctccttctgggggttctgggtggtgctgtggcacttactgggaggcaggtcctgccaatgcttctggcagag

SEQ ID NO: 33002 - DNA, 601 bp, Human
cctccagccaacttccaaagagacctgcttgccaggaaggaaacaggctccaaggcatttaaaaatgccaggtgatgctccctgtgggtacgatgctgggggccctcggaggagctcatggtgccacagagcctgtgggggtggtctgtgtggtctggagtataggccctgaggatgctcaaagtggtgtgttctttttttttttttttttttttttttagatggagtttcactcttgttgcccatgctggagagcaatggtgcaatcttggctcactgcaacctctgcctcctgggttcragtgattctcctgcctcagcatcccaagtagctgggaccacaggtatgcgccaccatgcccagctaattttttatttttaatagagacggggtttctccatgttgatcaggctggtctcgaactcccggcctcaggtgatccgcctgccttggcctcccaaagtgctgggattacaggcatgagccaccacgcccgtcccaaagtggcttgttcgaagggaaggatttgggcattcacgtggtcatctgctatctgctttgcatgggcttctttgaggccaacctgctcctaagtggatg

SEQ ID NO: 33003 - DNA, 601 bp, Human
tctgtcgcccaggctggagtgcagtggcatgatctcggctcactgcaagctctgcctcccaggttcacgccattcttctgcctcagcctcctaagtagctgggactacaggcatccgccaccacgcccggctaatttttttgtatttttagtagagacggggtttcaccgtgttagccagggtggtcttgatctcctgacctcgtgatccacccgcctcagcctcccaaagtgctgggattacaggcttgagccaccgcacccagcccatagaaatatttttaatgccaccaagatgggcrctgtggtggcaacacctgaggtcctgccctgggtctccaaacttcttaagggcagaaagtgagtttgcttcagcagcttgttcctcacagtggccagcgtgggccctgagagaggaggcacacactgtctgctcctggctctccgagggactgcagggatgagtgagcgagtgaggaggtggcagagcgcatctggagctgaagcttcattctctgttctgattggatgagggggctgggggctgctttattgagctggggatgggaatgggtgtcctctgcacatactcacctgtgttg

SEQ ID NO: 33004 - DNA, 601 bp, Human
cgtcccagcgcccacacagtcaaacaccatgttataccctctggatgtgagtcatcatccgtgtgtatattttatatgatgtttcttttttttcctcaaaagagctcttattaaatcttaaagaaccagcaacatcttagaatcaaagaaccatagaattttttttttttctttcagacagagtctcactctgtcgcccaggctggagtgcagtggcatgatctcggctcactgcaagctctgcctcccaggttcacgccattcttctgcctcagcctcctaagtagctgggactacaggmatccgccaccacgcccggctaatttttttgtatttttagtagagacggggtttcaccgtgttagccagggtggtcttgatctcctgacctcgtgatccacccgcctcagcctcccaaagtgctgggattacaggcttgagccaccgcacccagcccatagaaatatttttaatgccaccaagatgggcgctgtggtggcaacacctgaggtcctgccctgggtctccaaacttcttaagggcagaaagtgagtttgcttcagcagcttgttcctcacagtggccagcgtgggccctgaga

SEQ ID NO: 33005 - DNA, 601 bp, Human
aacttatgctggtgtctagggactatatattctcatccataccacttgttgaagaatacgaactcatactgttgacttcttaatatacattaggcttgttctgatctttaaaacaactttattttactatcattagctccattttacagatgaggaagctgaggcacagaaagacaaagttacttgcctaagatcacttggctagtaagagatggagccaggatgagacccaggcagtcccgtcccagcgcccacacagtcaaacaccatgttataccctctggatgtgagtcatcatccrtgtgtatattttatatgatgtttcttttttttcctcaaaagagctcttattaaatcttaaagaaccagcaacatcttagaatcaaagaaccatagaattttttttttttctttcagacagagtctcactctgtcgcccaggctggagtgcagtggcatgatctcggctcactgcaagctctgcctcccaggttcacgccattcttctgcctcagcctcctaagtagctgggactacaggcatccgccaccacgcccggctaatttttttgtatttttagtagagacggggtttcaccgtg

SEQ ID NO: 33006 - DNA, 601 bp, Human
ctcagaacttatgctggtgtctagggactatatattctcatccataccacttgttgaagaatacgaactcatactgttgacttcttaatatacattaggcttgttctgatctttaaaacaactttattttactatcattagctccattttacagatgaggaagctgaggcacagaaagacaaagttacttgcctaagatcacttggctagtaagagatggagccaggatgagacccaggcagtcccgtcccagcgcccacacagtcaaacaccatgttataccctctggatgtgagtcatyatccgtgtgtatattttatatgatgtttcttttttttcctcaaaagagctcttattaaatcttaaagaaccagcaacatcttagaatcaaagaaccatagaattttttttttttctttcagacagagtctcactctgtcgcccaggctggagtgcagtggcatgatctcggctcactgcaagctctgcctcccaggttcacgccattcttctgcctcagcctcctaagtagctgggactacaggcatccgccaccacgcccggctaatttttttgtatttttagtagagacggggtttca

SEQ ID NO: 33007 - DNA, 601 bp, Human
gtgctcttcctggagtctggctcagtcctgcctttcagccaccccttcagccgagctggaacttcgtatcccacccacacactccccacattctccaccctacagcactttgcctgtccctctgttgtggtgctgaccttccccatcttgtgggagactgggtagtgtgggacacactctcaaaggcaggaagcccttgctccattcatcctggggctggctccctgaatggttaactcagaacttatgctggtgtctagggactatatattctcatccataccacttgttgaagaatacraactcatactgttgacttcttaatatacattaggcttgttctgatctttaaaacaactttattttactatcattagctccattttacagatgaggaagctgaggcacagaaagacaaagttacttgcctaagatcacttggctagtaagagatggagccaggatgagacccaggcagtcccgtcccagcgcccacacagtcaaacaccatgttataccctctggatgtgagtcatcatccgtgtgtatattttatatgatgtttcttttttttcctcaaaagagctcttattaaatctta

SEQ ID NO: 33008 - DNA, 601 bp, Human
aagagccaggaaccaattcggggagtgccagcaaaaggacagggatggcttgatcctgaggcataagacaccccctggctttctactttcattggaagtacagccaaatgacaccatgcagatggcactgtggtctgacagtcttagggacgggagtctaggctctagcagcatggttgcaactagcacctgccagatatctgtgacgtgacttgtttgcagggcagtggtgggagtgctcttcctggagtctggctcagtcctgcctttcagccaccccttcagccgagctggaacttcrtatcccacccacacactccccacattctccaccctacagcactttgcctgtccctctgttgtggtgctgaccttccccatcttgtgggagactgggtagtgtgggacacactctcaaaggcaggaagcccttgctccattcatcctggggctggctccctgaatggttaactcagaacttatgctggtgtctagggactatatattctcatccataccacttgttgaagaatacgaactcatactgttgacttcttaatatacattaggcttgttctgatctttaaaacaactttatttt

SEQ ID NO: 33009 - DNA, 601 bp, Human
ggtcagtttcaagcctgtgtctccctggtatgcaaacctgccctcttaaccattaaactactgcctcccaactttatggatccctaacaaaggaggccccataatccttagaagcctaaagaaacaaccatcaactgtgtgaactgcctggcttccaaaggagcagctttctcttggcaattctcttgcacacgtgtaaaagtctgccattgtgtttctctgtgtaaagaaactatccgggcataaagggaaggagaaggtggcagaacggttcagtcaaatcatgacaagcttccctggrcactgccctgagtggactgggcactcagttgctggtctctttgggcaaccaagagccaggaaccaattcggggagtgccagcaaaaggacagggatggcttgatcctgaggcataagacaccccctggctttctactttcattggaagtacagccaaatgacaccatgcagatggcactgtggtctgacagtcttagggacgggagtctaggctctagcagcatggttgcaactagcacctgccagatatctgtgacgtgacttgtttgcagggcagtggtgggagtgctcttcctggag

SEQ ID NO: 33010 - DNA, 601 bp, Human
cccagaggaccaaggccactgcacatgaagcacagcatcagaaaatccccgggcaggagggagcagtaccttcacctccttattcaactcccagcccttggcagaagtagtgaagaagggagctgactctcactcacaagggcacaccatgggccagactctagaccacgtgctttccatctgttttccactgggttctctagcaagtctgcccacctctcaccagtcaagaaactgaggatagaaggggttaagtcccttgcctcaggtaaaggctagtaagtgccatttcattggtcartttcaagcctgtgtctccctggtatgcaaacctgccctcttaaccattaaactactgcctcccaactttatggatccctaacaaaggaggccccataatccttagaagcctaaagaaacaaccatcaactgtgtgaactgcctggcttccaaaggagcagctttctcttggcaattctcttgcacacgtgtaaaagtctgccattgtgtttctctgtgtaaagaaactatccgggcataaagggaaggagaaggtggcagaacggttcagtcaaatcatgacaagcttccctgggcactg

SEQ ID NO: 33011 - DNA, 601 bp, Human
gtattcatatgctttgtctcattcctcacaacgctttcccatactgctactctaattagctggagcactgtaaagaagaggaagcttaggaacaaagaaacttggcgaagctcactcagctagttcattgttttttattttttatttttatttttttagagacagggtctcactctgtcacccaagctggtgtgcagtggtgcagtcatagctcactgcagcctcgaactcctgggctcaagtgattctcccacctcagcctcccaagtaggtgggactacatgcactcaacaccatgctsagctaagtttttaaaataattttttttttagagatggggtctcgctatgttgcccagggtggtcttgaacttcattccttccctacccaccaatctcaacctgggctcaagcaatcctcctgccttggcctcctaaagtgtgagattatacacctggccaactcagctggtttataagtagcagagcttcattcaaacccaggtctgcctgaccccagcacctgcatgatgtgtagccaacgtctgaaattcttccccaagacaagctgaggtcctcccacccctgcccctctccccccg

SEQ ID NO: 33012 - DNA, 601 bp, Human
tccccctttctatctcctctctgggattcttgcttcctcctgagcctaaaggtgagtgctgctcaaggctctgtcctaaacctttacctgcactttcttgggtatactaccccagggaaccttcctacctcttctgaccttgtcagctccagcctaaggccctgcagctctgaactacctttcagatgcaaggcccctgggctctgacagcattaggatcctgctgggaactcatctccaggaataggctctcccattcactgagtgcttactccctgctggacctgtgcccagtattcayatgctttgtctcattcctcacaacgctttcccatactgctactctaattagctggagcactgtaaagaagaggaagcttaggaacaaagaaacttggcgaagctcactcagctagttcattgttttttattttttatttttatttttttagagacagggtctcactctgtcacccaagctggtgtgcagtggtgcagtcatagctcactgcagcctcgaactcctgggctcaagtgattctcccacctcagcctcccaagtaggtgggactacatgcactcaacaccatgctcagctaag

SEQ ID NO: 33013 - DNA, 601 bp, Human
cccatccctggatgggtggctggagtgcctgcctcctggcccaggcaagccctgcggatcctgcagcaccctctgggctcaccaatgaggaagttggcataggctgctgaggtgccatactgcttctccaggaacttgttgaggaaggtggagaggccagcaatgacggaggagaaggtgcactgggccaggaccaccaggacgaagagtgagttcatcaggagcctcagaaagatgcatggaaaccctgtgaacagaccgctgtcaaggctctggcagaacccctgggctgcaggcacacctaggggatgggccagttacaggccctctgctcctactgtcccttaccgcacacaacaccacaggggctggggtccccctggccactatcccctcccccgcactgtgccagcccacccagggctgtagggtcagttacgtttaatgaaatccaccagggagcctcttgacttggcctcctccaacttccttgcttcatctgctgtggcaggagccctctgaaggcaataaaaggggtgagtgttcacggcccaggctcactgtagccacccttccctgagcccttgagtctctggcctca

SEQ ID NO: 33014 - DNA, 601 bp, Human
tctgaattatgcctggtggagccaacagtgaatttgccactgtttagtggtcacggcatctctccatttcttctgccactgggagcccaaatccactaattatgctctgggaaggcctggctggtgaatcccttgccacagtaggcgtcaagacaaccaaccacccagaaagggcagctgcaatgggcaggtcacagacaatattcgccttccctcttcttcagccgaaaaacagtggctgggaccgctgaggcaatccaggatttagtttgctgtctgtctcctggcttaatgtagaccytgcccagagttactccatccccttgagcttcaaccagagggatttcactggttgatctcactgttcccactgttccccggtatctgatattcatgaccttcttcggggagggttgggaaaggggctgacaaaccactgtccagatatttcactagtataattatacgaatgagagttcatctcgtgccaggcactgtgcccgggggctttacatgcacaatcatcacaacgagtctacagtgaattatttgcctgttgtggattagaaaaccaaagcttagataaggtaagcaacttccc

SEQ ID NO: 33015 - DNA, 601 bp, Human
gaatagaagtgccccagactgaggcagagccctgggttcaagtgccaggtcagcccgaaatagctgcatgatttcaggccagccatgtggccacacctgggagctgaggggttgaaccaagtgccctcagctactgcttctggctctacccttccaggtccatgtcacagaagcctaatgccctcgatttatctgggccacggccagcctgcaggacccagagatgcccatgaggatctctcaggatggggctcaaaggcctcagctgaaggagtgctttgactggtttctgctctgagcrgttaggcctcaagaatgtgaatttgttggacatcggccagtctttaattgactgtgggctgtcagcatctggtcatgaccccagggtagggaggtagagagaggttggatgtggctcagaggaggccaggatgctggtaatgagtgtgtgtgtgtggagccctgcctatcctggagccgagaaacagtctttgagggcatgcgctgagctccgagatcctgtggggctcctcttgcctctggaccctggctgcccttaccagttgcttggaggttgcagagctcatgttgatgttgctgc

SEQ ID NO: 33016 - DNA, 601 bp, Human
ctgccccaggggtcccacctctgtcactgtttgggcaacagaaaccatcttctgggctgggctgggctcctccagaagtcatatctgcctctggatgcccaggaacactgccaggttaggcccccaacccccagcttggagccaggggcccaggagggcttgtgcccagcagtggtggttttgcagattgttgtttttgctgtttgtgtgtttattgcagagggaggcataaacagtaggagggcagtgggaacacagtggaattccctgggttctgattctgtcaggcctttgctggagytccctgcctgaaaggaactcctgcctagaagggactccagagaaggaggcccctgtctcaagtctgcaagtccatatggctcaatactgttgtccaactcactttggtggccactgcccttgtctggtggtcttcaccttccttcgctgcccttgtcagatggcccagcctgtgacaatttcagtgtccaagcagttacaagactaatattggaactaagggactagtatgtttccttctgccgacagtggtaactatgcaccctcttcacttggcccctaggaaactccaaagttagtt

SEQ ID NO: 33017 - DNA, 601 bp, Human
aaagtcaaagggagatgtggggaaggagaagccacgccccagactcacagaggtttgccactcaccgcagaaccatcatgtagagggggttgtgggagatgcaggctatcagggacacgaaggagatgaggaagatggccgggagcaggaagtgggcacaggggacagggcacgatcctgtctttgctgaagcggatcccccggtcacacagctgcagttcaaatagatcttcaagaggaaggggagggaaaaagggggaaatttgttattatttcactttcacacacttcagacgtctgyaccagctcttgttggagactgaggtttcaacccttgtgtcctctgggtctggttcccagggaagctgggtgagcctggggccaggtgagggtttcaagctgccccaggggtcccacctctgtcactgtttgggcaacagaaaccatcttctgggctgggctgggctcctccagaagtcatatctgcctctggatgcccaggaacactgccaggttaggcccccaacccccagcttggagccaggggcccaggagggcttgtgcccagcagtggtggttttgcagattgttgtttttgctg

SEQ ID NO: 33018 - DNA, 601 bp, Human
tggggacgagaccccctcatctcagagtaatgggaagaacctcccacatctccctggcagcagatgaggtggcttcacatgcacttccctgtctggacttcagcccgtattccgaggagtagagaggcagaagagatgtcagcaaagcaagtgatgaagcagagtggatgtccactgtcaccaagctggatggcaagctgcggcccacaaaacagccagtcaggttggctttcctggtttcagacatgctcataccattcccattttctcagcctcttctcactgcctccagagaggtggrtgcctgggttgagagacacagctgctacgtgatagatgttgagagacagaagccaacgaaggaggtcattcatcaacaaatatatttattggagaccgactttgtgcaaagcaatgctaatcagggttctccatggagcttccctcagctcttacctcacctccctccatttacattagggccttctcccagggtgtgctcggtgggcagtgtgggactgggggtgtgggagttggtgagagcaggaggagaggtggggacagcaagaagccacagattggcatgaaggatcctgacctg

SEQ ID NO: 33019 - DNA, 601 bp, Human
cttcactaaaaagtgggcacccacacctcggggccagtgtgaggacctgagaagtcgatgcctggagagcctcctgccacacagtggaggcccgtgtatctccactctgagctgatctcaggagaactatgttggatgtctgagccggcatcaaggtgatccctgtgacttactctgacttgaaagaatggcccaggtcccttttgtcttctaagccttctggtgaaagagaaattcaggcttcactgaaagctattctgctttccagagtcactgtgagtcctatgggtacggcagagcygttctcatgtatgtgaactgtgtcggggacttggctcccacacccctgctggacacctctgcctgcagttccacctgaccagggctttctgaaccctcttccagcctggctgccatctccagccctctatggcctcaccattgaccactcctgcatccggtggaactcgctgtgcttggggaggcgaggggcctgcgcctactatgacaacgatgctctccgagacaggtgagggcccatcatgtatgtgtgtcccagagccaggccctgggcttgagatgacagtagtcatatgcccag

SEQ ID NO: 33020 - DNA, 601 bp, Human
gggattgggttgacaatgtttccggactttgcttctacataaggaagtgtcatatatcactctggccagttttcatccccctgttcacctggagacttgagagtgagcaggatctgagtagagaggcttcttcttagagtttcccacttgtgggcagtgccacaagtggagcattgtctgtctttcttctggaagcagctgctcacagggccctaaacaaagtctgggaggctgttgtcagcactgtggtgctgagaatgggatgggccagccttggtgtaaatcctggacaagccctccscagtccagtaactgcctagagctgtagctagtggtacgctacccacaggtagtgtggcatccggaatattagacagccaggaaggcatagcccctgccaagccaaatcttaacactcagctgctgggaagttcggggtcccagagcagaagctttgagcagccaggtattgggaggtctgcagaggggtgttgtctaatccaatagggcagcttggtgtggtggaagtacatgggattcgaacctccataaaccagggttccaagtctggccttgacttctcttggctgtgttacagtgt

SEQ ID NO: 33021 - DNA, 601 bp, Human
gaccacaatgagaaaacccaggcctggaggggttccatttatcacccaagaacacaatccactcttgggtaaaaaaaaggacttcctattacaggttttaaattacacattgggattgggttgacaatgtttccggactttgcttctacataaggaagtgtcatatatcactctggccagttttcatccccctgttcacctggagacttgagagtgagcaggatctgagtagagaggcttcttcttagagtttcccacttgtgggcagtgccacaagtggagcattgtctgtctttcttcyggaagcagctgctcacagggccctaaacaaagtctgggaggctgttgtcagcactgtggtgctgagaatgggatgggccagccttggtgtaaatcctggacaagccctccgcagtccagtaactgcctagagctgtagctagtggtacgctacccacaggtagtgtggcatccggaatattagacagccaggaaggcatagcccctgccaagccaaatcttaacactcagctgctgggaagttcggggtcccagagcagaagctttgagcagccaggtattgggaggtctgcagaggggt

SEQ ID NO: 33022 - DNA, 601 bp, Human
ttaactcagagcactatatgaaagcactgcatttccaggcactgccaagcccgtttgttcataaaataaagcaacagttgggcaaatgtcaaaagccacactacgaagaacctgacagtaaacagaaaccgattagcataatctacgtggtctgagtggtactaaaacttgacctttttttctattttgatctttgctacacagcataaaacaaaacaaaaatatttaaagtaaactgctaaatacagcagcaacttctgaaagtctaggtcagtaaaatttagaatgctgccttgcttgyaggcaacaaggggtagaggacaataaagaacctttgtgttccgactggcagtaacacagcagcgactgcagcagctctatcctttaaaaaggaggcagctccctgtgtatttatcacgacttacattaactggtcacgacagtctccaccattagactgtaagctccaggaaggcaaggaccatgactcaccacagtagcctcagcgcctaaaataggcgctcaataaatatttgctgcagaataaatgaataggcggcgatgcagaagggaagaagaggctctggggacaaccccagag

SEQ ID NO: 33023 - DNA, 601 bp, Human
tgtaatagaagctttagccaattaagactaaaagttaagagtccgagttggtttttcatcattctaatgctttggaacagtaaagaaaaattctgtccttctccagaatgaaataaatacatgaaaacttcagcccaggagtcttgatgaggtagctggttagtttccaagttttataacagcatggttttgtgactctccaattatgagataataattaaacataataatttctatgcatgtatatttgttacagactttatgagtttacttcataattatgctgtctcaaaagtttaaraggaaaaacataccgatttatcattctatcatcttttaacattccaagcaatcttggctttgagggttaaataattcatctaagtaaagtggagctgaagaaagagtactgattgtagcaattaaaaggccagttagtttcagtgccagttttgccattttgagcaagtcacttaagttttcaggggctgattcagctgtaagatcaagggactcaggatatgctcctccagaacctgccccaccctaccagtattcaaaagtattagcacaataccataatcacgcaatctaaataaaa

SEQ ID NO: 33024 - DNA, 601 bp, Human
aaccatatatgactttttacatttaaaaatacttttaaacaaaggggaaaaagtaatggaaacttggaattaaatagagggtaaatcaaatgacagcaagagaccaatacaatgtgaaaaccaaacaaagcaagggccaaggttggtgggaattatctgcctgaggatacaccagtgaagtctctaggaaagacagatgcatcccaaaacaagggtgagaataaaatagtcagccctcagtatccacagattccacatcctttaaccaaccatgcattgaaaatattctgaaaaaaaaaaatggatggttgttactgaacatgtaggcttttttcttattattccctaaacaatatagtataacaagtatttacattgtattaggtattatgagcaatctagagaatatttaaagtttacaggaggacgtgagtaggtgatatgcaaatcctacaccattttatatcagggacacgggcatctgggactttggtatccatggggagtcctggaatcgattcaccatggctaccaagggtcaactgtattctacagctgtgttgaccaatatagcagccactacacacagtaaaatatggct

SEQ ID NO: 33025 - DNA, 601 bp, Human
ctggatatgcaaaaatattttaaagatgtctaatatctactgctcacaggggtagctgaaagctaggactctaaaaacctggctgggagaaagcaaaccaatacaatctttttgctggctaatttggcaacttagtatggtctttaacccagtaattccatttctaaaactgaacctacataaatattaaaaacaacaatatctataaacgtgtatgcataaatatgaatgcatatatgtaaatacacagaaaaatgtttggaaggatacatactaaagcactagaagcagttacccctawggaggggaaggagataagacagtggcatgtaaaaggtgacttatctccacaaacttatactttataattttttttatgataaccatatatgactttttacatttaaaaatacttttaaacaaaggggaaaaagtaatggaaacttggaattaaatagagggtaaatcaaatgacagcaagagaccaatacaatgtgaaaaccaaacaaagcaagggccaaggttggtgggaattatctgcctgaggatacaccagtgaagtctctaggaaagacagatgcatcccaaaacaagggtgaga

SEQ ID NO: 33026 - DNA, 601 bp, Human
aaatccaccaaaaacggcagaatttaagattctccctaagtcagtttaagccctatttgcttaaattgttcaccaagtatatgtgagaaaatgagatctaatccaatatgtagagaatgagggaaatgatcatatatatatatctgaaaaagttgaaaattttgctgactcagttggttctagacctaaacatacactatccgtgacatatactacccttggctctgtgtggagttcttaaaaaccaaaggcaaaaataatttcagttattcatcacttaacaatggggatacattctgakaaatgtgttgttaggtgatttcatcgttgttgtgcaaacatcatcaagagtactcacacaaacctagatggtatagcttactacacacctaggctatacagtatagcttattgctcctaggctacaaacctgaaaagccttttactatactgaatactgttggctgtactgaactgaatggtaagtatttgtttatctacaattatccaaatagaaaaggtgcagtaggaagatggtattataatcttatgggtattatagtacaaatatggtattataatctttcggtctattgttgac

SEQ ID NO: 33027 - DNA, 601 bp, Human
tcatgttgattagtacttgacaaagccagtgtgaaactagtattacatctaatctgccacactcttaaggtctcatatgtaaaataatggagttaaagcaggacactgaagttgcctgcagttttaaaatctataaacccaggatcttttatgaagtagtttcattttaagacatttgcccaaccttctctcaactgtcaaatcttttcaatttttaattgtgaaataattttaaacttacagaaaagtttcaatagcaaagtcttgtatattttttctcccagattctctaatgattagyattttaccacatttttcctatcatctctaaatacacacaccaacacacacagacatacatatgcactcacttttttccaaaaccatttgtgagtcagtaatacattactcctaatacttcagtactggctttccaaaacaaggctattccctcatataacaggacaaccatcatggggaaattaacattgatatatcattactatttaatccacagaactcattcaaatttctccaattgccctaatacctccaaatcattttccctcgtataaggaggtaggtaaaaatgaaaaatttt

SEQ ID NO: 33028 - DNA, 601 bp, Human
accactagctggaactatttcattattctgtagagatctaggaaggaacttaaaatatagtgttccatatcttgccattttttaaaaaaccaaccagccatttttaattagaacacataacctgtttcagtctaggccttcaagttttcctttgcttgagtattagtatggttgcacgacatgagattttctgaggaccactgaccaaaccatactaacagatgtggtttattcatgaccctttaagaaaaaattttagtatcatgttgattagtacttgacaaagccagtgtgaaactastattacatctaatctgccacactcttaaggtctcatatgtaaaataatggagttaaagcaggacactgaagttgcctgcagttttaaaatctataaacccaggatcttttatgaagtagtttcattttaagacatttgcccaaccttctctcaactgtcaaatcttttcaatttttaattgtgaaataattttaaacttacagaaaagtttcaatagcaaagtcttgtatattttttctcccagattctctaatgattagtattttaccacatttttcctatcatctctaaatacacaca

SEQ ID NO: 33029 - DNA, 601 bp, Human
gacatatgtaataggcccatactagtacactgagtttttttaaaaagaactaaataaaggaatccagtgaaatgtgcttatctcagctgggcacagtggctcacacctgtaatcccagccctttaggagcccaaggtgggcagatcacttgaggtcaggagttcaagaccagcctggccaacacggtgaaacccccgtctctcctaaaaatacaaaaattagctgggcatggtggcacacgcctgtaattccagctactcaggaggctgaggcaggacaactgcctgaacccaggaggcaraggttgcagtgagccgagatcatgccactgcactccagcctgggcaacagagtgagactccatctcaaaaagaaaaaaaagaaatatgcttatccctttccttctgccattttcattttgctaaaaacctcaaacccaagtacagtcaatatgttctgctaaaatttaggaaaggaggtgggaaccacacctttttttccttttcactactgtagcaatgaccaacaacttaggcccactgtgtttatactacccatctatcaggacacagcatatagagaaggcaatgaataggcaatc

SEQ ID NO: 33030 - DNA, 601 bp, Human
caagggtgggatcaagcttgaggaaatttgtgatgacaaacaacaattcaaataaagtagttgtccctcagtatctgtgggagattggttccagaaccacccacagatttcaaaatccgtaaatgctcatgtccctgacataaaatgacacagtatttccacataacctatgtacatcctctcatatactttaaatcatctctacattacatgtactgcctaacacaatgtaaatgctatgtacatagtcactatactgtgttgtttagggaataatgacaagaaaaaaaaagtatgtacwtgttcaatacagtcacaatttgtttttccaagtattttcaatccactgttggttaaatccatggatgtgaaattcataaatgcagaactgatggatattactatttttacacaaagcaatttggcactaactgtcaaattttaaaatatatatacctttaacccagcaatttcagttccaggaatttatgctagagatatacaaatttttgtgtgcatgcgtattgacacacagaacacatatatatgtgtatatatatttttacagcaaattcatgacagtataattcataataacaaa

SEQ ID NO: 33031 - DNA, 601 bp, Human
aaaatatgaaagttaaacagatggtccatacaaaagtacctggaaataattttttttttgcattattatagtaataccaaacaataattaatcgatagcaaagtaaatggtttataggaaaagacagcaaatactgtgaagtagttattcccatttttggattaagaaattgatgcttttgaagtcaggagcactctgaaaaagaaggaaggactagcttcttcataaaagagcaaaacatatcataaggttggagtaattaactatgaacataaatgaatagactaacagatcgattgarcagaacagagtctaaaagtagacccaaatacatagctgagtaaataatcacagtaatattaagtattagtgagcaatagaaaactaattcagtaaatggtattgtgacaactggggagccatctggaaaaaacaagttggatcactatctcatttgttccactaactaattctagatgaatagaaaacttaaacatttaaaaagaagaaaccataaaagaatttcaaaaaggagaattttaaaaataataatggaaggaccttcttaagtatgccagaaaaccctgagccataaaacatt

SEQ ID NO: 33032 - DNA, 601 bp, Human
gtttggctgcatactcatatttggtctgggaccatagtttcccattggttgtccctgactcattgtcatctgattctgtactggcatgctctgtgatgatggcacagaatggttgtaacctcccatggatccatggctacttgaaggcatattcatggaactgtttgtcatattgagttgattgggtccaggtccctgcataggcatatggttaggccctttgaagaaaaatgatcagaagcaaaatatgaaagttaaacagatggtccatacaaaagtacctggaaataattttttttttgcattattatagtaataccaaacaataattaatcgatagcaaagtaaatggtttataggaaaagacagcaaatactgtgaagtagttattcccatttttggattaagaaattgatgcttttgaagtcaggagcactctgaaaaagaaggaaggactagcttcttcataaaagagcaaaacatatcataaggttggagtaattaactatgaacataaatgaatagactaacagatcgattgaacagaacagagtctaaaagtagacccaaatacatagctgagtaaataatcacagtaata

SEQ ID NO: 33033 - DNA, 601 bp, Human
ctttaaacttttatttttatgaaccagctaagaacctgacaacaatcattttacttttcaaaggctaatagagcactctagtcaagaaggacataaagcttagttaccttggtttggctgcatactcatatttggtctgggaccatagtttcccattggttgtccctgactcattgtcatctgattctgtactggcatgctctgtgatgatggcacagaatggttgtaacctcccatggatccatggctacttgaaggcatattcatggaactgtttgtcatattgagttgattgggtccrggtccctgcataggcatatggttaggccctttgaagaaaaatgatcagaagcaaaatatgaaagttaaacagatggtccatacaaaagtacctggaaataattttttttttgcattattatagtaataccaaacaataattaatcgatagcaaagtaaatggtttataggaaaagacagcaaatactgtgaagtagttattcccatttttggattaagaaattgatgcttttgaagtcaggagcactctgaaaaagaaggaaggactagcttcttcataaaagagcaaaacatatcataa

SEQ ID NO: 33034 - DNA, 601 bp, Human
caaaaaataccaactcagaaaaacaaatgctaacttcttaaaaataggttcaaactagtagcaaatttatttccttttaattttgatactacagtgctgtgaagtaaaattgggtttattcctgaccctttataacttttcaaaaacaaaacagtattttctgctgtgaattagtgagctttcgatataaaattgtatggtataacttattccagaaaataacagataagaagttcctatcttcttcgtgacccctttgtacttactagaaccctaccttttgtcaaaaaaaaaaaaaaaraaaaaaaaaagaaaacgccctgactttgtctagattaaaaggtcattaaaatttaaagcctttcaattacattaagtagcaaattttccaaatggaatcttaccctgttgaggaggtctatagggaggaatctgtctctgacccatcatatgattgccttggttaacttgacccatcattcccataggtggctgctgtccttggtaatgctgtccgcctccctgtggcatattgtattgctgagaaggaggctgctgatgcatcattggacctgaaacaagacacaacattatacacata

SEQ ID NO: 33035 - DNA, 601 bp, Human
tactctatgtaaatgtcagatataaagtaatatacacctatgcaaaaatgatacccttcaaattaaaatccactaataaaatgaattaaagtaaccttaatgttttgatatttacaaaataacaaaccaatatattttgaacagaaaggttataacaatacacatgtcacatttcaagagatacccaggatcaaaacaacaatgtcaaatttaactctttaaaatgtaattaaaaattaaaaaatagaaacaatcatttattttcagcagacttcttaatacatataatttaacaaagtaratttcacgtctttaaaatacgtagagtctacaacaatcttactaaagtttttaatttaaaaaaatcttaataccatgtttacatatgaaaagaaaaaacaaaacaaaaaccaatgtccttaagtacaaatgtacctttatgttttatgtattaacaaaaaatgacaggtgagatgttttttcaaatatcctaaattgtatcttcttgctagcttacatgggctgctagtcaatggctgctaatactttagctttaagtttcttagtttctctgttcagtaatttatatttacatcaaagg

SEQ ID NO: 33036 - DNA, 601 bp, Human
tctatatatttactaacataaatatccggacatgagagaaaagagccaatgttgtttacaaatattaattgtcgacataaatagaatactctatgtaaatgtcagatataaagtaatatacacctatgcaaaaatgatacccttcaaattaaaatccactaataaaatgaattaaagtaaccttaatgttttgatatttacaaaataacaaaccaatatattttgaacagaaaggttataacaatacacatgtcacatttcaagagatacccaggatcaaaacaacaatgtcaaatttaaytctttaaaatgtaattaaaaattaaaaaatagaaacaatcatttattttcagcagacttcttaatacatataatttaacaaagtagatttcacgtctttaaaatacgtagagtctacaacaatcttactaaagtttttaatttaaaaaaatcttaataccatgtttacatatgaaaagaaaaaacaaaacaaaaaccaatgtccttaagtacaaatgtacctttatgttttatgtattaacaaaaaatgacaggtgagatgttttttcaaatatcctaaattgtatcttcttgctagctt

SEQ ID NO: 33037 - DNA, 601 bp, Human
taccgccttgcatattcaccacatgaaataaacataatatacaaaatattgctgctgtaaaaagtgtacatttccctcttccccttacaaaaaaatctgtggaaaagtattaaattcccttacccttcataaacatacaaagctgttcacacctttcagtctgtaacagtccatttgaaacacagttccaaaatcattacaaattggttatgtcattgcattttctgtccaatgttgccatctagagtagaaatgtgaaatcaagagtatttttgagctactaaagccttttataactaawccacaaaggctgcttactgatgaaacagccacttatccacaaggtttttccaaaaactagatggaatggaaggatctcttcacagggaggtgtccacagtgctgaggtgacaatatggctgctaatagatactggctactggaatgtaagtactttttcactgctggtaatttccatactgtccctaaaagataaatttaaaaatataattagataatagtttgaccataacaggcaaagaagattacaaacgaatcatttctaacactgtcataccacaaaaaagcagccgtacctaca

SEQ ID NO: 33038 - DNA, 601 bp, Human
tttaattttttgacatatttgctacaggttgacatacacgataagggtccaaattcaaatcaatgaatttaacgtgaccattttttaacacctgtcaagacaggcaaaaaaattatttttaaatacctgcatttgcctctcaaattcagaatatacccatcctcctcagatacgagtggcaagaaactgacaacagctaaatagctttcaagttaaattcagaggggaaaaatgtcagagtacttccactctgaaaaactctctaccatgggggaaaaaagatgtccatatgaacataacwcactttagacaggagcaaagttggggtgagcaattaacaggtgggagaagatttaaaaaaaacacagaaaagcagccaagacaaccttaaccggagaaaactagagccagtcgagccagaaaacagacccatcgtagaatgaaaaagaccactctgatggaaactatcgcactttaacctggaatccttcagttctagatataagttttaaaacaaaaccctacgcaagtaagcccagagaagaacacaaaaatagccatacctaaattttccccttcttcaatccgcgacagacactgc

SEQ ID NO: 33039 - DNA, 601 bp, Human
aagataactaatacattttttttgagagggagtcttgctctgtcgcccaggctgcagcacagtggtgcaatctcggctcactgcaatctccacctcctgggttcaagcaattctcccatctcggcctcccaagtagctgggattacaggcgcccaccaccatgtccagttaatttttgtattttagtagagacggggtttcaccatgttggccaggctggcctcgaactcctgacctcaagtgatctgcccgcatcagcctcccatagtgctgggattacaggcatgagccaccatgcccrgcaataaatgttcatactaatatcttccagtttgtgtatagaatttttataactgtttctacaaatgttttgccttattaacaactgtttgagaatccttatctatataacacaaagagccctgagtaggctaatcagggctctttgtgttatatagataaggatagtttccagttacctggaatggaaaggaaaggaccctaggccaggctcaactatcttgacacctgctgcctgaatatcccaaactacctgcttataaataatctgagatttgccaaacgactgctaagatcatgg

SEQ ID NO: 33040 - DNA, 601 bp, Human
tatatcatcacctcacagagtgaggattgtagtgactcagtaagatgatacatgaaagtgctctgcccccagaaagcacttcatcaacaacggcttttcttccctttaaaggacaaatgggatttggacaagcaatgatgaagggatgacggtccactgtggggaatgagaggaagcaaaagtacagtggtagaaacaaacaacatgttccagagagcaagcaggccagtctgcctggagggaggatccaccacaggacacaaagggaagcaaaactcaaagccaggatgagaatcacaakggggagcaaaattaaagtattctagccactgccccacagtacctagcaggacatgggagattagtaagtattcactgaacttgccaagtctcaaatgctcagaagggtgcaaaattatacatattcatcagtctctttttaagggtcaaagtataatgtggcccaatgcaaacaaatttcttttaacacacaagactaatgtttagaagtcaagacactcagatgtttgctaaaaatgaaagcagcgatgagtaggaggctctgaaacctttccattcccactcatgccctagtgcaagg

SEQ ID NO: 33041 - DNA, 601 bp, Human
acctagtaaacacatgctatgtgcaaggtgccgtgggagatacaagattggggcatggtggccctgtccaagtgacactgccaaccctgccttccctcctgatcccactgcccctccctgctccctggcagcggtctccagtctccagcctccctccctcccttccctgagtggggtctcatcaggccttccaatttgttgtattagaattatctggggcatggtttaaaaagcagattaaagggcattctcctgactcttctaattcagtagccaggagcctgggaatatgtattttttkagcattccacaggtcattgtgtcatgaagcccagcttgagagcctctgcctgacacactagactacagaaatcccaggcctggcccatctagcatgcagactctcctaccttcactctttcctatgcaccgtattctcctaccataggctccatgacactctgaggggcacaccaggctttctcatgcctgtatgtaaggagctcccactgcgtagagtcccccagcccccaacacactcgacgaccttctgctcatccttcccaggccagctcaatgtttgttcctctataaaatctga

SEQ ID NO: 33042 - DNA, 601 bp, Human
cactttgcagtgtgcccctaaccaggaccgcctcgaaggcgggggccacatcttcctttgtccatcccaaacacatagcatacccagcacagtaacacagaccccaatgtgagctggagacatattagctgaactaacattgtgattgtcagagagccacaagggagttataccatcaaagattagagtaaaaagcaaacaagaatccttcttgtgaacatgaaacgttaaatgcttgggtgtggctaaaaaaagtacaaaagctgaaaataaccccaaactcaaattattcaatgaaaaytatagcccatttcttctaatcaactttgcatttacctgattaataactgccctgggaacagagcaaagcacagatctgacctcagaattataacatcttttacaaacatggaaagtgtctgaattcagagtcttgaggaatttatataaatcaaatgacccgcaaaagttaaccaagaatagagacaaatttctgtattcttcacccgccatgaagaaaaaacttatttttaatgctgtttgggtattttgcaaatgaataataaaagcaagttgatgaataagtacataggcttgaaaa

SEQ ID NO: 33043 - DNA, 601 bp, Human
gtggaaatgggacctcccccacgtcgaaggaggttgcccaaaattctcatcccagcccagcttctgaaagaaacagcagatgccaggcgcggtggctcatgcctgtaatcccagcactttgggaggccgagttgggtggatcacgaggtcaggagatcgagaccatcctggctaacacggtgaaaccccgtctctactaaaaatacaaaacattagccgggcgtgatggcgggcgcctgtagtcccagctactcgggaggctgaggcaggagaatggcgtgagcccgggagacggaggtcrcagtgagccgagatcacgccactgcactccagcctgggtgacagagcgagactctgtctcaaaaaaaaaaaaaaaagaaaaagaaagaaagagcagactatcaggggctattattaggaaccatgctcctgtgaattctgtggaaatgaaagcctgtttcagttcatgccaagtcttttcatggtccgccagcgatccttaatcatcacagctgttcggttaacaaatgggtaatttttagaaatggcagcccagtttccttccccatatttctgcactccagccttgacccactcgctt

SEQ ID NO: 33044 - DNA, 601 bp, Human
agggagaggggaaaccaggagacccactaccagagcctgagctgaaccctgacaatccgcttgatggtaaaaccagtgaacctctgctcctccacctcctggctggcctttccacggccacagcctctcctcgctattctcacagcctcctcctttgtcgtcatgtttgaacttctcacttgcctgattcagctttgccaccttcttaagctgtaaaaccgcaaacaaaaggtcatcacatgagatagtttaagggcatatttgccaggaaactgaccaaagctgacctaatctgttaggyctcagtgttctcatttgtaaaataggatcataatagtatccacccctctaagttgtgctgaggacccaagggcagagcatttggcacacagtaggtgcataattgcttaaagagggatgtccacaatagtactgatatcatgcctttctgggttgttaatattttaagtatcattaaatacacaaatatatatcgatctctttgtcccctccaaaagggttcccagcaaacggtctgaggtgatgagcaatgctgtggaaggagagatattcgtctaacagtttgtcattcaccaagagg

SEQ ID NO: 33045 - DNA, 601 bp, Human
atgaggccccagagggcatgtggattggtcaaggtagagtgagtcaggagcagagctgagtagaagctcttcaggacttaggcctcaggcctcagccctccaacttccaatcagctccctcctctgccaggttttggaaggagggagaggggaaaccaggagacccactaccagagcctgagctgaaccctgacaatccgcttgatggtaaaaccagtgaacctctgctcctccacctcctggctggcctttccacggccacagcctctcctcgctattctcacagcctcctcctttgtcrtcatgtttgaacttctcacttgcctgattcagctttgccaccttcttaagctgtaaaaccgcaaacaaaaggtcatcacatgagatagtttaagggcatatttgccaggaaactgaccaaagctgacctaatctgttaggcctcagtgttctcatttgtaaaataggatcataatagtatccacccctctaagttgtgctgaggacccaagggcagagcatttggcacacagtaggtgcataattgcttaaagagggatgtccacaatagtactgatatcatgcctttctgggttgttaa

SEQ ID NO: 33046 - DNA, 601 bp, Human
ctaaaaaaaattctgaattacaaaacacatctgatctcaggggtttaggcaaaagattgctgacatgtgactatatttgctcttctcatttggtcctccatttggttttggtcttatatgtttagtaattacagaggatcatggcctattagaacaagaaagggcctcagagaacatctgtcctagaggttcttaatcaggaatgggtgtcagattctaatgggtaacacctgggtacccgtgggttttttgtctgttttttgggggtttttctttttttgagacagggtcttactctgtwgcccaggctggagtgcagtggtgcgatctcagctcactgcaacctctgcctcccaggttcaagtgattctcatgccttagcctcccaagtagctgggattacaggtgcacaccaccacacccagctaatttttgtatttttagtagagatgaggtttcaccttgttggccaggctggtctcaaactcctgacctcaagtgatcctcctgcctcggcctgccaaagtgctgggattacaggcatgagccactgcgcctggccagcaactgtgtttttacaaagctcctggtgtctctgacc

SEQ ID NO: 33047 - DNA, 601 bp, Human
cttggcttcaacctggaaaaatcaagacaacggacaaatgcctttctgtgatgtgccaacgtaccttctcctgagttcgaagacggcttcctgggcttatagactggaggtcttcccctctgcatttggggcagatctgatcctcgccattcctggggaaacatggacaaagccttggagagaggcactacagctccctgcaccatccactctcctgacagctccagaagcctcaactatcagcagggtggtgatcatgtacgtccacaatcccagagccacagttcctaaatcgcaaaastgccgagtatcccacattttttggtagtttgcagtgagcttcctgggctgccaaacctgccgtgactgcactgaccggaagctattatagcccttacttgccccacttagtgtgaatatatacatgtttcattgcagaaacattaatgtgcttgattacagggcactgccgcattccctgccacaattacatgatgccctgatttgcttttctaaaaaaaattctgaattacaaaacacatctgatctcaggggtttaggcaaaagattgctgacatgtgactatatttgctcttctcat

SEQ ID NO: 33048 - DNA, 601 bp, Human
atgcataggacagacgcaatctcagagtaaaagtttggttttataaatggaaagaatttagtttacataaactgatttatagaattgccttatttttatcattttgtcatgagctggtgggaatggatcagttctggatagcatgtgggaacctctgagcaggacatgtaacctatgagggtccttccagcttgggagggccagggttctaaattgtagctcctgaaaatgtctctctggcctatcacacttccaaatgtgtctcttattcctagaagcaccgtttgacagagctcaggasgtgagctgataatggtctctccccacctaaaggcaaacagaggcagacagaaccatctagatgaggagtttgctaaccttttttatgtaaaggggtggatagtaaatattttgggctatgaagtctttgttgcaagtactcaattttacataattttcatgtgtcccaaaatatctttttttgtttttttgagacagggtctcattctgctacccaggctggagtgtagtggcacgatcatggttcactgcagcctcgacctccccaggctcaggcgactctcctacctcagcctccaga

SEQ ID NO: 33049 - DNA, 601 bp, Human
cattggattaggagatattaaaatatctatgtgatctaagatttacacaataaatgtgtattaattttgttaagaggaaagaataaaacaagctaaaaacaacagtcctagagcattcaagcaggtaagggccttttgcaagtgaggcatagtggctcacagagttgagggtctgcttgtgtctcacagccgatccaccaagagccaaacagtgaggctcagggagttactccacggagcagcatatcatattaactcttaccacgttgcagagtgtaaagttccaagaacatgcatttgktccttactcttactctctgagggcctgccgatggagaggttgctgagaagcagatgggagagtgctcaaaaccagctctgggtgggacaggaaattcccctgaactctctgaatgagagggaccagctcagagaaaggagaaggaggtgtggacactcgcctgcctctggtccagcggtagggggatagctgccctgccagcactgctatcacggtctggacatcacagatcctggaaaggccttgcagagctgacttaatatcctcattttacagatacagaaacagggcctgggaatt

SEQ ID NO: 33050 - DNA, 601 bp, Human
tgctcccaaatacaggcagcttcctctcccatcctgtagcctgttagggtgcctataattctaccatgaattatagtgccttcacttggcttaaggcagcaagtttcaaactgtgctctgcagggccctaggagtccccagaacctcttaggggctcggataggagaaagaaatggggcaattaacaggtcggggctccaggatccccctccatcagaatgcttttactttcatctgattgaaaaagatgaaaaaaagccattggattaggagatattaaaatatctatgtgatctaagayttacacaataaatgtgtattaattttgttaagaggaaagaataaaacaagctaaaaacaacagtcctagagcattcaagcaggtaagggccttttgcaagtgaggcatagtggctcacagagttgagggtctgcttgtgtctcacagccgatccaccaagagccaaacagtgaggctcagggagttactccacggagcagcatatcatattaactcttaccacgttgcagagtgtaaagttccaagaacatgcatttggtccttactcttactctctgagggcctgccgatggagaggtt

SEQ ID NO: 33051 - DNA, 601 bp, Human
gtaggtgatcagaccatgacttaccgcccctccccaccccagcttttcaccagaagtccatgactccacgaggtggggaagccagcagggaggggagggggctgatgcctctcagaggtctgcccgcattaaagaaggcttctttgctcccaaatacaggcagcttcctctcccatcctgtagcctgttagggtgcctataattctaccatgaattatagtgccttcacttggcttaaggcagcaagtttcaaactgtgctctgcagggccctaggagtccccagaacctcttaggggctsggataggagaaagaaatggggcaattaacaggtcggggctccaggatccccctccatcagaatgcttttactttcatctgattgaaaaagatgaaaaaaagccattggattaggagatattaaaatatctatgtgatctaagatttacacaataaatgtgtattaattttgttaagaggaaagaataaaacaagctaaaaacaacagtcctagagcattcaagcaggtaagggccttttgcaagtgaggcatagtggctcacagagttgagggtctgcttgtgtctcacagccgatccac

SEQ ID NO: 33052 - DNA, 601 bp, Human
gtggctttgtgtaggtgatcagaccatgacttaccgcccctccccaccccagcttttcaccagaagtccatgactccacgaggtggggaagccagcagggaggggagggggctgatgcctctcagaggtctgcccgcattaaagaaggcttctttgctcccaaatacaggcagcttcctctcccatcctgtagcctgttagggtgcctataattctaccatgaattatagtgccttcacttggcttaaggcagcaagtttcaaactgtgctctgcagggccctaggagtccccagaacctyttaggggctcggataggagaaagaaatggggcaattaacaggtcggggctccaggatccccctccatcagaatgcttttactttcatctgattgaaaaagatgaaaaaaagccattggattaggagatattaaaatatctatgtgatctaagatttacacaataaatgtgtattaattttgttaagaggaaagaataaaacaagctaaaaacaacagtcctagagcattcaagcaggtaagggccttttgcaagtgaggcatagtggctcacagagttgagggtctgcttgtgtctcaca

SEQ ID NO: 33053 - DNA, 601 bp, Human
ggggtgggagaaacaatcccatttgctgatcctcagcagacaggactgaagattatctccagccccctggcatcccctccttcactgtcacttctacaggaagatcacgccaggcaagtatcaagtctctaactaggtcaacattaatcctctaatatctgcttcttacattaggtaatcagtccatggctctgggcacttctttgggagataatcatctaatgaagtcacaggctggggacaaactgataagcagatggcatgggaagtgtttgcaaggagggctggtcctcagccctcyaccctgcctccatttcccaggttgccccagatgtgcaggcaaacttaggaattaccacacatgcaaagtggtgacttatcatcagccactttcctttggtcaaaagtcccccaaagttcccactggggcaaaagtcagaggagtccctggtccttcccctatgtggctttgtgtaggtgatcagaccatgacttaccgcccctccccaccccagcttttcaccagaagtccatgactccacgaggtggggaagccagcagggaggggagggggctgatgcctctcagaggtctgcccgca

SEQ ID NO: 33054 - DNA, 601 bp, Human
gctccgtcctccccaccatagtgtccttgcctggggtggcctcactcaaaggccagggaccgaggggacaggagagggaatcaggaatcagactgcattgcaggagaagaacagaggatctgtcctgggccaaccctgtctggtgtcacaagtggcccctgtgtgagtggcctcactgcttgcaaattgctaaaaataaagtgtgcagtggaatttcctccgaggaggagacagaaacagagaaaacagattcccagccctgagggaacactcgttcttctgtctgggtctgaggagtctytgcgtgtgtggtgtttccggccaccctggctacccaggccctttgtggtggggtcacagtgggccctagcggggggccccattctgagacctggggcctccgggaatgtgactgttaagagggtgctgggagcatgagtgccacctctgcagcccctgcacagaacaaagaggatctgagcaggccaggcactgcctacccccacactgggctgaggtcagggatgcccggaggggctgctgtgactcaggtctcagctggtgctgagggggtgctctacagtcacatggggagcttggt

SEQ ID NO: 33055 - DNA, 601 bp, Human
ccataggatccctgtgacaatcatctgaggcaggtggggctgtattagagtcaccttaacacaggcagaaacagagggaatggcttaaggtcatgctgagcttgtgagcagaggagctgggcacacctgtgcattctctctcacagttgtgagcccctgcatgggcttgctgctctcctggcactcatgtagacactgtcccatcagatcctcacagccatgagggggaggttggggctctgaggttctgcttccctcgggtaggtggagaagccgaagcccaggggcgatcagtgacttscaggaggcaacggggcaggcgaggggagcccaggagcctggagtccgtgtgcaggctccgtcctccccaccatagtgtccttgcctggggtggcctcactcaaaggccagggaccgaggggacaggagagggaatcaggaatcagactgcattgcaggagaagaacagaggatctgtcctgggccaaccctgtctggtgtcacaagtggcccctgtgtgagtggcctcactgcttgcaaattgctaaaaataaagtgtgcagtggaatttcctccgaggaggagacagaaacagagaaaa

SEQ ID NO: 33056 - DNA, 601 bp, Human
tacatgtatctcatttaatcctcacatcacaaactctttaacaatgaactctctaaaactccattttcccactggatttcctcaaggtggtgaggaacattcctaaatgaacaggaccaaaatatgtttgaatgttgtcccataggatccctgtgacaatcatctgaggcaggtggggctgtattagagtcaccttaacacaggcagaaacagagggaatggcttaaggtcatgctgagcttgtgagcagaggagctgggcacacctgtgcattctctctcacagttgtgagcccctgcaygggcttgctgctctcctggcactcatgtagacactgtcccatcagatcctcacagccatgagggggaggttggggctctgaggttctgcttccctcgggtaggtggagaagccgaagcccaggggcgatcagtgacttgcaggaggcaacggggcaggcgaggggagcccaggagcctggagtccgtgtgcaggctccgtcctccccaccatagtgtccttgcctggggtggcctcactcaaaggccagggaccgaggggacaggagagggaatcaggaatcagactgcattgcaggaga

SEQ ID NO: 33057 - DNA, 601 bp, Human
gcactggtattagttacccattgctgctgtaacaaaataccacaaacttaacagcttaaaacaacacagctttattatcgtacagttctggaggccaggggtcctaacatggaaatgtcagcaggactgcgttgctcctggaggcccaaggggaggatggcttcctcccttccccagcttctcagggctgcctgcactccttggcttgtggtcccttcctccatcttcaaagccagcagtggagcatctccccttctctctgaccctcatctccctcttctgaggacacttgggcctcctrgataatccaaggtcacctccccatctcagaatccttcatttaatcgtgtctgcagagtctgttttgccattgttatgggctcagcaacccccacccaaatcagatgttgaagtcctaaccaccagtatctcagaatatggagacagggcctttaaagagctaattaaattaaaatgaggtcattgggggtgggccctaatgcaatgtgactggtatccttttaggaaggggaaatttgaagaaggaccacatgaagacatagggaggggacagccatgtcaaggcaaagagagaggcctt

SEQ ID NO: 33058 - DNA, 601 bp, Human
atttttttttgagagaataatctcatggaaccacgtgaaaggggatttggacgaaagcaggagaggacagaggtctttcggactgagcaaatacaaaaagtcacactagttattattctttaaaagtaacataaccagagagctgtgggcttaatgagtacagttgggttgagacacagaacacagcccagcaaaggccaccctgcccccacccccacccaccaactgcccagggcttcagggacaagttgttcccaataaataatagaaaacagatgttctatggaaggcaggcagaggscggccttggcagggagaccgtgctggcttcgggaagtctgtggtgatgaaacctccccaaacatgtagcttttgacatgtgagaacagtggagggaagatgctatgtgtagacctggctccttggtgaatatacctgggggagcctttcaggtcccacccctccccacaggtccatgattccaatagtctgtggttctaagggtcaaagcttggtgggagagtcataaaagagataagaacatgaaaatgatcaagctaagagtgaaattccagacatcaccccgcaggtggaggggatg

SEQ ID NO: 33059 - DNA, 601 bp, Human
gccaggctcagtggctcaacacctgtaagctcaacactttgggaggctgaggcaagaggattacttgaggccaggagttcaagacagcctgggcaacataatgagacctcatctctacttaaaaaaattttttaattagcagtcttggtggcgtacacctatagtcccagctacttgggaggctgaggtgggaggatcgcttgagcccaggggttcaaggctgcactgagctatgatcacatcactgtactccagcctgggtagcagagaaagaccttgtctctcttaaaaaaaataaatraataatgaacagatacaatctatgaaagtatcttataaagttaaatcatacttataaaataatttacttataaaccatacttataaagttaccatacaatccacacatttcactcctaggaatttacctaagagaaagtaaaacatatgtctgcacaaaggtgtgtatgtgaatgttcatggcggctttgttcaaagcaacccaaatgtgtcatcagctggtgagtgggtaaacaaattggtctatatatactacagaacaaccaaatggaattaaataccagcataaataataacatgg

SEQ ID NO: 33060 - DNA, 601 bp, Human
catccagatgagtggactgatgttacgggaaaatcatggaggggctgcagtggggagacctggaggtctggaaccatagtggatagatctcctttctcacactcagatgcttaccttgaaggagcagccgacacctgcaaaggggcacccaattccagcctcagccacctcggggtgagcctggaaataataatcacatcactgaatgttatagcgatccctgtggctaccctggggctctcttcaatgcaccaggatccaccagggcaggagatggcttgggccacatgactttgcacaytgctgttccctttggctatctcctttccaccctttaagcttccacccttccatgaccttccttcaaaacaggacctgggcccttactgtgatcctgggcagcactgctatttctcctgtcagggcacagtccacacagctccgtaatcatcactcactctctggttgccccgactggtcgggggggctctgtgagggccatggctgtgttcccagtgctgagggcagtgcctggcacagctgagacactcagaacacactgactgcatgagtaaatgcctccctcctcctgaagttcatg

SEQ ID NO: 33061 - DNA, 601 bp, Human
acatgcccacgatgagccacatgcattgcagcttctaattctgccctgccctggagtgcaaggatgattcaggaccatggagaggggcattgggggtgggggtcattttagtgatgttctgcctatgcttaggtaagacattaggaagaacttccctgagtactgtgatgacttaatagtaggctctgatgcttgggaaagtcattagtacaaaggacatccagatgagtggactgatgttacgggaaaatcatggaggggctgcagtggggagacctggaggtctggaaccatagtggayagatctcctttctcacactcagatgcttaccttgaaggagcagccgacacctgcaaaggggcacccaattccagcctcagccacctcggggtgagcctggaaataataatcacatcactgaatgttatagcgatccctgtggctaccctggggctctcttcaatgcaccaggatccaccagggcaggagatggcttgggccacatgactttgcacactgctgttccctttggctatctcctttccaccctttaagcttccacccttccatgaccttccttcaaaacaggacctgggccct

SEQ ID NO: 33062 - DNA, 601 bp, Human
ctctgtgcccctgggaggtgttacctggggagaagaggctgacggtcctgccacaggccgactcatggcaccgcctggtgacattggtgatcttccacaggaaagtgccatcgaaggaggcctcctccatgaggcgcaagctctgctccagcttgcccagggcctggtctttctgggccagggtctgctgaagctccaccacctgtagggaagactgttcagccaggaacaccagaacccggcttggggatgggatgggaatggcgggatgtggagattgatctgccccagatgtgttttsctgaccacgcctcactcaggtgtgcgtctgcatctgaatgtgctgccccctgcctggccttccttttccttatccaccaggaatccagctcatatggcccctcatctgggaagccttcaaccactgtcctagcttagctgctctctttcaatatgttcttacagagcccttacaatgatttcatgagacatatttttctggcttccctaccagatggtctcctccaccgaaagctgggcccatgctcattgtgtctttgtgtccatgccttgcatagtacctggtatgtaaaagtagagc

SEQ ID NO: 33063 - DNA, 601 bp, Human
ccattacgttttggtagaacaggaagcacgaggtactgcttgctttttccctctttgaaaagaattgagggaaaaaggtctacaagtagggctcgaggccaccccatgaagagagctgtcccaacacagtgggatgagcgctactcctgcaggaaaggagtcccagccctgctctgggattgtgacacactccgctgcctcgttaaaaaaaaattgttttttgagagggtcttgctttgttgcctggactggagttcagtggcaccatcatagctcactgcagactcaaactccttaagcyatcctcccatctcagcctctcaagtagctaggaccacaggtgcaggccaccatgcctggctaatttaaaaaaaattttgtggagatgggatcttgttacgttgcccaggctggtcttgaactcctggcctcaaatgatcctcttgcctcagcctcccaaagtgttaggattatagacatgagccactgcacgcagtctgctgcctcattttttgcacaaatatatgcactgttatattaacagatatcatttagttaagagaaacacttgccaagtaattactttatgcaagacattgtg

SEQ ID NO: 33064 - DNA, 601 bp, Human
catcatactcccctctcatgatcacgatgaagagcgacagatgggttctctttccagtgccatctccattcaggtacagccgcaggcacaacttgtagccatacttggcagtgtagaaggctgaaacgcagaagccagaggcagttgggaagtgctggactttgcagatgtgggactgggatccagtggtcaggcatgcccaaggtcagcggctcaaaaccatgaaagatggggttagaacccagcattcttctcgagtagggtgtcagacaggaatgggctcttgggggtcatctagctyagtgtttgtcagctggccatccaagtcatacactgccgggccccaccctcagagtttctcactcagtgaccctggggtgagaactgagagttggcacttccagcaagtttgcaggggttgccaatgccactggtcctaggaccacactctgagaaccactgatctaaccaacctatgttttacagtctggaaaccaagctgagaaaaacaaagtggctggtcaccatctcacggtatgttggggacccagcaagaatgaggggccaggcttcctgcctcccagcagcagtttctttctgc

SEQ ID NO: 33065 - DNA, 601 bp, Human
gagtacagtggcgcgatctcagctcactgcaacctccacctcctgagttcaagcgattctcgtgcctcagcctccagagtagatgggattacaggcacacatcacaatgcccagctaattttttgtattttttgtagagacagggtttcgttatggctggcctcgaactcctgggctcaagcgctccacctgcctcggcctcccaaagtgctgatattacaggcgagagcctctgtgcccggcctatcttcatagctttggcttttccagaatgtcatatagttggaagcattcagaacayagtcttttcaaattgacttcttttacttagtaatatgtgtttaagtttcctccctgtattttcatggcttgatagctcatttctttttagcactgaataatattccactgtctggatgcaccacagtttatttatccatccacctactgaaggacatcttggttgcttccaagttttggcaattatgactaaagctgctatagacatccttgtgcaggtttttgtgtaacataagttttcaactcctctaagtaaactcctttgagtccaaggagagcaactggctatatcgtttggtaa

SEQ ID NO: 33066 - DNA, 601 bp, Human
acaattgatgaagctgcattgacacataattatcacccagagtccacagtttacattggcatttactcttggtatttcactttctatgggttttgacaaatgcataaggacatgtatccaccataacagtatcaaacagaatagtttcactgctcccaaaatcccctgtgctctattcatctctcccggcacctactcttggacaatcactgatcttactgtctccatagcttttgtttttgtttttgtttttgttttgagaccaagtctcactccgtcccccaggctggagtacagtggygcgatctcagctcactgcaacctccacctcctgagttcaagcgattctcgtgcctcagcctccagagtagatgggattacaggcacacatcacaatgcccagctaattttttgtattttttgtagagacagggtttcgttatggctggcctcgaactcctgggctcaagcgctccacctgcctcggcctcccaaagtgctgatattacaggcgagagcctctgtgcccggcctatcttcatagctttggcttttccagaatgtcatatagttggaagcattcagaacatagtcttttcaa

SEQ ID NO: 33067 - DNA, 601 bp, Human
ttcaagcgattctcctgactcagcctcccaagtaactgggattacaggcatgtaccactatgcccagataattttttgtatttagtagagacagggtttcaccatgttggtcaggctgatcttgaactgctgacctcaggtgatccacccacctcggccttccaaagtgccagaattacaggcgtgcgccaccatacccggcaaagaatttttaatagattgtattttttagagcagttttaggttcacagcaaaactgattagaaaatacagagttcccatatacctcctgcccccaccyagtgcacaacctcccccactatcaacatccccaccagagtggtagttttgtaacaattgatgaagctgcattgacacataattatcacccagagtccacagtttacattggcatttactcttggtatttcactttctatgggttttgacaaatgcataaggacatgtatccaccataacagtatcaaacagaatagtttcactgctcccaaaatcccctgtgctctattcatctctcccggcacctactcttggacaatcactgatcttactgtctccatagcttttgtttttgtttttg

SEQ ID NO: 33068 - DNA, 601 bp, Human
acacagcacagacggaggttcccctgagaagccgattgtctaaaagtgacacaaaccctcttccctggcacatgcccctgaaatgtccatcaggaagctgaatggcttcccgttgccaactgaagcatcctcaccctgcacattaggaccccctgcggagacttcatcctgatgctcaggccttatcacttacgggggtgagattctgtcactggtgttttaaaaatctccccagcacctttgggaactgccgggggtaggagaacctactgactcacatccagaccaaagcggcacaccygccctgccccacctgtttccccagacctgaggtctctattcttgacaccctcccctcatgcaatgctgctgttcacccacaggaaatgcctatcccccaaacccctctataagaattatggtgtgtttttttttttttttttttttttgagacagagtttcgctcttgttgtccaggctggagtgcaatggcacaatcttggctaactgcaacctctgcctcctgggttcaagcgattctcctgactcagcctcccaagtaactgggattacaggcatgtaccactatgcccagataatt

SEQ ID NO: 33069 - DNA, 601 bp, Human
gggctgtcatcgatgtcctgagacatttgtggagcttctggtatacacagcacagacggaggttcccctgagaagccgattgtctaaaagtgacacaaaccctcttccctggcacatgcccctgaaatgtccatcaggaagctgaatggcttcccgttgccaactgaagcatcctcaccctgcacattaggaccccctgcggagacttcatcctgatgctcaggccttatcacttacgggggtgagattctgtcactggtgttttaaaaatctccccagcacctttgggaactgccgggggtaggagaacctactgactcacatccagaccaaagcggcacacctgccctgccccacctgtttccccagacctgaggtctctattcttgacaccctcccctcatgcaatgctgctgttcacccacaggaaatgcctatcccccaaacccctctataagaattatggtgtgtttttttttttttttttttttttgagacagagtttcgctcttgttgtccaggctggagtgcaatggcacaatcttggctaactgcaacctctgcctcctgggttcaagcgattctcctgactcagcctccc

SEQ ID NO: 33070 - DNA, 601 bp, Human
ttggaaagttttgcttcatcaactacagctggaacctcctggggcaaggcagaagggccagaacagagaggtcttctactgaggggctgtcatcgatgtcctgagacatttgtggagcttctggtatacacagcacagacggaggttcccctgagaagccgattgtctaaaagtgacacaaaccctcttccctggcacatgcccctgaaatgtccatcaggaagctgaatggcttcccgttgccaactgaagcatcctcaccctgcacattaggaccccctgcggagacttcatcctgatkctcaggccttatcacttacgggggtgagattctgtcactggtgttttaaaaatctccccagcacctttgggaactgccgggggtaggagaacctactgactcacatccagaccaaagcggcacacctgccctgccccacctgtttccccagacctgaggtctctattcttgacaccctcccctcatgcaatgctgctgttcacccacaggaaatgcctatcccccaaacccctctataagaattatggtgtgtttttttttttttttttttttttgagacagagtttcgctcttgttgtc

SEQ ID NO: 33071 - DNA, 601 bp, Human
ttcaggggctgttccatgatgaggatcagatgttccctccagccagcaggaagcaggggaaggttctgatgccccagtcaagtgtgactggctgttgggggcagagggtgtgactgaagcactgacaaggtgggtggaggcaataacctgtaacaccccctctggcttggaaagttttgcttcatcaactacagctggaacctcctggggcaaggcagaagggccagaacagagaggtcttctactgaggggctgtcatcgatgtcctgagacatttgtggagcttctggtatacacagcrcagacggaggttcccctgagaagccgattgtctaaaagtgacacaaaccctcttccctggcacatgcccctgaaatgtccatcaggaagctgaatggcttcccgttgccaactgaagcatcctcaccctgcacattaggaccccctgcggagacttcatcctgatgctcaggccttatcacttacgggggtgagattctgtcactggtgttttaaaaatctccccagcacctttgggaactgccgggggtaggagaacctactgactcacatccagaccaaagcggcacacctgccctgc

SEQ ID NO: 33072 - DNA, 601 bp, Human
cctgcagggaagggataggtgggagatcaggccctacagcagcagcgcagcttggaggcccaggcttgggctcagagctgtgctccacacctactgcctgtgcagcccctcagacccttggctcatttggattaggagtcagagaaaccaagtaaggagcgcacctggcgtatggccagacccagggagccagcggcacctggtattctgagtgcacttcaggggctgttccatgatgaggatcagatgttccctccagccagcaggaagcaggggaaggttctgatgccccagtcaagtstgactggctgttgggggcagagggtgtgactgaagcactgacaaggtgggtggaggcaataacctgtaacaccccctctggcttggaaagttttgcttcatcaactacagctggaacctcctggggcaaggcagaagggccagaacagagaggtcttctactgaggggctgtcatcgatgtcctgagacatttgtggagcttctggtatacacagcacagacggaggttcccctgagaagccgattgtctaaaagtgacacaaaccctcttccctggcacatgcccctgaaatgtccatc

SEQ ID NO: 33073 - DNA, 601 bp, Human
gtgacgtggtgtttagctgatggaggcacaggatgtgggggctgggtgtgctcctgcgtgttggggaagctgagctgccaggcccagggtggcaggtgccctgtggaccaggtcagtccagtgggggttactgaaggtgagtgaggagctgggaggacaggaagctcctgaatgtttccagaacccctgtagctctaggactcacctgggccaggaggcctagaatgagagactttctgggctggaaggaaacttaaaagtcttcaaatccaacccccaatttgaagtcctagtggagccstctgggtttgcttgttcacctccaatgacgagcctggacagactgcattcaaactggcaccccatcccttccacccggtcctgtttctgaccctggagaaaaagagagcaggcctgtgtccaggtctccctggcggccctgcagagatcttcctagcccgagagcttctctgcttgggtcctacggttccaagcctggttccattttcttctcatttggtgagagtccacctcaacattcggggccggagtggctcactggcctcccagtgtcgcatggtccgtgcagaggggagcagct

SEQ ID NO: 33074 - DNA, 601 bp, Human
tcctctagaagtatgagcagccatagcatccctcctttttaattaacaaaaataacaggggcaaaaataacagcagcgctcgctgaccaagcgccagcatctatctgccaggcgcatgctaaatgctgcactcttctatcgccgtccctgttaacagagttcaggaaacgaaggctcagcaagaactttagtccaacagctcttagctgccacagccaagacttgattcccatccgattcagaggcagagctctgaaccagtgctctcgcatgcaccgaaacgcaaacgctagcattagartctcgctatacaaaaatcttttccctttggccgggtgcggtggctcccgcctgcaatcccagcactttgggaggccaaggcgggcggatcacctgaggccagaagtttgagaccagtccggccaatacagtgaaaccctgtcaatactaaaaatacaaaaattagccgggcgtggtggtgtacacctgtaatcgcaactaccgaggaggctgggcacgaaaatcgcttgaatctgggaggcagaggttgcagtgagccaagatcatgccacagcactccagcctgggtgacagagcaagg

SEQ ID NO: 33075 - DNA, 601 bp, Human
aaggctttggtaaatacagtcctctagaagtatgagcagccatagcatccctcctttttaattaacaaaaataacaggggcaaaaataacagcagcgctcgctgaccaagcgccagcatctatctgccaggcgcatgctaaatgctgcactcttctatcgccgtccctgttaacagagttcaggaaacgaaggctcagcaagaactttagtccaacagctcttagctgccacagccaagacttgattcccatccgattcagaggcagagctctgaaccagtgctctcgcatgcaccgaaaygcaaacgctagcattagaatctcgctatacaaaaatcttttccctttggccgggtgcggtggctcccgcctgcaatcccagcactttgggaggccaaggcgggcggatcacctgaggccagaagtttgagaccagtccggccaatacagtgaaaccctgtcaatactaaaaatacaaaaattagccgggcgtggtggtgtacacctgtaatcgcaactaccgaggaggctgggcacgaaaatcgcttgaatctgggaggcagaggttgcagtgagccaagatcatgccacagcactccag

SEQ ID NO: 33076 - DNA, 601 bp, Human
atctcaagaaaaaaaaaaattacatcacaaggctttggtaaatacagtcctctagaagtatgagcagccatagcatccctcctttttaattaacaaaaataacaggggcaaaaataacagcagcgctcgctgaccaagcgccagcatctatctgccaggcgcatgctaaatgctgcactcttctatcgccgtccctgttaacagagttcaggaaacgaaggctcagcaagaactttagtccaacagctcttagctgccacagccaagacttgattcccatccgattcagaggcagagctcygaaccagtgctctcgcatgcaccgaaacgcaaacgctagcattagaatctcgctatacaaaaatcttttccctttggccgggtgcggtggctcccgcctgcaatcccagcactttgggaggccaaggcgggcggatcacctgaggccagaagtttgagaccagtccggccaatacagtgaaaccctgtcaatactaaaaatacaaaaattagccgggcgtggtggtgtacacctgtaatcgcaactaccgaggaggctgggcacgaaaatcgcttgaatctgggaggcagaggttgcagt

SEQ ID NO: 33077 - DNA, 601 bp, Human
cgggcgtggtgacgcatgcctgtaatcccagctactcgggaggctgaggcaggagaattccttgaagccgggaggcggaggttgcggtgagctgagatcgcgccattgcactgtagcctgggcaacaagagcgaaactccatctcaagaaaaaaaaaaattacatcacaaggctttggtaaatacagtcctctagaagtatgagcagccatagcatccctcctttttaattaacaaaaataacaggggcaaaaataacagcagcgctcgctgaccaagcgccagcatctatctgccaggcrcatgctaaatgctgcactcttctatcgccgtccctgttaacagagttcaggaaacgaaggctcagcaagaactttagtccaacagctcttagctgccacagccaagacttgattcccatccgattcagaggcagagctctgaaccagtgctctcgcatgcaccgaaacgcaaacgctagcattagaatctcgctatacaaaaatcttttccctttggccgggtgcggtggctcccgcctgcaatcccagcactttgggaggccaaggcgggcggatcacctgaggccagaagtttgagac

SEQ ID NO: 33078 - DNA, 601 bp, Human
aatacaaaattagccgggcgtggtgacgcatgcctgtaatcccagctactcgggaggctgaggcaggagaattccttgaagccgggaggcggaggttgcggtgagctgagatcgcgccattgcactgtagcctgggcaacaagagcgaaactccatctcaagaaaaaaaaaaattacatcacaaggctttggtaaatacagtcctctagaagtatgagcagccatagcatccctcctttttaattaacaaaaataacaggggcaaaaataacagcagcgctcgctgaccaagcgccagcakctatctgccaggcgcatgctaaatgctgcactcttctatcgccgtccctgttaacagagttcaggaaacgaaggctcagcaagaactttagtccaacagctcttagctgccacagccaagacttgattcccatccgattcagaggcagagctctgaaccagtgctctcgcatgcaccgaaacgcaaacgctagcattagaatctcgctatacaaaaatcttttccctttggccgggtgcggtggctcccgcctgcaatcccagcactttgggaggccaaggcgggcggatcacctgaggc

SEQ ID NO: 33079 - DNA, 601 bp, Human
cctgcagaagggttggctgccactgtttaccaaacttccacacggcacagtggtagtcagagcggacggccagcagagctgaggagggatggaaagggccaggggtcaggtagcaggtcagccagtgagggaggaaagtgtatataagggccttactttctccctggacggtgcatgtcaccacttgccggacaggtccctggagctggatgcgtccaggtttcccaaggaattggggattgtcacctggggtcagaacgacctcttggaaatctgggcctctcactaaggatcagtgcaygagctatgatcactgcaagccccccaaattcctgcccttctctggaccatgccaagagcacctcctctaccagaggcgagcccgctggaatctcctgtctcgcaagaaaggatacgcagcctgtcctgggcgcctccagcagggtagaccagctgcccgaactggggtgtccttccaggaacccaggccagcgcgcccccagtgcaggcctcatccagaagcagctgctcccaccgcagcaccagctcctcgtgcagcagctctgccaagtggctcgccaccgacgtgcccaggatgggg

SEQ ID NO: 33080 - DNA, 601 bp, Human
gtgggcagggggacaggctgatggggaaggggctcaagggtcgcgacatgctcaacagggcggagttcagttcgttagggtggggggtttcacaggaagcggcgatacccatcctcagggctccacaggcagacggctcccgagcggctgcagatggccagctccccgggcaggtgagggctacagggcaggaatgcattcacatcgggctgctcagccctgcctccagcccctcctcaccgaccaacctgacccccctcacctgaggctgatccccgtggcccctttctccacctgcatygcctgcagaagggttggctgccactgtttaccaaacttccacacggcacagtggtagtcagagcggacggccagcagagctgaggagggatggaaagggccaggggtcaggtagcaggtcagccagtgagggaggaaagtgtatataagggccttactttctccctggacggtgcatgtcaccacttgccggacaggtccctggagctggatgcgtccaggtttcccaaggaattggggattgtcacctggggtcagaacgacctcttggaaatctgggcctctcactaaggatcagtgc

SEQ ID NO: 33081 - DNA, 601 bp, Human
acgaagaggagtcccggaacacgagggtctcagggtccctgtagatttgccgcagccttggggagacaggcaagccgtgggcagggggacaggctgatggggaaggggctcaagggtcgcgacatgctcaacagggcggagttcagttcgttagggtggggggtttcacaggaagcggcgatacccatcctcagggctccacaggcagacggctcccgagcggctgcagatggccagctccccgggcaggtgagggctacagggcaggaatgcattcacatcgggctgctcagccctgccyccagcccctcctcaccgaccaacctgacccccctcacctgaggctgatccccgtggcccctttctccacctgcattgcctgcagaagggttggctgccactgtttaccaaacttccacacggcacagtggtagtcagagcggacggccagcagagctgaggagggatggaaagggccaggggtcaggtagcaggtcagccagtgagggaggaaagtgtatataagggccttactttctccctggacggtgcatgtcaccacttgccggacaggtccctggagctggatgcgtccaggttt

SEQ ID NO: 33082 - DNA, 601 bp, Human
tggtttgctgggtggttgtctgggcccagcagagccgctggtaagcagcagcctctagtgaccatctgagacagagcagaggtggggcggggcggtgttgtgtgccactcacctgggtacagacgagatgaagagtaggggggaggcatttggggctggagtgccccaggtactgggtaagcaggacacgttcccctttctggcacgaagcctctgcccccaaacgaaaaagcaacagaccacagcccggcgggccctggaagataaacacagggtcagccctccccacagtcccaggccsgtgacgctgtcctcgcccaggccgcagccagcctgggactcaccgctctgcggccgctcccgcagtcggggtgggtcctctgccgccagcccgtacctgagtgtccagcatcttcactccggtgcggtcacccacggtcagcacccgagggtgcgcagtgaagtctgcccaacgccacgaagaggagtcccggaacacgagggtctcagggtccctgtagatttgccgcagccttggggagacaggcaagccgtgggcagggggacaggctgatggggaaggggctcaagggtcgcgaca

SEQ ID NO: 33083 - DNA, 601 bp, Human
aggcggggcaccgacgccccttctcctgaggaaggacagacagctgaggccctgtccaggccccgaccgccccatctcccacacgccgcccaccctggcctggaccctcacctgccaggtgcagcagctgcagctgcccaccctggcctccgaggagcaggggctgcacgcagctgggccggggcggaggcagcagtcgggccagcaggagcggggaggggaggccatggttccacttcagcatcggcaccaggggaaggcgctcgtccactaggtagagagagaactggggcccgagaargaagggggatgtggccgaacttgggagctgagctgtgtagtggccctccaggccccatgtggctctccaggtgagtgcagagccctgaggggcagcagcatctcccatcagcctccacgtgcctctcagacttcacctgccagccctgaacaggtgccgcttccttcaccaattctgaccgacagtccggtggacagacagaacaagtgggaaaggggtgctcagaagaggtgtgggggagccttgccagcagaaacctgcctggccttctcgcagccacccccactctcctgacccggg

SEQ ID NO: 33084 - DNA, 601 bp, Human
cagccagacctggtgacgggaatgacaatgacctccagggcctagcggggggaggggatgttttccactgcgccccccaagctcactcccccaccccagcacacctatggtcggtgctttcaggcgctcctgcagccgccactggatcttaggctccagcagaggaaatgcagggagggagtcgatcctggaaggaagagactggggggggcctgccaggcggggcaccgacgccccttctcctgaggaaggacagacagctgaggccctgtccaggccccgaccgccccatctcccacaygccgcccaccctggcctggaccctcacctgccaggtgcagcagctgcagctgcccaccctggcctccgaggagcaggggctgcacgcagctgggccggggcggaggcagcagtcgggccagcaggagcggggaggggaggccatggttccacttcagcatcggcaccaggggaaggcgctcgtccactaggtagagagagaactggggcccgagaaggaagggggatgtggccgaacttgggagctgagctgtgtagtggccctccaggccccatgtggctctccaggtgagtgcagagc

SEQ ID NO: 33085 - DNA, 601 bp, Human
tggccactcagggctatgaggggagctggtgtcctctgagggatccacatggccactgagcgaaaagctgctggacagctgggtccggcgcttgggccgcctggtctgtctcccgggctccgaggtcctgccctgctgcctctcccaccaggcagcccctcggcctgcccaggcttcccccaggcgctcactgagcttgtcctctaggcctgactcgggtgcagggggtggctctgccgcagggagggagcccaggtctctctgcagcaggagctgccctcgggccatggccttgcggagyacacccagccgctgcccttcctcttcctccctccgcagctctgtgctgcccagcatctggcggtgggtgaaggtgggtgctgtccacacaggaggagccaggggcacttttagcagggccttcagccactggctgcagccggcagtgtcctgggaggtccaggaagctgtgggggcatggcagtcaggttgggtgtcgccaggaggcccagcatctctgcggaggctggagtccacctgggggcggagctgctggtagaagacatctcccgccgccgagagctggaagagcaccaggcct

SEQ ID NO: 33086 - DNA, 601 bp, Human
cccccaaactgacatgaccgtgaccctctgctcagagggcactatcgacagcccacaggtgccagacccatgtcccaagggagaaggaacatcagccatcatctctctgcatgagctcagtgtcaggtagtagctgtggcgggacgctgtccagcctaaaaaacgtgaccattccaattcatcttcagctgccaagtgtatttagtccctgaacctggatccaaggcatctccctgtaggaaacatcagaccggggcagagattgacaaagcaacccacaacagcagctgccaacggccgytgtgcccacctcatcagcagctctgcaggggcctcactccaccctcaccaaacacgaggagccagcactcctggcccccattccactggacaggaaggcgtgagaactgagggacctgcctgaggcccccacagctgaggcgcagcggagccctgcctcccagcacagactaaaatcccagcaacacaggcccaccggcacctccagcctgccttgcgggatgatcttcaggcgaatatacaaaatacaaaagaaactactactgtattttgttgccctgtcccttcaacttggctccaa

SEQ ID NO: 33087 - DNA, 601 bp, Human
cattttccccacaggaaaacagaatcttccactgcagctagagaaactccgaggaagagggacttgatgctttagacatcaaaatgagaaggggagggaggaaagaaaggggggagtctgtgaggcacaacagagaattcccccaaactgacatgaccgtgaccctctgctcagagggcactatcgacagcccacaggtgccagacccatgtcccaagggagaaggaacatcagccatcatctctctgcatgagctcagtgtcaggtagtagctgtggcgggacgctgtccagcctaaaamacgtgaccattccaattcatcttcagctgccaagtgtatttagtccctgaacctggatccaaggcatctccctgtaggaaacatcagaccggggcagagattgacaaagcaacccacaacagcagctgccaacggccgctgtgcccacctcatcagcagctctgcaggggcctcactccaccctcaccaaacacgaggagccagcactcctggcccccattccactggacaggaaggcgtgagaactgagggacctgcctgaggcccccacagctgaggcgcagcggagccctgcctccc

SEQ ID NO: 33088 - DNA, 601 bp, Human
cctcggcctcccaaagtgctgggattacaggtatgagccaccacgcccagttgaggacactgaatttggcctggactgaaccccaaggctgcccccctgtccttgcagtcacagtgacagggagaaagcacaggtcacccttccttccacagtgccgactgagagcgccgccacacccccagagacgtgtgtcggagttgcccagcccagccaagctctgcccacgtgggacctcactgcattcccagcaccgaaagcatcatagttttccccagttatatgtagcataaatggtttaatyataaatgtctcccttaggcatgataaacattttaacacccacgcgagtcagtgtatgattgggctagctcctgtttgtgtgagtcacatgcaattcctttcaccagccaacctgaaaaaagacctttctcttactatgtcatcagaaaccagacagacccgggtccctgcaaaatctcaagtgagcattttccccacaggaaaacagaatcttccactgcagctagagaaactccgaggaagagggacttgatgctttagacatcaaaatgagaaggggagggaggaaagaaagggggga

SEQ ID NO: 33089 - DNA, 601 bp, Human
gctcactgcaacctccgcctcctgggctcaagtgattctcctgcctcagcctctggagtagctgggattacaggtgtgcgccaccacacctggctaatttttttgtatttttagtagagacggggtttcaccatgttggccaggctggtctcaaactcctgacctcaggtgatccacctgcctcagcctcccaaagtgctgggattacaggtgtgagccactgcccctgattcatttaaattcgaattcgttaaaacgaaataaacaactcagttgttcagttgcaccagcctcattttaygtgctcagtagtcagaagtggctggtgtctatggattggacagtgcagaggtagaatgttttcatagtcatagaaagttacactgggttggccaggcgcaatggctcacgcatataatcccagcaccctgagaggctgagtggggcagatcacttgaggccaggagtttgagaccagcctggccaacatggtgaaactccatctctactgaaaatacaaaaattagccaggcatggtgatgcatgcctgtggtcctagctattcgggaggccgaggcaggagaatcgcctgagcctggga

SEQ ID NO: 33090 - DNA, 601 bp, Human
acaactcagttgttcagttgcaccagcctcattttacgtgctcagtagtcagaagtggctggtgtctatggattggacagtgcagaggtagaatgttttcatagtcatagaaagttacactgggttggccaggcgcaatggctcacgcatataatcccagcaccctgagaggctgagtggggcagatcacttgaggccaggagtttgagaccagcctggccaacatggtgaaactccatctctactgaaaatacaaaaattagccaggcatggtgatgcatgcctgtggtcctagctattsgggaggccgaggcaggagaatcgcctgagcctgggaggcagaggttacagtgagccgaggtcgtgccactgcactccagcctaggtgacagagcaagactttgtctcaaaaaaaaaaaaaaaaagttctacttggcagcagtggtctagtgagtgtttcagagcctccttggaggagcacatgaccctatagttatcctagcagtgcgaacaagacaggctcccccgtccctgggccttttaagggtttcctgagggaccctatgggtgacaatgatatttgcttagcagtaacttaagt

SEQ ID NO: 33091 - DNA, 601 bp, Human
taatagtctacagtgttcccgcgcagaaagggaacagcaagcttttgttttcatcttagaagaaaatgaatgccctgtgttttaattttccagtagggaccctggaggacaggcttcctggccccacgccgcgtgcaccttcctaaccagagcgactccaggctggggctggcacaataggcaagattatggcccagagaggttacctgtcccaggccacgcagcacagaactgcgtttggaagccagactttatagctgccagcactacctgactcagatgaaaaccagcatttattagrcacaactgcctgccacaggcttcacagtcagggttttcctggtggggtaggtcagagacctgagatgctggtggtcttggttgtagggaccccctacattaaggcctctgggctatggggctgcagacctcgactctggggccatgaggatagccagctgcctgtatacccatatagggtgtcccagtttagagatctttttcctccaaccattgaatccccatacccaagcccagtggcactgtggaactgggctgcttgtccccaattctatagacgtggaaactggccacgcagagt

SEQ ID NO: 33092 - DNA, 601 bp, Human
ctgtatacccatatagggtgtcccagtttagagatctttttcctccaaccattgaatccccatacccaagcccagtggcactgtggaactgggctgcttgtccccaattctatagacgtggaaactggccacgcagagtggctcacgcctgtaatcccagcactttgggaggctgagacgggcagatcacctgaggtcaggagtttgagaccagcctggccaacatggtgaaaccccatctctacttataatacaaaaattagcaaggcgtggtggcgggcgcctgtagtcccagctactygggaggctgaggcaggagaatcgcttgaacctgggaggcagaggttgcagtgaaccaagattgtgccactgcactccagcctgggcgacagagtgagactgtgtctcaaaaaacaaaacaaaacagatgtggaaactggagcccagaggagggacgtgacttgctcaagtcccacagcagaagtggccgaggtgggattgcagccccagtctgtccagtccccgcctgtcctgcagttcttcccacctcctcctcatccaggacttgagaggggccaagaaaacccagcacggcattgtc

SEQ ID NO: 33093 - DNA, 601 bp, Human
atagctggcctcccgtgaacattcacagactgaggctcagagagagaagggactaacccaaggtcacacagcaaattagaggtgaccagaggtgaggcccagccctgggaactctgagatgaccagccctggccctcagtggggtggttggaatagggcttgctcactcattaattcttcattcattcattcacttgtgtatcacattgtgtgccagtctccgcagctcagcacagggcagcgacatcccagctcgaaggccgggtggtgagacgggtgctcactgtggcctcgcgtgctctgtgtcccacaggagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagtaagatccttcctcattccatttgggggccccagggagggtgggagcctcggtccccacccagcagagggggccccctcctgtcccactatgggccctgggcaaagccggaccccaaggcatggggctact

SEQ ID NO: 33094 - DNA, 601 bp, Human
gcagagagacttgaagagacatgacttgggacaaaatagcaccaaagtggtcgggtacagtagctcatgcctgtaatctcagcactttgggaggctgaggtgggaggatcacttgaggccaggagttcaagaccagcctgggcaacataccaagaccctgtctctgccaaaaaataaaaataaaaaaaattacccaggtgtggtggtgcacacctgtcatctcagctgttcaggaggctgaggcaggaggcttgcttgagcccaggagtttgaggatgcagtgagctgtgattgcgtcackgcactccagcatgggcaacagagcaagaccccatctcttaaaaaaaaaatatggcattttaggtgtcagaaacgggagaaccatgtcctgtgcttgctcaggttgtaaatctggggttaattagggatccaggggagattaggttgttgaggctggtctgaggcagtaccagttgtcaggagagccaagaaggcagcctgagggcttaaggttgaacccatctctgctaagtgccccaggcaatgcagaggcaggaaggggaggggtgcagcaggagacaggaggcaatcaaccgcacct

SEQ ID NO: 33095 - DNA, 601 bp, Human
tttttggataactctgccaagtggttccaatgtgctcaagtttgagagttgctgaattaaagcgctgggtcttgccaggcatacctgtaattccagctctttgggaggctgaggtggaaggattgcttgagcccaggagttcgagaccagcctgggtaacatagcaagatcctatctctaccaaaaaaaaaaaaaaaaaaaaagcgtttgggtctaatgcttggcctgtagtaggtgcttgtaagttatatatactattattattattattattattattattattattattattattatwataagggggaaaaaagcccaaatatgtgggctgaccagggcttcgaacttatacatgtaaaacaagtgttcttacctggaaaaggtaacctccgacatccctttcttgttaacctggctttcggctagcagattctggtgcagaatgtcttagacctctggtcaggggccttgccttgagtttgtgatcacaggaatcagttattggatgtccctggcagatgaggctgttaccccagagccagggcctgtgcactggggccagatctggggaaccctcttgggtcccacctggaacctt

SEQ ID NO: 33096 - DNA, 601 bp, Human
ggatgtggtggtgcctacccgtagtcccagctacttgggagactgtggtgggaggatcacttgagcccaggagttggaggctgcagtgagctgtgatcgcaccactgcactccagcccgggcaacagttagaccctatctctaaaaaaagttgtaacaaaaaataaaataaataaccccaaaatggagcttaaaacatcaagtgtttattacctcacagtttctgggggttgggaattcgggactggccgagttgggcagtgctcggtcagggtctttcatgaggatgcagtcaaaatgtyggctggggctgctgtcatccaagagctcaactggggcgggaggagacgcttctgagctcattcacacggctgttcgtaggaggcctcagtcccccaccatgtgggctagccttgacggggctgcttgagcatcctcacaacatggccactggtttcctccagagttattgatccaaaagagaggaacgaggaagccacgtggcttttatgacccatccttagaaattgctgtcatattctatctgttagaagccagaaacatgatccagccttccctctgtgggagaggaattaaactcc

SEQ ID NO: 33097 - DNA, 601 bp, Human
ggtcatggccggtggagggcgtgtgaccgtcccgtggggccctgctcacttgtgcctcctgtgttttgatagagaagtgggacgccttcataaaggaaaccgaggacatcaacacgctccgggagtgtgtgcagatcctgtttaacagcagatatggtgagtgggcggcgcggcccgccgtgtggccccagcagccgtgttgagcatctcattacgtggcaatcactcgtgttccccaacacggcagcgggagccatatgctggctcccgcgcgccggcaccgctaatgtcatccgtcgcrggctcctcctgtctgggtagggggtggttgtgtcaatatttcccttccagattcttcagggggcggaactgatggcaaagccccagacctgggctcagtggcggggagcgggacaggttgggggcagagattacccatctgggggccgggcgcagtggctcatgcctgtcatcccagcactttgggaggccacggtgggaggatcacctgaggccgggagttcaagaccagcctgaccaacacagtgagacctcccatctctacaaaaacaaattttttaactaggctgggtgcagtggc

SEQ ID NO: 33098 - DNA, 601 bp, Human
catggggctgaacaagactctggaggccttagtgaggagcctgggatagccagctacctttgatgtggccaccctggcccagccacgcctcctcactcctcagagctgcaaagggctgtctgcacctgcccctgagtctctccccgccccaggcaggtgtgagccaggcggaggttgggggaggggaaccagggaggagccggctctgcctgccttgggagggttctgcccaggccagtgttctggcctgtcccacgctctggactttccaaaatgccaagccttttccaaatgtcagttyctgagtcacatccaaagagtgttgggtgtggagtggtcaagatcttgttccccataaagccggagctccctctggggagctgcgtgggggagaaggcagctgcccagtactggggaccccacgggtggtggggacggggtctggcagcccaaggcattccactggtcgtgggtgagcaaaccctgctcccagctctaccagccaccaaatctgggtgaattgggccagtgacagtgtgggtggtacaaaggaggaagaaacagaaaaattagaattgggggaaacattaggcttcaggaa

SEQ ID NO: 33099 - DNA, 601 bp, Human
ccagccaatttcctaacagaaaagtgatatgattttgacatttctgcaggatccctctggccgctacatggccagagtggagtggggacggtgggaggtgatggggaccgcagctcccgggtcctgtgtgtccagcagcctgtctaacactcagccttgctgtttggttgtctttccagcggaagccctgggcctggaccacatggtccccgtgccctaccggaagattgcctgtgacccggaggctgtggagatcgtgggcatcccggacaagatccccttcaagcgcccctgcacttayggagtccccaagctgaagcggatcctggaggagcgccatagtatccacttcatcattaagaggtgcgggtggggctgggcgcagtggctcatgcctgtaatcccagcactttgggaggccaaggcaggcagatcgcttgaggccaggagttcgagaccagcctggtcaacatggcaaaaccccgtctctattaacaatacaaaaattagccaggtgtggtggtgggtgcctgtaatcccagctacttgggacgctgaggcaggagaatctcttgaacccgggaggcagaggttgcaatga

SEQ ID NO: 33100 - DNA, 601 bp, Human
aggtgtggtggcgcacgcctgtagtcccagctactcgggaggctgaggcatgagaatggcttgaattcgggcgacagagattgcagtgagccaagatggcacaactgcactccagcctgggtgacagcgagaatccatctctaaataaataaattaaacatagaataaccaggcctgataattgtccatgcctcatagtgttgatcggagagtaaattaccagatgtggatgaaatgcttagaacagtggctacagcttcagagcctccaagtacacttttttctattacacaccccagcytcatcatttaaccatctgagatcatgctggcaaaagtgagtcaggagaggagggcttaaaaaggagccaggggctgagcacagtggcttacggcctgtaatcccagcactttaggaggccaaggtaggcggatcacttgagcctaggagttcaagaccagcctggccaacgtagcaagaccccatctccaaaaagaaaaaaaaaaagtggggggagccaggaggtagagtctctgccctggcccaggtatctgcagggtatgcaccatctgggagtcagaagtgctttctacaaggcctg

SEQ ID NO: 33101 - DNA, 601 bp, Human
ggagagtaaattaccagatgtggatgaaatgcttagaacagtggctacagcttcagagcctccaagtacacttttttctattacacaccccagcctcatcatttaaccatctgagatcatgctggcaaaagtgagtcaggagaggagggcttaaaaaggagccaggggctgagcacagtggcttacggcctgtaatcccagcactttaggaggccaaggtaggcggatcacttgagcctaggagttcaagaccagcctggccaacgtagcaagaccccatctccaaaaagaaaaaaaaaawgtggggggagccaggaggtagagtctctgccctggcccaggtatctgcagggtatgcaccatctgggagtcagaagtgctttctacaaggcctgagggtcttgttattggtggtacagctctctgccccccacctctgccccaaccccaactcatgccaagttctggcctcctacttctcatgtctgtattcctactgggatacaatagaatcccccagggctgtgggttcacacctcaggggcagatatattggttctagctaagccagaacttaggaggagaaagtatctggagaaga

SEQ ID NO: 33102 - DNA, 601 bp, Human
gtagggcctcactaacaagttacagacaccagaatgttctggaaagagtcactctgcccagtcgggatcatgccagacttgacaggattcttcctttcctccttgcaggaacctccggggagctgggcgggctgaggccgatcaaaattgagccagaggatctggacatcattcaggtcaccgtcccaggtaagggacgggcatctgaccaccccctgcagaaatcagggccggaccgttagcctcctgagggtctgccctggtgaagaagtggcctccaggccgctgtttctctctgtgrattctgagagccatcggggtactgtgaatgctttttctggccacatctgtcccctgcgttgtgaatcagtgttctcagctctgaccttccagaaggtcccctcaaaacttcacctccctggcttggcttccctgggatttgtgaggctggacagaagaaaaagccatgggtgtgagaggctctgagtttgaccctaccccctgccaagcctcattttccacatcttcagaggagaggatagatttgggcgctggagcctcagtacggggtgactgttagaagccaagagggtgctgggca

SEQ ID NO: 33103 - DNA, 601 bp, Human
catggcttaggagatgatgaatgtggcttcccggcatcctctgttctcttttagacaaaggtctgagtgaggacgcgcggcccgaggagaggcccgtggagggtgaggccctgtctacccctgacattttacacccacccccaccccatctctcttcccctgccgcccacctccccttggcctctgggtctcttcgttctctccacctcatctctctccagcaccctggtgtgggggtgggaatcctgtgggctgcctgatatgggaggagatttaaggatttgtcttctagaaccaggargttcctggtcaaaggtgagagcagttcccactgctaaggaaaattgcaagcctttgtttttattacacaccctgctgctttgcgcaaaggttttaagactgggaactgagcctcctctatctgagcaagtagattagaggcctgaaagcacaaaatttgctttgtgtccagcagacacgcccattctcaggaacgtgagaattccctccctgctgagaatggaagtaggacagagagagagggaggccagggtgagggtgggtctgtttcatctctgtagtatcctggaatggaatgagt

SEQ ID NO: 33104 - DNA, 601 bp, Human
tcagtcacatacctagaaagacccatggtcactcctagtccacagaaccttccaaatcttcattcaggctggcggtgccctagatttgatttcgcaaacaagaatgtgagcccaggaattgtggacctgtctgcgtgtgccatttctgaggaaataagttacccaccgccccagccccagccttcccccattccaagatcccaccacagggccaatgttggtaccagcagagcaggaacatcagccgagaagctgccaccaaccagcctcaacagactgccttttgccttccagacagccmcggtgacgtgatccggcccctgcggaagcaggtggagctgctcttcaacacacgatacggtgagcaagaagtgggacagggtctgggggcatcccggcccccctccagccgccctgtttgcagaagggctttggtcgcatccccttgcctgttcccatcccagctgttctctgggcagggacaagggagagagggaagggaggagctgggacccatcatgaggatggggacactagagaggctgtcactcaggctccctggctcactcactcacactctgcctcagtcgcaggttggaga

SEQ ID NO: 33105 - DNA, 601 bp, Human
tcccatcccagctgttctctgggcagggacaagggagagagggaagggaggagctgggacccatcatgaggatggggacactagagaggctgtcactcaggctccctggctcactcactcacactctgcctcagtcgcaggttggagaggccactccctcccctgtaatgtcgccagccctcagccctccgccctcaccctcatccctccgccctcaccctcatccagggtcctcaagaagactcataataagaataagataagataacctcagtggtgtgccgggcatgaggctaggtgmttccccatgtttttctttttttttttttttttttttgaggcggagtctcactctgttgcccaggctggggtgtggtggcgcaatatcagctcactgcaacctgcgcttcctgggttcaagaaattctcctgcctcaccctcccgagtagctgggattacaggcacctgccaccatacccggctaatttttgtagttttaatagagacagggcttcaccatgttggccaggctggtcttgaactcctgaccttaagcgatctacccaccttggcctcccaaagtgcagggattataggctt

SEQ ID NO: 33106 - DNA, 601 bp, Human
gaataagataagataacctcagtggtgtgccgggcatgaggctaggtgattccccatgtttttctttttttttttttttttttttgaggcggagtctcactctgttgcccaggctggggtgtggtggcgcaatatcagctcactgcaacctgcgcttcctgggttcaagaaattctcctgcctcaccctcccgagtagctgggattacaggcacctgccaccatacccggctaatttttgtagttttaatagagacagggcttcaccatgttggccaggctggtcttgaactcctgacctyaagcgatctacccaccttggcctcccaaagtgcagggattataggcttgagccactgcacccggccccctgtgttcttgtatcccatctcacaaaatccccgtgtcctaagacccactttacagatgaggagaactgaggcctggtaaaggggtgtgactcgtccaaggccccacaccactcagtggcagagatcgggttcgttccaaggcgtggtgttgtgccacagcagcgtgtggggttgcttatggtggcaggagggacactcggggggccttactggaagggcgaggcccagtgg

SEQ ID NO: 33107 - DNA, 601 bp, Human
actcctgaccttaagcgatctacccaccttggcctcccaaagtgcagggattataggcttgagccactgcacccggccccctgtgttcttgtatcccatctcacaaaatccccgtgtcctaagacccactttacagatgaggagaactgaggcctggtaaaggggtgtgactcgtccaaggccccacaccactcagtggcagagatcgggttcgttccaaggcgtggtgttgtgccacagcagcgtgtggggttgcttatggtggcaggagggacactcggggggccttactggaagggcraggcccagtggactcggggaagcaatgccgaatctcagcagccattagtggtggcttctgtactgcctgggcatgagggcatggacccagcgtgggccttggggtaaccctgggttgagttcctatcccctggctctgctgttcagtggctctgtgacctcagacaagtcacgtcccctctgaactccaggttcctttcctgcaggctggggggccactctttccacatcccaggaaagctggcaggccctcaaaagggctctggcagctttgccccccgacacaggcacgggacacagg

SEQ ID NO: 33108 - DNA, 601 bp, Human
gatctacccaccttggcctcccaaagtgcagggattataggcttgagccactgcacccggccccctgtgttcttgtatcccatctcacaaaatccccgtgtcctaagacccactttacagatgaggagaactgaggcctggtaaaggggtgtgactcgtccaaggccccacaccactcagtggcagagatcgggttcgttccaaggcgtggtgttgtgccacagcagcgtgtggggttgcttatggtggcaggagggacactcggggggccttactggaagggcgaggcccagtggactcggggaagcaatgccgaatctcagcagccattagtggtggcttctgtactgcctgggcatgagggcatggacccagcgtgggccttggggtaaccctgggttgagttcctatcccctggctctgctgttcagtggctctgtgacctcagacaagtcacgtcccctctgaactccaggttcctttcctgcaggctggggggccactctttccacatcccaggaaagctggcaggccctcaaaagggctctggcagctttgccccccgacacaggcacgggacacaggggttgaggctcctggc

SEQ ID NO: 33109 - DNA, 601 bp, Human
ctctactgcagggcctgctctgtgccaggagggaggctgctgctccatgacacacaaagagcagatagcaaaaagctatgcaacagggctggagagcaagagtcatgattcgtgcagtagaagcaaaggcttcagcaggccaggatgaatgcagccacatgcccggtgtgtctgggcatattaaaaggaagattgagccaggcatggtggctcatgcctgtaatcccagcactttgggaggctgaggtgggcagatcacttgagatcaggactactgaaaatacaaaaattaaggccgggygcggtggctcacgcctgtaatcccagcactttgaaaggccgagttaggcagatcacctgaggttgggagtttgagaccagtctgaccactatggagaaaccccatctctactaaaaaatacaaaattagccgggcgtggtagcaggtgcctgtaatcccagctactctggaggctgaggcaggagaattggcttgaacccaggaggcagaagttgcagtgagccgagatcacgccgttgcactccagcctgggcaacaagagcaaaactccatctcaaaaaaaaaaattagccaggcatg

SEQ ID NO: 33110 - DNA, 601 bp, Human
atgaatgcagccacatgcccggtgtgtctgggcatattaaaaggaagattgagccaggcatggtggctcatgcctgtaatcccagcactttgggaggctgaggtgggcagatcacttgagatcaggactactgaaaatacaaaaattaaggccgggtgcggtggctcacgcctgtaatcccagcactttgaaaggccgagttaggcagatcacctgaggttgggagtttgagaccagtctgaccactatggagaaaccccatctctactaaaaaatacaaaattagccgggcgtggtagcrggtgcctgtaatcccagctactctggaggctgaggcaggagaattggcttgaacccaggaggcagaagttgcagtgagccgagatcacgccgttgcactccagcctgggcaacaagagcaaaactccatctcaaaaaaaaaaattagccaggcatggtggcatgcacctgtaatcccagctactcaagaggcaaagaggagaatcacttgaacccgagaggcagaggttgcagtgagccgagatcgcactcctgcatttcagcctgggggacagtaacactcttgtctcaaaaaaataaa

SEQ ID NO: 33111 - DNA, 601 bp, Human
aaaatacaaaaattaaggccgggtgcggtggctcacgcctgtaatcccagcactttgaaaggccgagttaggcagatcacctgaggttgggagtttgagaccagtctgaccactatggagaaaccccatctctactaaaaaatacaaaattagccgggcgtggtagcaggtgcctgtaatcccagctactctggaggctgaggcaggagaattggcttgaacccaggaggcagaagttgcagtgagccgagatcacgccgttgcactccagcctgggcaacaagagcaaaactccatctcaaaaaaaaaaattagccaggcatggtggcatgcacctgtaatcccagctactcaagaggcaaagaggagaatcacttgaacccgagaggcagaggttgcagtgagccgagatcgcactcctgcatttcagcctgggggacagtaacactcttgtctcaaaaaaataaaaagggaagatcacatttcaggtggtttaaggataaactcatgatagacatatagcccatcagatgtgtgaaaacagggaaataaagattcacaagagaatatgtgtaattatagtacagtaattggctctact

SEQ ID NO: 33112 - DNA, 601 bp, Human
agaggttgcagtgagccgagatcgcactcctgcatttcagcctgggggacagtaacactcttgtctcaaaaaaataaaaagggaagatcacatttcaggtggtttaaggataaactcatgatagacatatagcccatcagatgtgtgaaaacagggaaataaagattcacaagagaatatgtgtaattatagtacagtaattggctctactatatacatgtatagtactgtactggttgaaggagggcttctttcaacaaattctcagcctgagcaatgtgtgaaaccccatctctagggaaaaaaaaaaattagccaggcttggtggtgtgcacctgtagtcccagctacttgggaggctgaggtgggaggatcgcttgagccaggaggtcgaggctgcagtgagccctgattgcaccactgcactctagcctgggtgacagagtaagaccctgtctcgaaaattttttttttttaatttttttaaaaatacattccgtccaggcgtgatggctcacgcctgtaatcccaacaccttgggaggcccagataggaggatcgcttgagcccaggaatttgagagcagcctgggcaatgtatc

SEQ ID NO: 33113 - DNA, 601 bp, Human
gggagaaagtactcccgggtgactatgatgtgcacctgattaagaaacactgattgggccaggcgcagaggctcacacctgtaatcccagcactttgggaggccgaggcaggcatatcacttgagatcaggagttcaagtccagactggccaacatggtgaaaccccatctcaactgaaaatagaaaaatcagggccgggcgcggtggctcacgcgtgtaatcccagcactttggaaggctgaggtgggtggatcacctgaggtcaagagttcgagaccagcctggtcaacatgctaaacyctgtctctactaaaaatacaaaaattagccaggcatggtggcacgtgcctgtaatcccagctacttgggggctgaggtaggaggatcgcttgaacctaggagacagaggttgcagtgagccaagattatgccactgcactccagcctgggcaacagagcaagactctgtctcaaaaaaaaaaaaaaaaagaaaaagaaaaaaaaaattagcctggcatggtggtgcacgcctgcagtcccagctacttgggagtctgaggtggaagaatcactttagtccaggaggcagaggttgcagtg

SEQ ID NO: 33114 - DNA, 601 bp, Human
agtggggcatagtggctcatgcctgtaatcccagctacttggaaggctgagataggagaatcgcttgaacctgggaggcagaggttgcaatgagccgaggtcgcgccattgcactgcagcctgggcaacaagagtgaaacactgtctcagaaaaaaaaattagccaggcatggtggcacgtgcctgtggtcgcagctacttgggaggctggggcaggaggatcatttgagcccaaggggattgaggctgcagtgagccaagatcgtcccattgcactccagcctgggcaagagaacgagaytccatctcaaaaataaataaataggctgggtgtggtggctcacgcctgtaatcctagcactttgggaggccgaggcaggcggatcacttgaggctcaggagttcaagaccagcctggccaacatggcaaaaccccgtctctactaaaaatagaaaaattagccgggcatggtggcgggcgcctataatcccagctactcgggaggctgaggcaggagactcgcttgaacccgcggggccaaggttgcagtgagccgagattgcatcactgcactccagcctgggcagaagagtgaaactc

SEQ ID NO: 33115 - DNA, 601 bp, Human
gcaagaattaggtcactgttaaagatgatacggttcttgacccttaaaaaaacaagagaattgagctgcatgattcataaggattcttgcagctcctaaaaattctgatttcacatatgagatgtaaaaaggtgatatataattaaaatccaaataagtgaaaatgaggagagttatgggctctaagaaagaatccagcctggaggaaggaggtggggggtgggggcactggtgatcaaggaaggcttcctggagaagtagagcctcaagctaggccttaaaggatggggaggactttgaygagaagaggagtgaggcaggcagtggggagtgtgagtaacttttgccagcccctacctgctcccctatgcagcccagctggtgtagtgggtatgttcaagggagtgataactaatagctgacttttggcccctgattgtaatggcaaatctcattcacatgcattaactcccttgatcccagcaacaatcctgtgacagaggaggtattaatatttccattttcaaaagagggaagtcaggttcagagcatttcagggacttgtgtgggatcaagcatcgtgtgagtcactgagcctgga

SEQ ID NO: 33116 - DNA, 601 bp, Human
aactttaaaaccgtacagatgcccaggctccacccccacctattgaatgggaaccccagggtatggtaggggcctgggcctctatacttctcaaaggatccatgagtgattccgatgttgtttttttttttttttttaaaaaaaaaaaaaaaaaaaaaggtctatggccaggcactcaggaataaactgctgcatcagacaggagctaaactggaggtcagggggacactaacatttattggttgaggaccatgtgccagatcctggactaagagctttgcatatattagcgcttcttctyctttttttttttttttttttttttttggagagagacagctcgctctgttgcccaggctggagcgtagtggtgtgatttcggctcactgcaaagttcacctcctgggttcaagcgattctcctgtctcagtctcccaagtagttgggattacaggtatgcgccaccatacccggctaatttttgcatttttgtagagatggggttttaccatgttgttcaggctggtctcgaactcctgacctcaagtgatccacctgtctcggcctcccaaagtgctgggattacaggcgtgagccacca

SEQ ID NO: 33117 - DNA, 601 bp, Human
ggaagatcctgcaagccttcccagacatgcacaactccagcatcagcaagatccttggtaagggccagtggctggggccatggttcagtgtgacctggttgcaggagccagctgggtctattcagggcttgcttggtgatattccatactgtgttggactccagtggaatctgacgacaggggtgcaggagttgctggggatgtgagggcagctgggtcctggggtcttatatcactgaagtgttcggtagcacctgtcctcaagaactcaaggagtgtgcgtgtgtgtgtgtttacattatttagtactcctgatctaaacctaacctgttccactgtttgtccagacccttgctctggcagaaaacaggagagactagtgttcctgggctgtcactagaaagatttttttaaattatatgtcctgattggtggccacggagggatgttgggcagggcagatggagctcgaggggccagttgttttcaagactgaggctcctccagtgtcagcgcaggactctgtcaactgagacatcaggtattttgtcctgagcagggagcctgtctgggttgttgaaggtctgaggtggctgctctt

SEQ ID NO: 33118 - DNA, 601 bp, Human
catgggtgacagagcatgaccctgtctctaaatataagtaaacaaaacataaaatatacaagttctaaaaactggattcacacatgatcctccaagaatattatctgttgaacacatctatggccctaggtctgcaggtcatctgcagggtcgtaggtgccagtgaatttggccatcagaaagcaggctgggggcagggtatataagtcacagccaagagtgtgtggagtgggagtgcacgctctgaggaggcctggaggggagatgggtttggggttgaatcaagtgtgcatccatcacygttccccttctctgccccacagcccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgat

SEQ ID NO: 33119 - DNA, 601 bp, Human
gctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtaygggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcagaatctggcccttgtgcaggggaggagggaggctggcctaagtccagaattcccaaatatgc

SEQ ID NO: 33120 - DNA, 601 bp, Human
gttccctaaggaaatcaaatcccattgtcacctaactctgaagatctaaatagcccttggatcagtacgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcrtttcagaatctggcccttgtgcaggggaggagggaggctggcctaagtccagaattcccaaatatgccaccagcctgggcaccactgtcccctggtggcagcctgcaggagcttcaggcctggggcctcagaggaattggcttaatgcaagggaatcccaggccaagcttgtgagtgacacatttcctccacagagcccacgctgaatgcccctaccttgacgaggtgaggccacccggatcctaagaaagaaggcagtagtaagagcactgtaataggagtcatgaagctcggggtctc

SEQ ID NO: 33121 - DNA, 601 bp, Human
agatcaaaagttcttaagctggagggggagtccatatacttcaaggatgtctatgtatttgcttcagaaaataaataaaattctaatgtatacatattttctgagctaaggatttatagtttttttatgagtttttttctgtttggctttttttttttctttgagagagggtctgactctgtcacccagactggagtacagtggcacaatcacggctcactgcagcctcaacctcacatcctcaagccatcctcccgactcagccttccaagtagctaggactacaggtgcatgccaccamgcggggctaattttttttagtttttatagagacagggtccccctatattgcctaggctggactcgaactcctgggctcaagtgacccacccactttagcctccctaagtactgggattacttgcattagccactatgcctggccattacgaacttttcaaagcttcctgatcccacaacaattaagaatcaccaaatcacagagaaaatcggcctcaatttcaagtgttttccaataaacaattgtggttagaaatgttactaagatttattttataaggaatagttatagttactttaa

SEQ ID NO: 33122 - DNA, 601 bp, Human
gattactgatgaaccgaagaatgagctctctgatttgaagctcaatatccttaggttgatcacctacaggcacctaaaccaaacagagatgagcaaggaactaataattaaaaatcaactcagcttttttacccacatttaatcgatagaatataggtatatccatttaaaaatagttaaaataaaaataaagacattactaatatactacaatggtatttatgaatctggtaatgtgtcaagtctcaaagtgtaactcttgcaaatatcaaaagttgatttaatacagtcccatgttaaraactggtcaatgttgattggctagatacaaattcattcactcattcattcaattaccaagtgtttactggcagcctactctattttaggcacttttctgaacgtgatttcaggtcatgtcagattatgttacagtagtgaattttaaaaagaccaaactttctgccttcgtagaacttatgttttagtaataacacgcatataataaacaaaaacatatatatagtatacagatggtggtaagggctgtgggaaaataaggcagaacagcaggctagggaatgattagagatgatttttt

SEQ ID NO: 33123 - DNA, 601 bp, Human
gatccattaaatacaactatttagtgttaataaaggaaaaccctcatctacaatcccacttagtattacctctgtcatcattttggtaatgccttacttaccagtgcttttttaaaaataatgttaaacattgtgtataattttttaaaacatttttgccgggcacggtggctcacacctgtaattctagcagtttggaaggccaaggcgggtggatcacctgagatcaggagtttgagaccagcctgactaacatggtaaaaccccatctctactaaaaatacaaaaattagccaggcayagtggcagacgcctgtaatcccagctgctcgggaggctgaagcaggagaattgcttgaacccgagaggcagaggttgcagtgagctgagatcgtgccattgcacttcggcctgggtgacagagcaggactccatctaaaatatatatatatactatacatataaaatatatatactatattatatataaaatatatatagtatatatataaaatatgtatagtatatatataaaatatgtatagtatatatagtatgtatagtatatattctataatatatatactatatatattatata

SEQ ID NO: 33124 - DNA, 601 bp, Human
acccgcatccatgagatcaagtttagtgattacagctagggttctgcgacctggtaaatgcaaaaagaaaaaagggcaaagaaaagaaagaaaatgatccattaaatacaactatttagtgttaataaaggaaaaccctcatctacaatcccacttagtattacctctgtcatcattttggtaatgccttacttaccagtgcttttttaaaaataatgttaaacattgtgtataattttttaaaacatttttgccgggcacggtggctcacacctgtaattctagcagtttggaaggccarggcgggtggatcacctgagatcaggagtttgagaccagcctgactaacatggtaaaaccccatctctactaaaaatacaaaaattagccaggcacagtggcagacgcctgtaatcccagctgctcgggaggctgaagcaggagaattgcttgaacccgagaggcagaggttgcagtgagctgagatcgtgccattgcacttcggcctgggtgacagagcaggactccatctaaaatatatatatatactatacatataaaatatatatactatattatatataaaatatatatagtatat

SEQ ID NO: 33125 - DNA, 601 bp, Human
aaattcagacttgctctgaagtgagaatgcttatcccattctaagaatgcttatcccaattcttatcccattctaactgctaacctgttaactactccaattattccaagtttgactggaataacccttcccatcaatacatccatggcatcagtacccgcatccatgagatcaagtttagtgattacagctagggttctgcgacctggtaaatgcaaaaagaaaaaagggcaaagaaaagaaagaaaatgatccattaaatacaactatttagtgttaataaaggaaaaccctcatctayaatcccacttagtattacctctgtcatcattttggtaatgccttacttaccagtgcttttttaaaaataatgttaaacattgtgtataattttttaaaacatttttgccgggcacggtggctcacacctgtaattctagcagtttggaaggccaaggcgggtggatcacctgagatcaggagtttgagaccagcctgactaacatggtaaaaccccatctctactaaaaatacaaaaattagccaggcacagtggcagacgcctgtaatcccagctgctcgggaggctgaagcaggagaa

SEQ ID NO: 33126 - DNA, 601 bp, Human
ggggatgctgtgaggattccaagagataccatttgcaaattgctcacagtagagtgtctaaaacgtaattagacactcaataataatttccttttcccgatttttaataccaactatttataattaggatacctttaataaaatttctccaagtcacatcctggcaattacacagaatcactaatgctagggattaaaccaatctattaaaatcttgtcacctttaattagacactcaatactagtttccttttcccagtttttaataccaactatttataaattaggatacctttaatamaatttctccaagtcacatcctggcaattacacagaagcatcactaatgccagggattaaaaccaatctattaaaatcctgccaccttaaactctttctcgattgggtgcacattagataatttttcccttacccagtacctcctcatacatagcttaacatgataggcaagaattcttaaagcctggctattacaacatttcttccattttgtggtattgcttactttagaaacattttccagtaaaaatgtctatggggcaggcacagtggctcatgcctgtaatcccagcacctggga

SEQ ID NO: 33127 - DNA, 601 bp, Human
ggtgtgcccagagagggcacggaagctccacattccttcccacatgcccagccctgtgcatctcttcatctggctatttatctatatcctttgtaatatgctttacagtaagtgggtatatgctaagtagtgtttccctgacctctgtgagccactctaacaaattcatcaaacatgaaaaggggatcatgggtaccctgacttatagcctgtcagtcagaaacacaggctacaacctgtgcttacaactggcatctgacttgggggcagtcttgtgggactgaaccctcaacctgtgggmgctgacactatctccaggtaaacagtgttagcattgaattaaaggacattcagctagaatcccctggagaattccttgcttgatgtatggggaaaactccccatatatctgctctcaaaagcattctgtgctatactgattaactgtgtgtgaaaaggaaaaaaacaattttgattggtttttcctaaataataaaagcaaggaaaaaatgcaaattattttcatattactgcaattaccacagagaaaataagccacccaatcaattcttcctatataattttggtttcattgacttgt

SEQ ID NO: 33128 - DNA, 601 bp, Human
ggttagaaaggaaggatttaaaagtaaaattgtgtattctaaagccctaaacaagtcaaatttttacaatggggaaaacctatcaaataatttgtcctggcaaatgtgatactgtgaaatatatatttggtctttgtcttcatttcctggcagtcagctcctaaaatccttggactctccaagagcattaagggtgtttagagtgtctctgcatgctaatgagatgactggtggctgggggtccctagatagcttcaggatgggagctggtcaccagaacagcctcagaagagaggagagrggccaaacattgagctgatcaccaatggccaatgaagcttccataaaaactcaaaaggacacagttcatggagtcttcagagagttgaacacatgaaggttcctggagtgtggtgtgcccagagagggcacggaagctccacattccttcccacatgcccagccctgtgcatctcttcatctggctatttatctatatcctttgtaatatgctttacagtaagtgggtatatgctaagtagtgtttccctgacctctgtgagccactctaacaaattcatcaaacatgaaaaggggatca

SEQ ID NO: 33129 - DNA, 601 bp, Human
tattaatattcttctattcagtgtattgtttccagaagattatgttgtaccagagaacaaggcatgcaggcttagattaagaatcagaacagaccttgccatcagcctcagcagaagcagcgggggagggctcctgggaggcaggtgccaaagcacttggaactttagaagactaaaggcaaaaaatccaggggggaaaaaaaatcaaggatgcaaaaatgcattcaggaacattctataaatgaatttttcccttctgtaatgaaatcgtaaaataacatgaaaaatgaaaataatcatrggagattgtttattctgccttatttccttcaccattgtcacctttgttaaaagtttccttcagatgaatacataagaaaaatccaaatccaaaagcttcatttttatttttggtatttaataagattcttttctggcaaagaattcaaggtaaaagatttttatacacactttagtattacaactattttaattattactagtaattaaaacctctgttctgtgcatactgttttttccaagaaaccctcttattataataaaatcttgagtcatttcagctatgtgcaaagttgataaa

SEQ ID NO: 33130 - DNA, 601 bp, Human
gtatcccatattaatattcttctattcagtgtattgtttccagaagattatgttgtaccagagaacaaggcatgcaggcttagattaagaatcagaacagaccttgccatcagcctcagcagaagcagcgggggagggctcctgggaggcaggtgccaaagcacttggaactttagaagactaaaggcaaaaaatccaggggggaaaaaaaatcaaggatgcaaaaatgcattcaggaacattctataaatgaatttttcccttctgtaatgaaatcgtaaaataacatgaaaaatgaaartaatcatgggagattgtttattctgccttatttccttcaccattgtcacctttgttaaaagtttccttcagatgaatacataagaaaaatccaaatccaaaagcttcatttttatttttggtatttaataagattcttttctggcaaagaattcaaggtaaaagatttttatacacactttagtattacaactattttaattattactagtaattaaaacctctgttctgtgcatactgttttttccaagaaaccctcttattataataaaatcttgagtcatttcagctatgtgcaaag

SEQ ID NO: 33131 - DNA, 601 bp, Human
gctgtcctgaattaactgttaaaagatatgttaaaacatgcaatttaacaagcaaaatttaaataccaatgggttgaaattcaaaaagtgcaggataatttcctctttaaattactttttctgtgtgcatcttctatattgcaagcaaaagcatgtcaacaatataaactatgcattgcattgttatataattttaaaatatatattagactaaagtgatctgaccttagcacagtatcccatattaatattcttctattcagtgtattgtttccagaagattatgttgtaccagagaacwaggcatgcaggcttagattaagaatcagaacagaccttgccatcagcctcagcagaagcagcgggggagggctcctgggaggcaggtgccaaagcacttggaactttagaagactaaaggcaaaaaatccaggggggaaaaaaaatcaaggatgcaaaaatgcattcaggaacattctataaatgaatttttcccttctgtaatgaaatcgtaaaataacatgaaaaatgaaaataatcatgggagattgtttattctgccttatttccttcaccattgtcacctttgttaaaagtttcc

SEQ ID NO: 33132 - DNA, 601 bp, Human
acttaaaaatgagtaattagatttttaaatgtttgttaactatacatgaatgacataccaaatgaaatcttaaggagagagagcacattcagtgtgacgtcatgaatgaaataaaacttgtgcagtgatttagatggtttgattaatatctgagcacagtgggctgagagaagataagacatttataaacctttatttgaagttcagaactttaaatctggataattaaggaaaggagctaaatggcagaaaatcttgaaatagcgatgagtctgaataatttatacattatttaattttyctctaaaatggttatcaagaattgaaaacagtctcaaactctcacagtccccatttgtttttttaatttgcttaagcttctgaagcatatgtgaagctatatatagggtaacaagtgcaaactaactggaagcataagaaagaagcattagatctattagtactgaacagatctcaagatctttaaagaggaaaggaaatgtccaaaaatacaattccatctctgaaatctaggaaatctctgaatttcctaccaaaatactaaatttaaaactattcttgaaggtaacaaaacagtgag

SEQ ID NO: 33133 - DNA, 601 bp, Human
tgctgacagattaccaaaaactggatgcagaatattttctaatagatcacttcacacaactaaatgtatattctccctattactgcatgaaatgacataccaggcaacatgaaggagaagatgcagtagggactagacacatgaaaaaacattctgaacgagaaaaaatacacatatttcctagtaaaagacattcgttttgatactttggaaaaccaagttaaattaaaaaggcaagtcagtgttactagccaaaataattaatgaaactactaaattaaaatttaggaaaaagattttmttaaatgactcaaaatgtggcagccagatagaacaaaagaatctctcatttttaatagctttttctagctgatacatgaggtcctagtcattctatgttaacaaaatgggtcttgctacaagttacccaaggactatcagaaaatccacttgatgatttagaataaaaacctaaaattgtaaaaatacatgtatttttcaaaacagatcacagaatcatccagaagtattaaagtccgtcatttatattaagtaatactaacctgtcttgaatattctttctgacaatgagaaaatatga

SEQ ID NO: 33134 - DNA, 601 bp, Human
tgatactttaccttcttttcatcatctttatttcaaaactcttcaataagcatttattcataatagccaagaagtgagaaaaatccaaacatcagctgatgaatgcttaaacacagtatatctacataatctagtattattcacacaaaagatatgtcacttaatgacacggatatgctttgagaaatgcattattaggtgatttcattacatgcacagcacagagtgtacttacacaaacgtagatggtatagcctatgacacgcctaagctatatgggatagcctattgctccaggctrcaaacatgtacagcatgttactgtactgaatagggaactgtaacacaatagtatttgtgtatctaaacataggaaatgtacagcaaaaacatggtatcataatctaacgggaacacattcaaatacgtggtctgttgactaaaatgttatgtggtgcgtgactatactgattcatactacagtatggatgaggcttaaaaacattaagtgagccgggtgcagtggctcacgcctataatcccagcactttgggaggccaagacaggtagatcacctgacgtcaggagttcgagaccagcc

SEQ ID NO: 33135 - DNA, 601 bp, Human
gggcaacagagtgagactctgtctcaaaaaaaaaaacaaaagcaacaattcttgatactttaccttcttttcatcatctttatttcaaaactcttcaataagcatttattcataatagccaagaagtgagaaaaatccaaacatcagctgatgaatgcttaaacacagtatatctacataatctagtattattcacacaaaagatatgtcacttaatgacacggatatgctttgagaaatgcattattaggtgatttcattacatgcacagcacagagtgtacttacacaaacgtagatgrtatagcctatgacacgcctaagctatatgggatagcctattgctccaggctgcaaacatgtacagcatgttactgtactgaatagggaactgtaacacaatagtatttgtgtatctaaacataggaaatgtacagcaaaaacatggtatcataatctaacgggaacacattcaaatacgtggtctgttgactaaaatgttatgtggtgcgtgactatactgattcatactacagtatggatgaggcttaaaaacattaagtgagccgggtgcagtggctcacgcctataatcccagcact

SEQ ID NO: 33136 - DNA, 601 bp, Human
attaaacattaagaaaagcagttctcggccaggcgcagtggctcatgcctgtaatcccagcactctgggaggctgacgcgggtggactgcttgaggccaggagtttgacagcagcctggccaacatggtgaaacaccgtctgcactaaaaataaaaaattagctgagtgtggtggcacatgcctgtgatcccagctactcgggaggctgagatacgagaatcacttgaacccaggaggtggagattgcagtgagccaagaacgcgccactgcactccagcctgggcaacagagtgagactstgtctcaaaaaaaaaaacaaaagcaacaattcttgatactttaccttcttttcatcatctttatttcaaaactcttcaataagcatttattcataatagccaagaagtgagaaaaatccaaacatcagctgatgaatgcttaaacacagtatatctacataatctagtattattcacacaaaagatatgtcacttaatgacacggatatgctttgagaaatgcattattaggtgatttcattacatgcacagcacagagtgtacttacacaaacgtagatggtatagcctatgacacgcc

SEQ ID NO: 33137 - DNA, 601 bp, Human
attataaagttatgaaattaatctgaattacgcagggtaatttttccaatatatatgtggtaggtttataactaaccagtttatactaaccaatatcttctctggaattagaatctaatcaagtaccggccaggcgcagtggctcatgcctgtaatcccagcactttgggaggtcgaggcgggcggatcatgaggtcaggagttagagactatcctggctaacatggtgaaaccccgtctctactaaaaatacaaaaaattagctgggtgtggtggtgggcgcctgtagtcccagctactygggaggctgaggcaggagaatggcgtgaacctgggaggcggcgcttgcagtgagccgagattgtgccactgcactccagcctgggcgacagagccagactcccactcaaaaaaaaaaaaaaaaaaaaaaaaagattcttatcaagtaccaacaggaaacaagcctagctagaatataaagactatacatatccaagaatcaaactgcatttaaaactatttctatgtttctatctactacccaagtataaaaaatcaaaaggtccacaatacctttagcatatcagctgcttctttcctg

SEQ ID NO: 33138 - DNA, 601 bp, Human
tcatcttatccacaggcaaactgctttgcacaactagaacattaacagttgtttttaagttaagttcagatgaaactgtcacaagacagacttgatgtattttatatatactgggaaactttagaaacagccatttattatttggattaaatgtgtgatgtgttctgcaatttggaatacacttttcagtttatagccagtctccacatgagcagattcataccattgcaatacacaggagttcataaataagattctactcaggtaggcagtaactagcaagttttgagtcaacaaagtstcagtattacatagttctcttcaccaaagatgagtctcccggatttcagcaataatttgactggctccttgtaatgcctgcattaaaggaaaaaaaattttaaatgcttattataaagttatgaaattaatctgaattacgcagggtaatttttccaatatatatgtggtaggtttataactaaccagtttatactaaccaatatcttctctggaattagaatctaatcaagtaccggccaggcgcagtggctcatgcctgtaatcccagcactttgggaggtcgaggcgggcggatcat

SEQ ID NO: 33139 - DNA, 601 bp, Human
gtcatcttatccacaggcaaactgctttgcacaactagaacattaacagttgtttttaagttaagttcagatgaaactgtcacaagacagacttgatgtattttatatatactgggaaactttagaaacagccatttattatttggattaaatgtgtgatgtgttctgcaatttggaatacacttttcagtttatagccagtctccacatgagcagattcataccattgcaatacacaggagttcataaataagattctactcaggtaggcagtaactagcaagttttgagtcaacaaagwctcagtattacatagttctcttcaccaaagatgagtctcccggatttcagcaataatttgactggctccttgtaatgcctgcattaaaggaaaaaaaattttaaatgcttattataaagttatgaaattaatctgaattacgcagggtaatttttccaatatatatgtggtaggtttataactaaccagtttatactaaccaatatcttctctggaattagaatctaatcaagtaccggccaggcgcagtggctcatgcctgtaatcccagcactttgggaggtcgaggcgggcggatca

SEQ ID NO: 33140 - DNA, 437 bp, Human
cactcagcctcgcaccccggcacgttccgcgcctcccgccagccccaccccaccgcctcagcggattgcctcgctgcaggtgagtctggccaggggtcccttggcaccaggggttgctcaccttactgaggaccccgcagcgctccacaggcggcccagactccgtctctggatcctcctccgagcccgacgagttccagctctgattatccgacatggaggctcgacaaccgagcaggagaccggcccccgctccctcagctgcgccggaggaggcgcccagtcctcggggtgaagggtygggggatggcgaagcgaagagtgcccgctccggtgtgggggggagcaggaggagggacgaagtccgcccgccgcgccgccgccgcgcctgacaccgagcggagcgaggaaggaggacgagcggtgaaggaagccta

SEQ ID NO: 33141 - DNA, 601 bp, Human
attttcaactattccaatcaaattatccagttcctgtattccttaggagacttaataattttttctctagtatcttctgtttttttcataatttacacaagcttatttacttactaagcatatttgcctacttttcttacattgatcgtattgagtctctagctccaaaacttacatggacaacttcccactgactgtcatacaaattgtttagggcattcaagacccttcatggattaatcctacctcatttacaattaccacacttcataaggctaaactttgtgacagtggtcaagttacttattctctttgtgttctttttttctttgtcaaattctcttagagttaagtttaaacaagaatagacttagaacagtgcctggacatagtattttctgaatctgaggaagagttatacatagctaatgaagcttaaccttcagcatttctcactagaatagaactctttcaatgttagaggagaagccccagcaattatgtatccataacttaatattagttcttataagagactgaacaaactgtatcagcttcaggaccctttactcagtaagtattagctgtatcatgacacctg

SEQ ID NO: 33142 - DNA, 601 bp, Human
gaaggcctgactcaaaagtatactgtatgattccatttgtatgttgttccagaacaggcaaaactaatctataatgacataggttaaaaccatatgatcacctcttggggtggtggtatgatatggaataggaaggagcatgaaggaaccttctagggtgctagaaaagttatatatcttgatctgtctatggttaaggggtgtatacaaacgttaaaaaaaatcaggtagtatacttaagattggtacacttcattgtatgtatgttatgtattaattttaaatgaataaaacaaaaatrcacagcacagcaataatattaaagacttacaggaaagtgaaaatgtatgtaaaagtacacacctgtgaatctaataatgtaagaaaatgtatcttcaatgaacaggttatctcttattaacactgttaaccataattgcctaattttagaatttttggttttcctggacatgactggctaacaattaagtacacttcttctacagtggaaaggatcattattattataggtaaccaataaaaatcatcactacaaaatagtattttcaattagctgaaagaatcctggaactgacattat

SEQ ID NO: 33143 - DNA, 601 bp, Human
ttaagtaactgcatgtatacttaaaaagaaaagaaaagaaaaaaacccaggtaaattagcacctgaaaaatacctactatacattcttatacttccccttcccaccaaccccagttaagagatacatttattttggtatgaagaaaaacagcaagtaataccagaaaagaactcagtaggtgggatcaatgaatgctaaaaagatattctaagaaagaaaaccttcttatactttctcactgctgcttaagactgtattttagcgttgaaaaagactttagttatgtattttaacactctccttttaatgatagggcctatagctctaaaaggttaaaagacccagggtcaacacttaaaataacaaaggttggtcccatataaaacttatttccacaacaatggggttcactgggtcaaaactgatactggagtccagtatgtttgtaaataatctaatgcttttatttcctcatttcaaatagtcatacatggcttttttcttttctttcttttttttaccttgtccaaattccattttctaaaagactgatttgcttggtccccctattgggtaatgtaagcaccacacttttgaaag

SEQ ID NO: 33144 - DNA, 601 bp, Human
cctcaaacctatgtgatatagtaggagacacgataagggtaatcactctagcactttactgaggctccaaaggaaggtcttcaggactcagaccttagttatagattaaaagaagttagtaacttatgtctttaggtgaatgcacacttacaggtagacatatagcttagaaggtatataagctctggaaaactttgtaatttggagttggtctggtgatgatgttcagaccttctccctgtaaccagttacagaaataactctcttcctccccagttcatctgcatctcgttattgggcygtgagaaatagcagcccgaacctcagtttggtcccagaacaaattaactcacaaacagaaagtcaaatactgcatgttctcatttatgagtgggagctaaataataggtacacacagacataaagatggaaatgtagggactctaaaaggaggaaggttgggagggaggggtgagagttaaaaaattagctatttggtataatgttcactatttgggtaaggggcacactagaagcccaatctctgccagtacacaatatactcatgtaacaaacatgcatgtgtacttccaatgtaaaa

SEQ ID NO: 33145 - DNA, 601 bp, Human
ataaaagtagagactaaaaggtaggcttgggtttagcatttcttaaatgttaaaatatataaaataagacacatgaacaattggtgaaatcttcccagttaaactcataaccccaagtcatcattagtccattaaaaagtatctagcaacatcgtcctatccccaccataacctggaactacactggaagggtgggaggtatggggtcacgttcttgtcatttggcatataagaaatgttgacttaatggagttcttcttttagggttatgaggactcagtcccctacaacctacttcataaaaaaaaaaaaaaaaaaaaaaacaactttctattcagatacaacaaacatacagaacagtgcatatcttagtgaagcatcacaaagtgaatataccatctaatgaccatctgggacaagagggtcatgaaaaaatagtaacaacaccctagaggccttcctcctgcaggattctctttacaaaatcaaaacatttcaaagacagtaaaatgacagcaggacaactttgctctctgttgatcagagaaaacacaaaatatccaaactcaagcatattttctaatgattttaaatactattt

SEQ ID NO: 33146 - DNA, 601 bp, Human
tgtccaggaagtcagaggtcagaggtcaggttacagagctatgatcatgccactgcacttggcctggacaagtgaaaccttgtctctttacaaaaaaaaaaaaaaaaaaaaaaaatgctgggcatggtgtctcaggcctgtaatcccagcactttgggaggccgagacgggcagatcacttgaggtcaggagttcgagaccagcctggctaacatggtgaaaccctgtctctactaaaaatacaaaaattagctgggtgtgatagcgtgtgcctgtaatcccagctgagacaggagaatcrcttgaacctgggagacggaggttgcagtgagttgagatcgtgccactgcactacagcctgggtgacagaatgagactctgtctcaaaaaaacccaaaaaacaaaaatgaaaaaacaaacaacaacaacaacaacaacaacaacaaaaacacagaacttgcagtcctttacaactttaatttctcagatctggagtgacttcattcctaatatctgcccatcagacagattcatgtgttggtactaatttcctagtagatgtacatattttattttaagctgttttcagggcatctctcaa

SEQ ID NO: 33147 - DNA, 601 bp, Human
agctggttcaacttttctaatgaagagtttggcagtaaaaatttttaaaacttggctgaggcctgtggcctgtaatcctagcactttgggaggctgaggtgggaagatcactttaggctaggggttcaagaccagcctaggcaacacagtgagacccccatatctacaaaaaataaaaaattgaaaaaaaaattagctgagagtggtggcccatgcctgtagtcccagctactcaggctgaggcaaagatcgcttgaggttgcagtgagctatgattgtgccactgcattctagcctggawgacagaatgagaccctatctcttaaaaaataaataaaatagcagcctgggcaacacagtgagacctcgtctctgctacaaataaaaaaattagctgggcatgatggcatgtgcctgtagtccttagcccccgctactgaggagactgaggcaggtggatcgcttgagtccaggaggtcaaggtgcagtgagtggtgatctcaccactgcactccagtctggggaacaaagcaaaaccctgtatcaaaattaataaaaataaaataaaataataaaataaacacttgaaaatgttcatggc

SEQ ID NO: 33148 - DNA, 601 bp, Human
cagtgagccgagatcgcgccactgcactccagcctgggcaacatagcaagactccacctcaaaaaaggaaatacaactatgcttactacaaagccacaaaaccatagagggggcttgttagatagaataattattaataacaaaatagtgcactgttaacccaaaagagagatggctaagaacatagcacttttagcctaccgtattgacaaaagttaactgaattataatattcagtgctactatatcaatagaaaactggcctgggaatgtaagctggttcaacttttctaatgaagastttggcagtaaaaatttttaaaacttggctgaggcctgtggcctgtaatcctagcactttgggaggctgaggtgggaagatcactttaggctaggggttcaagaccagcctaggcaacacagtgagacccccatatctacaaaaaataaaaaattgaaaaaaaaattagctgagagtggtggcccatgcctgtagtcccagctactcaggctgaggcaaagatcgcttgaggttgcagtgagctatgattgtgccactgcattctagcctggaagacagaatgagaccctatctcttaaa

SEQ ID NO: 33149 - DNA, 601 bp, Human
tacttagctcttttgtcaaaaagaatgcaggtagttgtgtttctgtttgggagattattctgaattagggatttcaaatgcctaagaaatgaggtgtttttgatttgtggttttgtccaaaagaaaacagattccacaaatataaacgcgtagtaggtagcacaagttaaaaaatatatagatagcacatttaacattgtctttctagataggcaaaaaatgctgttccttcaatggtaggccacgagggaggcccaggttcaattttcagccatgctgtataaaaacgttttaaaaatgrtattcctgtaacagctacactgcatcaatggaaaaccggttttcaaaaggtccaacaaagaaacaaacattcagtactgtgctcctaaaaaactaaagattctaatgaagtactaaattactgcaataaactctgcaaaactttcatcatggaatcttcattcatgataatatcttccttgaggtaataacattaaagttaagagaggtatacaggtaaaaatctcactataacaaattttatgtttgctgtaggaaaatacaaagtaaccaatattaccataggggcagtaacttgggc

SEQ ID NO: 33150 - DNA, 601 bp, Human
atgacttttgatgagagaggttgcaatgattactccaggtgcaaagcaggtgaagtaaggacccaaagcaagcaatgaaaagacctatccaaagtgaaacaaatatatgtaactagcaactaataaggactagggaaacgctgactcagaaaacaaaaagcctgacaatgaatgtcaaagagaaataaatatgtaactagcaactaataaggactaggggaacattgattcagaaagctaaaaaggctgacaatgagtaaaagaactcttaatttccttccccactgttgcttatattcctaataataaatctgttctatgaggcaaatatctaagaaaatggtgcttaatatgaaggctaggtcgagcgcagtggctcacgcctgtaatcccagcactttgggaggccgaggtgggtggatcacgaggtcaggagttcaagaccagcctggccaagatggtgaaaccccgtctctactaaaaatacaaaaaactagccaggcgtggttgtgggcacctgtaatcccagctacagaggcagagaatcgcttgaacccaggaggcggaggctgcagtgagctgagactgcaccactgcactc

SEQ ID NO: 33151 - DNA, 601 bp, Human
ggaggattgtctgaggccaggagttcaagaccagcttgggtaacatagcaagacccctatctctacaaaaaataaaaaattagctgagcatggtggcacatgcctgtggggactcccagctactgggaaggctgagatgagaggattgtttgaggccagaggttgaggttgcagtgagccgtgatggtgtcattgcacttcagcttaggaaacagagcaagaccctgtttaaaacaacaacaacgacaacaacaaaaaccaacgaaacaatactctataggggaacatcaaaaaacatagyaaatactttcaacaactaaattttagtattgacagtcatattagtcaaataaagttaaaaaaagataaaacatatcttctagtacctgttaatactagaacaaaataggctttcctgcagttttttcttggacgtaagaagtaaaacgttttagaaatttaggatactctcgctttgccactgcccttaacactgaggctggtgcccatcctccagggttcactgcaagataaaggaaaattaaaatgtattaagatacaattctccaaacatatgtgaagcacttaatttgttcccttg

SEQ ID NO: 33152 - DNA, 601 bp, Human
atgtggtatgggtgcctgagtgagcaggaccttgaataagtgtgaggtcctctctaggcttcagcttcctccgcctcctcccctcaccgcagccgccttcctccacccatccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagcygccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctg

SEQ ID NO: 33153 - DNA, 601 bp, Human
cccagctcatatttccaacttcttttggaaaatcaggaaacccactcacactgagccagaatccctgcaaggcaacatcctgactggagcagaatggggcctgccctttggatacagctcacactttccagtgtacccctgtccccaccactcctgtttgtctcccatctggctccggtaggcatgtgcgtttgcagctctgtattagctgatcctgttctcccagcacaccccgcactcccacccctccccgcctggcacatgccctctctcgcccatgctgcctctttgcagcccttcrtgatttgcctgcccgactcccccaccagaaggggcagggcctgggctgattcagatcccagtacaaagcctggcacacaggacatgacacacatttggggaaagagtggatgatattccaccagctgtggaatcgggagtatctgttaagggcagcgcagttctcagaattgtcccagctacaaaaggcctgaggaactgtcttctttcatcctttcattttccaaaaaagaaaagaatggcctagagagggtaagggatcccctgacgaagaggagcagagccagctagaacctgggcc

SEQ ID NO: 33154 - DNA, 601 bp, Human
catggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggakcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttc

SEQ ID NO: 33155 - DNA, 601 bp, Human
atcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcrtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttg

SEQ ID NO: 33156 - DNA, 601 bp, Human
catgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctayatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaag

SEQ ID NO: 33157 - DNA, 601 bp, Human
agacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagstttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggca

SEQ ID NO: 33158 - DNA, 601 bp, Human
tcatgcaagtcctcttttttttttttttttttttttttttttgagattgagtctctgggctcactgcaagctccacctcccaggtttacgccattctcctgcctcagcctcccgagtagctgggactacaggcacccactaccatgcccggctaatttttttgtatttttagtagagacggggtttcactgtgttagccaggatggtctcgatctcctgacctcgtgatccgcccgccttggcctcccaaagtgctgggattacacttgagccaccacacccagccatgcaagtcctcttrtccagactttgcttgacagcaaagtgactttcccaagtggtcatctgccattggatgggaaatttgctctaattatgtcttggatgtttggtctctcagtagggtgttaagtcatgtaatttactgatcaaattaggacactcaagaatggaaagggtggtattaataatgatgggacaccacgtgtaaatcaggactgttccaagcatgctgggatggatgtgtggtctcctaaacatgagctttgggcaaattactaaatgtttctgtacctcaggtaccaaatcctaccgttctact

SEQ ID NO: 33159 - DNA, 601 bp, Human
tgcttaaaagaaaagaacttcagttttactctattgccctggactagaatcataacagtatgagaccttgaagaagtcatgcaagtcctcttttttttttttttttttttttttttttgagattgagtctctgggctcactgcaagctccacctcccaggtttacgccattctcctgcctcagcctcccgagtagctgggactacaggcacccactaccatgcccggctaatttttttgtatttttagtagagacggggtttcactgtgttagccaggatggtctcgatctcctgacctcrtgatccgcccgccttggcctcccaaagtgctgggattacacttgagccaccacacccagccatgcaagtcctcttatccagactttgcttgacagcaaagtgactttcccaagtggtcatctgccattggatgggaaatttgctctaattatgtcttggatgtttggtctctcagtagggtgttaagtcatgtaatttactgatcaaattaggacactcaagaatggaaagggtggtattaataatgatgggacaccacgtgtaaatcaggactgttccaagcatgctgggatggatgtg

SEQ ID NO: 33160 - DNA, 601 bp, Human
ttgagtatgggctcacatacattaaacagattaacagactggaaaggagccatactgtctaagtacttcacttatttttctgattttattgagttttacatataatttataattaatctcaggtgatcatttattcagcaaacatttcttgaactcctgggtgccagacataggtctaggtgccggggacaaacaaaacaatgaaaacagaatccctgcttttagtctaaataatgtattagtggtaataagtgatatgaagaaaagtaaggtgaagagctggaaaatgttagtggttggrgaggtagtgtgctccttcataaactgtgatcaggaaaggccttttggatgaagtgacttttgatcagagacctaagttgagcgtgagaggagtgagccttgtgactgtctgggggaagaatcttccaggcaggaaaaatgcaaaagccccaggttggtgggagtgtgccagtgtggctggagcagagtgagcaagggaggggggcaggtgggatatgaggtcagaagggtagcaggagggcaggtcttgttcagccatggtaaagggtttggcttgactcctggtgaaatggaaagtctt

SEQ ID NO: 33161 - DNA, 601 bp, Human
ctacaaacacattgtgctttctggagggtctactatgtatcctggcctgccatcacggttggaacgagaacttaaacagctttacttagaacgagttttgaagggtgatgtggaaaaactttctgtaagtattagtaaatcaactattactaacattcttttaaaaggctatacagtagtttgtgaatcttgacaaccaccagagggagcaagacgtcttccaaaacaaattcctactgcagtcaagtgcatcctggaaatgatagcaagaaggaaatagttcaagataagctctggtcayctctatagagttggtggatggaggcagtgaggtcagggccaaaagttctggttcatctgtaacaaccagcacggactctgaggcacctgtatatgcatgagaagaacctgctgtactatagggaaataaatgccccacttgagttttgttctttttttaaacttattttttggatatgcaatcagccttcagcacttctcttgggctatctcatatttctgactttatttgttgcatatgttgtcttctcagtcagattgaaaaacatcatgtctcaaaattttttgcattccggtgact

SEQ ID NO: 33162 - DNA, 601 bp, Human
aaaggccaaaatgggtgcaaatcagctcccaaactttactgtgagaattattcctcagaccctcgctcagattctgttacttttactacatatgcagtctttttagattggattttctgatctcatagatatcagaatagagggtactgctgtcagtagatagcagggtactgtatcagaaaagagggtactgctataagaagcatacacatcagtctagccaaaaataacagcagacagcctctaagcaaaggaacaaaaaagaaaactacaaaagataaatgaaaaattaaaaagcagraattctggattaaagtagaatagggctaattatagtaaacaaccacatcttagtggctttagggaagcatgtgataaaatagtttgtaatgtaaatcttggtcattattagaagtctcagttatattcacaaaaaagtgtattatatacttttagaagtattttattttcatcaaaattatgaaaagattttatatgtaaagaggggtcgttacttcacagtagtaataacagcaaatattcagccctgtgatttacatgtggaattttatttaattctcccagcaaccccgaggctgac

SEQ ID NO: 33163 - DNA, 601 bp, Human
atagggattagggagatgattttgttctttgatgttcattcacagcaaaattgtatttaaaagtacatgccagctgggcgcggtggctcacgcctgtaatcccagcactttgggaggctgaggccggtgaatcacgaggccggcgaatcacgaggtcaggagttcaagaccagtctggccaaaatggtgaaaccccgtctctactaaaaatacaaaaaattagctgggtgtggtgacgggtgcctgtaatcccagctactcgggaggctgaggcaggagaatggcgtgaacctgggaggcrgaggttgcagtgagccgagatcgcaccactgctctccagcctgggtgacagagtgagactctgtattaaaaaataaaaaaagaaaagtacatgcctgttgctgattagagcttcgacgtacctaaagtgcggagtcagattcagtaccttctccacagagtttgcattgcaaagtggaacaactcaaattttgttttgtgtgttctgcatgttgaaaatgtacatgtaaatgcttgtgagtacttatcacatgaatctgtatttcaactgcttagtttatgcgacattcactgggcttgc

SEQ ID NO: 33164 - DNA, 601 bp, Human
aatagccacctaattaattttgatgggatggctttggagccaggatagtaatagaaattaataaaaatagcaattgactcataacaagctataaacctggtagaagatgatcagaaatcgaatctagccttcataattatggtaaattctcatgatagggattagggagatgattttgttctttgatgttcattcacagcaaaattgtatttaaaagtacatgccagctgggcgcggtggctcacgcctgtaatcccagcactttgggaggctgaggccggtgaatcacgaggccggcgaatcacgaggtcaggagttcaagaccagtctggccaaaatggtgaaaccccgtctctactaaaaatacaaaaaattagctgggtgtggtgacgggtgcctgtaatcccagctactcgggaggctgaggcaggagaatggcgtgaacctgggaggcggaggttgcagtgagccgagatcgcaccactgctctccagcctgggtgacagagtgagactctgtattaaaaaataaaaaaagaaaagtacatgcctgttgctgattagagcttcgacgtacctaaagtgcggagtcagattcagta

SEQ ID NO: 33165 - DNA, 601 bp, Human
catatggagatcctgtctttacataaatttttttcaaaaagattagccaggtatggtggtggtgtactcctgtagtcctagctactcagaaggctgaagtgggaggattgcttgagcttgagaggtagaggctgcagtgagccatgattgtgtcactgcactccagcctgggtgacagagtgagaccctgtctctccccaccgccacaaaagaaagttcctaaaaaaaaaacatatatatatatataaaacatatttttatatgtttaagggacttgtttgtttgtttgagatagagtctygctctgtcgccaggctggagtgcagtggtgcagtctcggctcactgcaacctgggtggagtgattctcctgcctcagcctcccaagtagctggaattgcagacgtgagccaccacgcccagccttaagggacattttaaatttttttttttggcaaattgttaatggctttttgtagattttggagttttgggttttttttttttttcagttttgaaaagttttcttttagctttctgatatctttcacagatactctgtttgccatttgtctattgctcttagtgttttggccatgcaa

SEQ ID NO: 33166 - DNA, 601 bp, Human
aatcgcagcactttggaggctgaggtgggaggtttgcttaagcctaggagtttaagaccagcctgggcaacatatggagatcctgtctttacataaatttttttcaaaaagattagccaggtatggtggtggtgtactcctgtagtcctagctactcagaaggctgaagtgggaggattgcttgagcttgagaggtagaggctgcagtgagccatgattgtgtcactgcactccagcctgggtgacagagtgagaccctgtctctccccaccgccacaaaagaaagttcctaaaaaaaaaacatatatatatatataaaacatatttttatatgtttaagggacttgtttgtttgtttgagatagagtcttgctctgtcgccaggctggagtgcagtggtgcagtctcggctcactgcaacctgggtggagtgattctcctgcctcagcctcccaagtagctggaattgcagacgtgagccaccacgcccagccttaagggacattttaaatttttttttttggcaaattgttaatggctttttgtagattttggagttttgggttttttttttttttcagttttgaaaagttttctttta

SEQ ID NO: 33167 - DNA, 601 bp, Human
caagctctgcctcccgggttcacgccattctcctgcctcagcctccccgagtagctgggactataggcgcccgccaccacacccggctaattttttgtatttttagtagagacagggtttcattgtgttagtcaggatggtctcaatctcctgaccttgtgatccgcccagctcagcctcccaaagtgctgggattacagacgtgagccaccacgcccggcctggcataacatttttaaaagcaaaacagaatgtgataagagcagttacctaaatctatttaatttacctttttttccccaaatatattttaggaaaaattgttgttggtaatgattttggttacagaacagatgtatttataagtactagtgttccggagaacactgggaaattttaatcttttgctgattagtacctgattattcttggtttctagctcccagatggacgtatcatcaaagttgggggagagagatttgaagcaccagaagctttatttcagcctcacttgatcaatgttgaaggagttggtgttgctgaattgctttttaacacaattcaggcagctgacattgataccaggtacattagaaatggt

SEQ ID NO: 33168 - DNA, 601 bp, Human
agatgaagaccctatctcaaaaaaaatatatatgtattgtagggccaggcatggtggctcatgcctgtaatcccagcacttttgggaggccaagccaggcagatcacttgaggccaggagctcgagaccagcccagccaacatgcagaaactctgtctctactaaaaatacaaaaattagccaggcgtggtggcacatgcctgtaatctcagctacttggggggctgaggtatgagaatcatttgaacccagtaggcagaggttgcactgagccacgatcaagccactacactccagcctrggcaacagagcgagactctgtctcaaaaaaaaattaaattataaatgtactgttagacttgttaatgtaaaattaattctggtatctcatggaaatgtgtcaaatgctagcatacatgggcgtgcttattacttaggacaatccagtgaattgtgaggtgttatgagaggaagtttctacttaacacttctcatttaattaaatatgaacatgatgtgtgactgacaagatttttttgtacaaagtcataatatgatacctgatttgtttaaatcttatttgcttaaattgaaattatat

SEQ ID NO: 33169 - DNA, 601 bp, Human
ataggtacacatgtgccatggtggtttgctgcacccatcaacctgtcatctgcattagatatttctcctaatgctatacctccctccccttgccgccccccacccaacaggccccatgtgtgttgttcccctccctgtgcccatatgttctcattgtcagctcccacttatgaatgagaacatttggtgtttggttttctgttcctgtgttaatttgctgagaatgatggtttccagcttcacccatgcccctgtaaaggacatgaactcattcatttttttatggctgcatagtattccrtggtgtatatgtgccacattttctttatccagtctaacgttgatgggcatttgggttggttccaagtctttgctattgtgaatagtgctgcagtaaacatatgtgtgcatgtgtctttatagtagcatgatttataatcctttgggtatatacccagtaatgggatcgctgggtcaaatggtatttctagttctagatccttgaggaatcaccacattgtcttccacaatggttgaactaatttacactcccaccaacagtgtaaaagcgttcctatttctccatatcctctccagcatc

SEQ ID NO: 33170 - DNA, 601 bp, Human
ccaacatggtgaaacccgtctttactgaaaatacaaaaaattagctgggcaaggtggtgggcacctgtagtcccagctattcaggaggctgaggcaggagaattgcttcaacccaggaggcagaggttgcagtgagctgagatcgtgccactgcactccagcctgggtgacagagcaagactccatgtcggtaaaaaaaaaaaaaaaaaaaagttaagatagtgatccaaatattcagtaaacccccatttaaaaattttttaaatttattttttattatactttaagttctgggatacatgtgcagaaaatgcaggtttgttacataggtacacatgtgccatggtggtttgctgcacccatcaacctgtcatctgcattagatatttctcctaatgctatacctccctccccttgccgccccccacccaacaggccccatgtgtgttgttcccctccctgtgcccatatgttctcattgtcagctcccacttatgaatgagaacatttggtgtttggttttctgttcctgtgttaatttgctgagaatgatggtttccagcttcacccatgcccctgtaaaggacatgaactcattcat

SEQ ID NO: 33171 - DNA, 601 bp, Human
gtgtggtggctcacgcctgtaaccccagcagtttgagaggccaaggcagacagatcacttgaggccaggagttcgagaccagcttgggcaacatggcgaaactctgtctctacaaaaaaattacaaaaattagccaggcatggtggtgcatgcctgtagtcccagctgctcaggaggctaaggtgggaggtatgacttgaacccaggaaatgaagattgcagtgagcctagattgagccactgtactcctccagcctgggtgacagagccagaccctgtctcaaaaaaaaaaaggaaaaawaagtcctgtttttcagtcctcagtctcagggtctgtttcttctcatctccttggacagcacataatagtagactaaaagtcttaaaagagaacactcgctttaatacttatgcattagaaacaaactgcaaaataactaaataataaattctggcttctagttggttacgtttctgttttggcttccctactgtatttggaactcgctggctttggttttcctgatttgactttttatttaaatccccctggcttttatgcaggtttattgactggtgtagtggtagactctggagatgg

SEQ ID NO: 33172 - DNA, 601 bp, Human
tctgcatttacaggtaatgtttgaaacttaccagttttccggtgtatatgtagccatccaggcagttctgactttgtacgctcaaggtaggttaagcttaactgttagaaaaaacacttcatcaaacatttattatgtatgttttatgtcagagaatttggtttctcaataagttataagccccagaaaactacattatttatataccacactttgaaatattttcagtttttaaaatttgtgaaataagattttatatacatttttatttgctaaatatgtatttaaggtaaaaaaaaaaggcttaaagacttattttttaaaaaataggatattctctcttttaagctatttaaattttttttgagacagattttcgcttttgttgcccaggccggagtgcaatagtgcaatcttggcttaccacaacctccacctcctgggttcaagtgattttcctgcctcagcctcccaagtatttgggattacaggcatgtgccaccacacctggctaattttgtatttttagtagagatggggtttctccatattggtcaggctggtctcaaactcctgacctcaggtagtccgcccgcctcag

SEQ ID NO: 33173 - DNA, 601 bp, Human
aattaattcactctgtgaccatgaggaaaacatttatttattatgtaattttctaaataccagtttttttctttctgtctgcatttacaggtaatgtttgaaacttaccagttttccggtgtatatgtagccatccaggcagttctgactttgtacgctcaaggtaggttaagcttaactgttagaaaaaacacttcatcaaacatttattatgtatgttttatgtcagagaatttggtttctcaataagttataagccccagaaaactacattatttatataccacactttgaaatattwtcagtttttaaaatttgtgaaataagattttatatacatttttatttgctaaatatgtatttaaggtaaaaaaaaaaggcttaaagacttattttttaaaaaataggatattctctcttttaagctatttaaattttttttgagacagattttcgcttttgttgcccaggccggagtgcaatagtgcaatcttggcttaccacaacctccacctcctgggttcaagtgattttcctgcctcagcctcccaagtatttgggattacaggcatgtgccaccacacctggctaattttgtatt

SEQ ID NO: 33174 - DNA, 601 bp, Human
aggcaggagaatcagttgaaccctggaggtggaggttgcagtgagccaagattgcgccactgcactccagcttgggcaacagagtgagacttcatctcaaaaaaaaaaaaaaaaaaaaaagaatttcccttaagggatatcaattaagaaagtcttgttcaatacagagagctttctttcacactaattagtcattaactaatacactaagaaatctttgctttgtcacgcttatgaaatgcttggggacttagaaatctgtcttcagatttggagctctgtggcagcaggactttaatargaaataagaggagctgatgaaaatggaagactatttcaggtccatttgattctattttgggcaattaattcactctgtgaccatgaggaaaacatttatttattatgtaattttctaaataccagtttttttctttctgtctgcatttacaggtaatgtttgaaacttaccagttttccggtgtatatgtagccatccaggcagttctgactttgtacgctcaaggtaggttaagcttaactgttagaaaaaacacttcatcaaacatttattatgtatgttttatgtcagagaatttgg

SEQ ID NO: 33175 - DNA, 601 bp, Human
tggtggtgcatgcctgtagtcccagctactcaggaggctgaggcaggagaatcagttgaaccctggaggtggaggttgcagtgagccaagattgcgccactgcactccagcttgggcaacagagtgagacttcatctcaaaaaaaaaaaaaaaaaaaaaagaatttcccttaagggatatcaattaagaaagtcttgttcaatacagagagctttctttcacactaattagtcattaactaatacactaagaaatctttgctttgtcacgcttatgaaatgcttggggacttagaaatctktcttcagatttggagctctgtggcagcaggactttaataagaaataagaggagctgatgaaaatggaagactatttcaggtccatttgattctattttgggcaattaattcactctgtgaccatgaggaaaacatttatttattatgtaattttctaaataccagtttttttctttctgtctgcatttacaggtaatgtttgaaacttaccagttttccggtgtatatgtagccatccaggcagttctgactttgtacgctcaaggtaggttaagcttaactgttagaaaaaacacttca

SEQ ID NO: 33176 - DNA, 601 bp, Human
atcaccccactgcactccaacctgagcgacagagcgagactctgtctcaaaaagaaaaaagaaaaagaaaaaaaagttaatgaaataatgaaataagcagttacagaggaaagagagagcaagagagctatgatcctcatagtttaaataagtaatttttcaaggttcttttatttttgtatatatgaagtagaaatttaataacttctgtagctttccagttactgtttaatgtacatattttgtttacgaatatgtttaaatgttgatggaaatttttgaaagggtttagaagaaaatkttgttagtatttttaaagcctgtattaaaactcagtttttgtattaagtgttttgaaaatctaagatcatggttttaaagaatccatatgatttcttatggcttatattttaatattcttatttgtttatgactacaaatatgtctatgactgatagtgtcctaccttaatctcattaacatgctttcacattggtatgtgcatatatatgatcattcttccattttcatccctgtggaggtggaataaaggatgatggaataaaatactattcagactatctaattgcttaattgatga

SEQ ID NO: 33177 - DNA, 601 bp, Human
aagatagaagagttggagactttttcagtcatttaagcaaaagataatgatggttaggattgaagtagtagtagtagagatagtgagaaattaccagattataggtctgttttgaaggtagggctataaatgatacggttcaacaaagaagagggtagacagtggtgaaaaggccaaggaccagagagataggaggagccagcagaaggagattgaaaacgttattgaggccgggctaggtggctcccagcactttgggaggccaaggcgggtggatcacttgagactaggaatttgagaycagcctggccaacatggcaaaactccgtctctactaaaaacacaaaattagctgggcatagtggtgcacgcctgtaatcccagctacgcaggaggctgaggcaggagaattgcttgaacccaggaggtggaggttgcagtgagctgagatcaccccactgcactccaacctgagcgacagagcgagactctgtctcaaaaagaaaaaagaaaaagaaaaaaaagttaatgaaataatgaaataagcagttacagaggaaagagagagcaagagagctatgatcctcatagtttaaataag

SEQ ID NO: 33178 - DNA, 601 bp, Human
ataccttaagtggatgtagatcatcataaagatcttcatcgtcattgtcttcacaccgacgaagaagaggaggggttggtcttgctgtctcgggtggcagagacagaagaggtgcaaggggaggcaggaaagatttattgacaaaaatcgtgtataagtggacctgtgtggttcaaacttgttgttattcatggatcagctgtagatgctaaaggcaaaataaatcaggttaacggggagtgggaggttgtaattgtacataggttgtgagaaggtgatgtttaaacagacagggtaagtragttagccagggtatataggagaatggtattccagataaagggagtagccagtgtaaaggtcttaagttaggaacaagcttggtatattaaagaataagcaaggaagccagtgtggttgaggagagagcaacagaagatgaggtcgagtaagtaatattggtgccttgtaggctctaattaggaattgggcggctggaagtggtggttcaggcctgtaatcccagcacttctgggaggccgaggtgggcggatcacgaggtcaagagttcgagaccagcctgaccaacatagtgaaacgc

SEQ ID NO: 33179 - DNA, 601 bp, Human
gcaccaaccctccctactcacgtgcaaacttaactaccacccaaaatacttaacttctaatagcctactgttgaccagaagccttactgataacataatatgtattatatactatattcttaacaataaagtaagctagaggaaatactgttaagaaaatcatggccgggcgcggtggctcacgcctgtaatctcagcactttgggaggcggaggcgggcagatcacaaggtcaggagatcgagaccatcctggctaacacggtgaaactccgtctctactaaaaatacaaaaaattagcygggcgtggtggcgggtgcctgtagtcccagctactcaggaggctgaggcaggagaatgacgtgaacccttgaggcagagcttgcagtgagtggagatcgtgccactgcactccagcctgggcgacagagcgagactccgtctcaaaaaaaaataaaaaatcataagagaaaatacatttactataccttaagtggatgtagatcatcataaagatcttcatcgtcattgtcttcacaccgacgaagaagaggaggggttggtcttgctgtctcgggtggcagagacagaagaggtgcaag

SEQ ID NO: 33180 - DNA, 601 bp, Human
gcaaatatctacttctgatactagtttttttaattgaatttatcaacatatgtagaaattagtattatttaacatcttgactagctgttctctaaaaataagtctaaatgctaggacatccttacttattatatatagaaaatgtgactttcaaatgtgggtcatcttaagtatgctctcattggagacaagacttgtgagtattatgcttcatgtgtgatggtgtagttttccagtatactttaagattgaaaatgttgctcaggagacaattttaaaggatgggttatttgcctatatmttaattttttataactctacaaattctcattcaccttggtgaggcatatgtagaaacagtttaaattcttattcaggcatatgtagatagaagtttgtgctatttataagttagttggtgtatgtatgcattattatagagtaataaagaatcattttattttttgcttctttcattatgctttatagtacttacatttatcattttgatatttagtgcaaagaaatgtgctgcatgcattgagcatttttctacaagtttttttccccctgatgtgctatttcacatatcacaggcctt

SEQ ID NO: 33181 - DNA, 601 bp, Human
cctgtaatcccagctactcaggaggctgaggcaggagaatcgcttgaacctgggaggcagaggttgtagtgagctgagatcatgccactgcgctctagcctgggcagtagagcgagactcagtctcaaaaaaataatctcgtgttaattttgctgctgcttttttttgtctctccataattaaaacttaacgtattgtagcaaatatctacttctgatactagtttttttaattgaatttatcaacatatgtagaaattagtattatttaacatcttgactagctgttctctaaaaataaktctaaatgctaggacatccttacttattatatatagaaaatgtgactttcaaatgtgggtcatcttaagtatgctctcattggagacaagacttgtgagtattatgcttcatgtgtgatggtgtagttttccagtatactttaagattgaaaatgttgctcaggagacaattttaaaggatgggttatttgcctatatcttaattttttataactctacaaattctcattcaccttggtgaggcatatgtagaaacagtttaaattcttattcaggcatatgtagatagaagtttgtgct

SEQ ID NO: 33182 - DNA, 601 bp, Human
tggtggcaggtgcctgtaatcccagctactcaggaggctgaggcaggagaatcgcttgaacctgggaggcagaggttgtagtgagctgagatcatgccactgcgctctagcctgggcagtagagcgagactcagtctcaaaaaaataatctcgtgttaattttgctgctgcttttttttgtctctccataattaaaacttaacgtattgtagcaaatatctacttctgatactagtttttttaattgaatttatcaacatatgtagaaattagtattatttaacatcttgactagctgttytctaaaaataagtctaaatgctaggacatccttacttattatatatagaaaatgtgactttcaaatgtgggtcatcttaagtatgctctcattggagacaagacttgtgagtattatgcttcatgtgtgatggtgtagttttccagtatactttaagattgaaaatgttgctcaggagacaattttaaaggatgggttatttgcctatatcttaattttttataactctacaaattctcattcaccttggtgaggcatatgtagaaacagtttaaattcttattcaggcatatgtagata

SEQ ID NO: 33183 - DNA, 601 bp, Human
aaggtaaggatactcaattccaaacatttctttcagttaatcctttatagtatgtgtggtcctagaagtagatacatgaggcatttatttagagttggcattgggtcatgtaaatgtaagcccctatttgtacattaaataaaaagtaaatttctgttgaaatcagatcagacttatttcaaattggttgaaataatactgattatattatctaattatctaatctgttatcttgtacaacacacaaaaaagacgtaaagttagtaacaaaaatggtatatataattacaggtatagatttcccccctaacattttattaagcagtattaagaaaatgtagcaatattgaaatgattttacaatgaaacttgtatatccatcacctggattctgacattaatatatatcatactgatttattacatatctgttcatctgttcattcatcagtgcatcttgttttttgatggatttcaaagtaagttgcagataccagtatacttctccctgaatacttcaacatgtgcatgttattaactagaattcacaaatacagatttttagttttgcatattcctcatagaagaatctaaacggttg

SEQ ID NO: 33184 - DNA, 601 bp, Human
tttgtacttcttaaataagttaatactccattttaaatgtcctgtttgttctgaggaaggtaaggatactcaattccaaacatttctttcagttaatcctttatagtatgtgtggtcctagaagtagatacatgaggcatttatttagagttggcattgggtcatgtaaatgtaagcccctatttgtacattaaataaaaagtaaatttctgttgaaatcagatcagacttatttcaaattggttgaaataatactgattatattatctaattatctaatctgttatcttgtacaacacamaaaaaagacgtaaagttagtaacaaaaatggtatatataattacaggtatagatttcccccctaacattttattaagcagtattaagaaaatgtagcaatattgaaatgattttacaatgaaacttgtatatccatcacctggattctgacattaatatatatcatactgatttattacatatctgttcatctgttcattcatcagtgcatcttgttttttgatggatttcaaagtaagttgcagataccagtatacttctccctgaatacttcaacatgtgcatgttattaactagaat

SEQ ID NO: 33185 - DNA, 601 bp, Human
ttgagtttactctgtattctaatttgaggtgacattgttcaaaatgattcttggcaaatataatccctactacccacttttcatgaagtataaatacctttgaaacagcatctcagttactgtgatttttttcattgtttcagataggtgatgttcagtggcggggcaggtggttaaaacctaaggtctgatctgatcacttataacttggttctgagtgatgaaggcaagttatataacacttagtaggatttttttattaaaattttcgatatgaaaattttttaattggatagcttgwatagtcaaactttgtacttcttaaataagttaatactccattttaaatgtcctgtttgttctgaggaaggtaaggatactcaattccaaacatttctttcagttaatcctttatagtatgtgtggtcctagaagtagatacatgaggcatttatttagagttggcattgggtcatgtaaatgtaagcccctatttgtacattaaataaaaagtaaatttctgttgaaatcagatcagacttatttcaaattggttgaaataatactgattatattatctaattatctaatctgttatctt

SEQ ID NO: 33186 - DNA, 601 bp, Human
tctatagaaagttttttaaaaagtaaccaggcatagtgatatgtgcctcccaagcaacttgggaggttaaggcaggagtattgcttgagcccagaagtttgaggctgcagtgggtgatgacagggccactgcactccagcttgggtgacagagcaaaaccctgcctctattagttaattgaacaaacaaacaaatgttttcagtggaattttcttctagggatttaattgtgcttttgaacttgagtttactctgtattctaatttgaggtgacattgttcaaaatgattcttggcaaatrtaatccctactacccacttttcatgaagtataaatacctttgaaacagcatctcagttactgtgatttttttcattgtttcagataggtgatgttcagtggcggggcaggtggttaaaacctaaggtctgatctgatcacttataacttggttctgagtgatgaaggcaagttatataacacttagtaggatttttttattaaaattttcgatatgaaaattttttaattggatagcttgaatagtcaaactttgtacttcttaaataagttaatactccattttaaatgtcctgtttgt

SEQ ID NO: 33187 - DNA, 601 bp, Human
caggtgtggtggtgtgtgcctgtaattccagctactcaggaagctgaggcaggagaatcgcttgaacccgggaggcagaggttgcagtgagccgagatcacgccactgcattccagcctgggcaagagtgagactccatctcaaaaaaaagaaaagaaaaggaaagagtgcgcttgtagagaacagtgtaggcttattttaacagaagtttttgaccgagtgaggtgtttcatgcctataattccagcactttggcaggacgaggtgggaggatagcttgagcccaggagttcaagaccakcctgggcaacatggcaagaccctgtctctatagaaagttttttaaaaagtaaccaggcatagtgatatgtgcctcccaagcaacttgggaggttaaggcaggagtattgcttgagcccagaagtttgaggctgcagtgggtgatgacagggccactgcactccagcttgggtgacagagcaaaaccctgcctctattagttaattgaacaaacaaacaaatgttttcagtggaattttcttctagggatttaattgtgcttttgaacttgagtttactctgtattctaatttgaggtgac

SEQ ID NO: 33188 - DNA, 601 bp, Human
ttgggacatttgttttatgtaggaaggtggtaatgggtggtagagatttgctatgtagccttctgcttttgggatagagagttgagttacacaatgaataaaaatacaacctgaaacttgggttctgtgttagtttttttttttcagagttaaagtagcgaatttttctggcctctcctgttaacaaaaaaaataaaatgggacactcagtgtaagtttttcctttttaaggagcttttggaatatttgtgggattccttacttgcttattgtgaactcctttcattctgaatgaattctmtcttaaatgaactttgactggaaattagctaataatagtgataaggataaactgtttaatgaagttgaaggctatactttttattcagtgtcaggtttttaaagaatggcttttttatatactggacaataaaatttttgaggtatgaagaaatatcatgtatagccataaatttattttgcaacataggcacaaataactacacatctcttcatgcccactttcttcgtgtttaaggccaagtgatagaaatcaaatttgtcagtatgctaataaaacatttttgccaaggaattccct

SEQ ID NO: 33189 - DNA, 601 bp, Human
cacagggtgtaaatctcattgattcctcttttcattaatataacttatttccataatgtgcagaaggaagccattcaagcctttatttggccttggattatgtatcttaccataaagaggaaggaaagttttcattgcctactcgctgtatttaagatgaaagactacatgaaaagacgatcgatttttctcccatattaaagggatcagaaatcaagtaggagttacaatatttaacaagaaagagaacagtgagaggacagtagtcaccagttggctttaagttcttcaggtgactgarggatcaagttatacagaatgccatagaatttagggtcttttttagtgaattatttgtgaacacgctagcattgtttgtcctatctggatagtctttagcaagccttcagtgtaaggttatgagtcatttgaaatatgcattagggcgtatctctttgggacatttgttttatgtaggaaggtggtaatgggtggtagagatttgctatgtagccttctgcttttgggatagagagttgagttacacaatgaataaaaatacaacctgaaacttgggttctgtgttagtttttttttttca

SEQ ID NO: 33190 - DNA, 601 bp, Human
gactttttcttttcatgtttttatggcctgatccctctacttttttatatagccatttaggaaaacacagggtgtaaatctcattgattcctcttttcattaatataacttatttccataatgtgcagaaggaagccattcaagcctttatttggccttggattatgtatcttaccataaagaggaaggaaagttttcattgcctactcgctgtatttaagatgaaagactacatgaaaagacgatcgatttttctcccatattaaagggatcagaaatcaagtaggagttacaatatttracaagaaagagaacagtgagaggacagtagtcaccagttggctttaagttcttcaggtgactgaaggatcaagttatacagaatgccatagaatttagggtcttttttagtgaattatttgtgaacacgctagcattgtttgtcctatctggatagtctttagcaagccttcagtgtaaggttatgagtcatttgaaatatgcattagggcgtatctctttgggacatttgttttatgtaggaaggtggtaatgggtggtagagatttgctatgtagccttctgcttttgggatagagag

SEQ ID NO: 33191 - DNA, 601 bp, Human
agaaatcggcctggtatttttatgtctttcaattccatatatttgtcattgtatgtgagtgtctctttggcaccttagactttttcttttcatgtttttatggcctgatccctctacttttttatatagccatttaggaaaacacagggtgtaaatctcattgattcctcttttcattaatataacttatttccataatgtgcagaaggaagccattcaagcctttatttggccttggattatgtatcttaccataaagaggaaggaaagttttcattgcctactcgctgtatttaagatraaagactacatgaaaagacgatcgatttttctcccatattaaagggatcagaaatcaagtaggagttacaatatttaacaagaaagagaacagtgagaggacagtagtcaccagttggctttaagttcttcaggtgactgaaggatcaagttatacagaatgccatagaatttagggtcttttttagtgaattatttgtgaacacgctagcattgtttgtcctatctggatagtctttagcaagccttcagtgtaaggttatgagtcatttgaaatatgcattagggcgtatctctttgg

SEQ ID NO: 33192 - DNA, 601 bp, Human
cgtcaagaaaggaagtagcctgctccttcctgcagcgtcctgctggtgtgacagcacgtccccaagctcagtgctaacctccttattaaacatcccctgctgtgactcagggaacccacatgggtactctaaaacagtcattcagggaccccacggggtcatgtgggagggagacagatcccagaaagagcacaagtgagtcattaccaaaaactccaaggcccgcacaccggacgcacatacccagctaggggcagactcaaagatcccagcccttatcttctccccatatcagagctcrgaagccagaaatcttcctaaggcaggtgaaagcaagccgagccccactgctgaaggacaaagccacaggaagcctgatgacatctttcctctgaggcttccaaacgatcaccccaaattgcttgctgatactgggaagagtggccatgaactctccattgctctgctggctgtggaatgtttgctcagcacaggaagcatttaaggagaaagtcaaagtagccaaaaggcaaaccagatggtggtggacatgtgggtgacagagcatcctgcatttgttgcctcggggtgcagccccaaa

SEQ ID NO: 33193 - DNA, 601 bp, Human
cttttaacttataagcctgttgattagcctatacgagttatttgcacgtcaagaaaggaagtagcctgctccttcctgcagcgtcctgctggtgtgacagcacgtccccaagctcagtgctaacctccttattaaacatcccctgctgtgactcagggaacccacatgggtactctaaaacagtcattcagggaccccacggggtcatgtgggagggagacagatcccagaaagagcacaagtgagtcattaccaaaaactccaaggcccgcacaccggacgcacatacccagctaggggsagactcaaagatcccagcccttatcttctccccatatcagagctcggaagccagaaatcttcctaaggcaggtgaaagcaagccgagccccactgctgaaggacaaagccacaggaagcctgatgacatctttcctctgaggcttccaaacgatcaccccaaattgcttgctgatactgggaagagtggccatgaactctccattgctctgctggctgtggaatgtttgctcagcacaggaagcatttaaggagaaagtcaaagtagccaaaaggcaaaccagatggtggtggacatgtg

SEQ ID NO: 33194 - DNA, 601 bp, Human
atgaccggcagcttccctcaagtggcttcccagagactactaggagaacttggtcctatcgctgcccccacctggaagctggacttaaggatcccccaaagaacggggcaattagaaacctcccacccagcgaagggataagcttctcaactcagtcccaccactcttcatcgcaaccctctgagtctgcagcagaaacaaacatctccaagttacagaggaggggatggaatccccaaggggccgagcggtagcccttttaacttataagcctgttgattagcctatacgagttatttgyacgtcaagaaaggaagtagcctgctccttcctgcagcgtcctgctggtgtgacagcacgtccccaagctcagtgctaacctccttattaaacatcccctgctgtgactcagggaacccacatgggtactctaaaacagtcattcagggaccccacggggtcatgtgggagggagacagatcccagaaagagcacaagtgagtcattaccaaaaactccaaggcccgcacaccggacgcacatacccagctaggggcagactcaaagatcccagcccttatcttctccccatatcagagct

SEQ ID NO: 33195 - DNA, 601 bp, Human
cccattctcactgccggcacatcccccacattctcctcacactctgccagctcccctctggccagcgccggcaccttgcagccgcccaacacggcccctcctgggccacctgtgccccctgacctacgcctctccccccagccctttggccggtcctcaccagtcccctgtttgcactgacatgctgcctccacctgcccttcgatgtccccccagccatgccccttctcacctagcaccacttagctcctctcaccacctcggctcctacggaccccatctgcgagacccccaccctctscacctccagctcaggcctcccctttctgggcccagaaccacgcatgccccacgccccggcacccgacacaatgctcctcaggcgcctaaactgcccttggccaagctcagcttgctgctctccccacacccacacatgctctcctgagggtctgatcaggccatgcagccccttggtgggacactccggcttcactgtgagaggcggccccatggccctcattagagcagacgtgaagtgtgtgtgattctgactcttatatcactttttgatcagttcttggttctgtagcttccaaat

SEQ ID NO: 33196 - DNA, 601 bp, Human
tgaccccgtcccctgagtctagaaccactcctgtcgtgcgtcctgttgcgtacctgtcaccaggtcagcatcccctcacctcagccactgaggcacggggacctcctcacccaggggaggaaccctggcacatctgcattatctagtctgaagagaggacacgagggactccctagaggaacagtcatcaaggggctgtttttccagggaagtcagaccctggtcatggcaagcaggacggcacagggaggacaggactcagggaggccaggcttagggagcactcacagactgagcacarcctgcatggagatgaacagggccggcacgttgaaggtctcaaagaacacctctgccgccttctcccggttcttactcgggttgagcggggcctccgtgaggagcacaggatgctgcgagggacgggacagttgtaggcatcagaggaggcaacttgcaaggccctaaaaggctctttccagagaaccacacccgctggcgcacaggcagctcagcctcctacccctcctgagggccccatccctttatctgctggcagttactcttccggagatccggctctctttggaagattctgcct

SEQ ID NO: 33197 - DNA, 601 bp, Human
gccctggagctcagggaggcagccctgagagtcggagcagggaaccacaggcctagctggccctgccagggggatacccacaacagcctgacatggcgctcaattcccacacgccagctcaaggctcctgtccatgcagctcaatgttacttgtgtgtgcatgtcctgtgtagaggggaaggctgcaggggggcactgctgtgccacccacccaggggttcagggcatgcaggggaccctaagcctagtatacgagccaagaccaaaaagggttaaaggctctgtctcccctccctccccytctcccaacatgccccgccctccttgggcactagaaagttttgcgatgaatagcacgggagccatcctcttcatactcctttttggacacccacatcttcttaaaagtgtccagcgaggccaggatggagccgctgtggggatggagggatagtattgctgtggacctgtcagggagccaaccaccttcctgggtgctcagagttgcatttccctaatttgggagggaaatccacccacctccacgtggcctaggccaacaatgggaggagcatccagggtaaagtggtctcctcccaga

SEQ ID NO: 33198 - DNA, 601 bp, Human
atatcccgtaataaggttaaagtccagcaggttttgcttggcacatagtcagtcctcctgcctgaagcaataaggcaccagcagattctccagatgctgtggcactgggaatctttcttcagaacctggagaaagttgaagaattggacaggaaggccagaaagaaatttatccttgagtcatgcttgcacctttgtcaatttgcacaggatgaatatctattttgcacactctacagaaaaaatattttttactattaagagcctgaagattgtgcttgcatattgatttctttgaccamcccccagagcaatcagcatcaataacattgccccacccaacagaggatacatgaacacacccccaacacatgcacccatacccctgaaaggacatatgaacctatttgccactcagggttattccaaaccaataaaaataaaagcatacttcaaatttcaagctactttttgggtggatcccattttgggattgccagtcactatgttaaaggatatagggtgataactttttggagcagttctgcagaggagatgacaattcggtgcatggtcagcatgacttgcaacagttggttact

SEQ ID NO: 33199 - DNA, 601 bp, Human
atatgtcaccatgcccggctaattttcatatttttagtagagatggggtttcaccatgttggccaggctggtctcaaactcctgaccttaagtgatctgcccactttggccttccaaagtgctgggattacagatgtgagctactgtgcccagacaccccaggaacaatttagtccctaggccaacaaataagtttttagggaggaatatttaatcactgacattgtttataatcactggtacatgaaattaataaaaagtagacactgagttggtttcatgatggtttaaaattctctgyagaagaggcacccacttattacctgcacctcttatttatgtgcacttctcgcaatgctcccccactttgtgtgctactggaaaacacctcctttgagatgagaggtaaagactcatgagtaggtatagagaagggattcagtcctgatggtttttattttttctgtgtgctgtaagatgaaacgcggggaattaggagagtggaaaagtgttagagcagctacaagtcatgacacagtaccagggacctgcgccttgggtgctaaacggtctcactccgcctacaactcttcttttgtgg

SEQ ID NO: 33200 - DNA, 601 bp, Human
aatcacccacagaaaggaagctgagtaagaggaaaaccaggacattacaccatatgtaagcagagctcgaagaagcctctagatgaaaagctggagaaggcccaacccaagaggtaggaaagccaggagggtgtcgttccgggagccttggagggagagctgggaggagaacggggttgtcagtcatgcctaatgcttctgggggtcaatggaaacaaggatgagaaaaagccattgggctttgcaatcaggaggttactggtgacatcagaggaaagttcgaatactgggggccaacttmacacagttacgaagtgaggagtagtaaagagattggagatagtgagtgtagactattttaagacgctttcacatcaaatttttaaccctaacaatggaatgaaggggaggtagggttaagagttgatttttagatgaggagacttgaatgtgttttaggctgaggggcaggtgccattgaagaggtagagtttaaaagtataggaggggtgatagctggtggagtaagattctgtgagaagtacgagggaccatgggaaagggagggggggtctgccccaatatgtaggcagccagtagt

SEQ ID NO: 33201 - DNA, 601 bp, Human
ggacagtgggctaatgcatatattaaagtcttaagtgttagcaggacaaactggtataaacctaagaaaaatggtttaggttagatggctgggtgccgtggctcatgcctggaatcccagtactttgggaggctgaggtgggaggatgacttgatgccaggagtttgagaccagactaggcaatatagtgagacccctctccccgcaccaatttccaaaaaaaaaaggaaaggtttaagttagagaaatccagacttgaaagtcaccatcagcacagaagaatggtggaaacagtggtagraattctggtgagaaatcacccacagaaaggaagctgagtaagaggaaaaccaggacattacaccatatgtaagcagagctcgaagaagcctctagatgaaaagctggagaaggcccaacccaagaggtaggaaagccaggagggtgtcgttccgggagccttggagggagagctgggaggagaacggggttgtcagtcatgcctaatgcttctgggggtcaatggaaacaaggatgagaaaaagccattgggctttgcaatcaggaggttactggtgacatcagaggaaagttcgaatac

SEQ ID NO: 33202 - DNA, 601 bp, Human
acagtattcagtacagtaacctgctgtacaggtttgtagcctaggagcaacaggctgtaccgtctagcctagaagtgtagcaggctatgccatctaggtttgtgtaagtacactctatggtgttcacacaatgacagagtcgcccaatgatgtatttctcagaatgtgtcttaggcaaaacaaggctgtactggtgtcgaagcagaattaatgaggtagtggctgtgggtggggacagtgggctaatgcatatattaaagtcttaagtgttagcaggacaaactggtataaacctaagaaraatggtttaggttagatggctgggtgccgtggctcatgcctggaatcccagtactttgggaggctgaggtgggaggatgacttgatgccaggagtttgagaccagactaggcaatatagtgagacccctctccccgcaccaatttccaaaaaaaaaaggaaaggtttaagttagagaaatccagacttgaaagtcaccatcagcacagaagaatggtggaaacagtggtaggaattctggtgagaaatcacccacagaaaggaagctgagtaagaggaaaaccaggacattacaccatat

SEQ ID NO: 33203 - DNA, 601 bp, Human
actgtgtagagtcaaagttttaaaaattaagtttataacataaagtcacagtaagctaaattattattgaagaaagaaaaatattttttatcaatttagtatagcctaagtatatagtgtttataaaacctacagttatgtacagtaatgtcctaggccttcacattcactcaccactcacccctgactacccagagcaacttccagtcctgcaagctccattcatggtaagtgcccccctatacatatcattttttaatcttttataccatatttttactgtactttttctatgtttagrtatataaatacttaccatgtgctacaaccacctacagtattcagtacagtaacctgctgtacaggtttgtagcctaggagcaacaggctgtaccgtctagcctagaagtgtagcaggctatgccatctaggtttgtgtaagtacactctatggtgttcacacaatgacagagtcgcccaatgatgtatttctcagaatgtgtcttaggcaaaacaaggctgtactggtgtcgaagcagaattaatgaggtagtggctgtgggtggggacagtgggctaatgcatatattaaagtcttaag

SEQ ID NO: 33204 - DNA, 601 bp, Human
tatctctagaatcacagtgacttctgggccaggaccacttcaaggatttaggtatgttctgggctagggcagtagaatctattttgggatttcccagagccattcaaagcttaccccagaatgaattcaaactctgagaggacatatcctctccccgcccccgcacccccccccctttttttttttgaggaagattttaaaaagagttgttgaagcctaatgattatcaggggtatgaggattatcaggggtatgagggtagaatgagagagacagagagagagagagagagagagagagwgtgtgtgtgtgtgtgtgtgtgtgatgtgtgcccacagtatggtaacttgagtgagtggtgggatggtatggggcgggggcatggaagaagagagatgggagaagcacaggagtcacaatcaaaggaattcagatggtactgattttttcagactctatgatgtctggcaggaaagcctgccacgacttgagggggcctctaaggttatgaagcggatgggctgttgaattatcatcttattttcagaaatatcccagggaagatttttctcctgccccttgcatacataccgatatcctc

SEQ ID NO: 33205 - DNA, 601 bp, Human
cttcacacagctatttacaaggtaattctgataatcagagaactgcaggaaaagaaacaacaacaacaaaaaaaacctatcagtactgtactctggtattccagaagatttaagggacaagtccagtctgctcagttgatggctgggaactgccatggaacagaggagctcctggtgctcttctgcatcttggccacttgccaacaagcatgatgggagggaaatcttccttattctacccacagcatgatttctctacatcgaaagttattaggaataagtggatgtgtagacacattasttaatccaaatgctgtatttcagtagatattgttactgactattctaaattctaaagaatacagtacagaataaagatcagtattgctgctaaggttaagggaataaaaggtaattcccctgacaaaaacaaatctctctctccccagctgttttcttaccttaaaaatgtgatcataaaatctgccctatctaggacatagaattgttatgaagatcaaagaagataatgtgtgaaagctttaactttttaaagtgttacatatatgtaaggttgcgctaatggagtagttatgaacct

SEQ ID NO: 33206 - DNA, 601 bp, Human
tggccccctcccctccacactgtccttgtatggaagaagagacaagtcaccatatctagatctggttgaaggcacacaaacctctccaccccctcgccatggttcaggagggaaaaaacagctctaattaatagactaagctggaggaaaaggggatagaaagtttaccttatagcccaagccaaatgtcttaaaccagttattcacctgagccacctggatgaacttgatgaagacttctgctcggagctgcggcgtggggcggctgagaaccatcagttgtacccactgggagatgccrttgcacagagcaatagatcgctccatggtggggttttccttcacacagctatttacaaggtaattctgataatcagagaactgcaggaaaagaaacaacaacaacaaaaaaaacctatcagtactgtactctggtattccagaagatttaagggacaagtccagtctgctcagttgatggctgggaactgccatggaacagaggagctcctggtgctcttctgcatcttggccacttgccaacaagcatgatgggagggaaatcttccttattctacccacagcatgatttctctacatc

SEQ ID NO: 33207 - DNA, 601 bp, Human
cttattgatttcatgtgggacatgcgaacttgtctccttgagcctcgagattgagctgtgacacagcccacctatcacagccatcagtgtattgaagttctgtagttggtggagcttctgtgacacagaagacagatgacagcagagtcactgtacatgtcagttatatggggagcttagaggctgcctcttgtctctgtgccgtgagtctcccttaacgctggttaaagactagttacgaggcattgcaatttcctgtccatgtctccccttctgctttattcagactggtggattccamatctgggaggcattacatctctctccttttgttgttgctgatctgtggaccaccttctagatcagtgctttcttagaatcacctcaagtatttgtttaacacaatggtttctggacctaacccagacattctgattgcctggatctggggttaggcttggagatctgtacttttaatatacctttagttaatatcagagcaggtgatccaaagtcagagctgttgactttgagaaacactggtctagaccatccagagttggagaaagatattattaagtgtaatcttttatttattcca

SEQ ID NO: 33208 - DNA, 601 bp, Human
cccatgccatacatttatatcctcggtatattacagtggtttatatttataacaacagctccagctggactcagtggctcatgcctgtaattccaatactttaggaggccgagatgggaggatcgcttgaggccaagagttggagaccagtctggacaacatagggagacccttatctctacaaaaattttaaaaaatagctgggcataatggtgtgcacccatggtcctagctacttggtaggctgaggtgggaggattgcttgagcccaggagtttgagactgcagtgagctatgatcrtgccagcctgtgctccagccttgatgacagaggaagaccctgtttctataaaaaagagaaacaagcaaaacagccctatgtcataaaagataaaagtatattctgtaaaatctaataatgtaggaaaatgtacaggacatttaagaaaaatattcattaataaaacattatgtattacaaaatggtatctgaagaactcatatccaattatctggtaaaattcaactatccggaatgtcattcttcaagggttctggatagctaagtttttaatatatcactatataactacactcaatg

SEQ ID NO: 33209 - DNA, 601 bp, Human
aaataaataataaaatttatgaattatttctgggattttccattaaattttttttggactgcagttgacctcagataactgaaactacaggagacaaaacctcagataagggggactactgtaacccttttagacactgtgcccaaacttaataaaattgtggcctacgaagtaccatttctccacaatgaagaacttggagttcttggagtcagaccccttcaaatcactgggagatggcaagagagcttcttcttcataaacctctaccaatggtgcaggtgagccctaggcatggaargggctcacaagacaagagtgtaacagcaaaaatgataaagatatttttattcccctccgaaggtgaaatcaacaacttggggacttttgcttcaaccctggacttactaattcactatgcagaccaccctgagggtcaagtagctaccgacaggaagcactgctgtggggggaccccaagctgaagaggagcaagctctctcttataagctaaatgacatgaaggcttcttaatctctgtgactatttctctctgtcacctctgagatgtgggcaatcttttcaactgttccacctggtt

SEQ ID NO: 33210 - DNA, 601 bp, Human
tcaatcaataaataaataataaaatttatgaattatttctgggattttccattaaattttttttggactgcagttgacctcagataactgaaactacaggagacaaaacctcagataagggggactactgtaacccttttagacactgtgcccaaacttaataaaattgtggcctacgaagtaccatttctccacaatgaagaacttggagttcttggagtcagaccccttcaaatcactgggagatggcaagagagcttcttcttcataaacctctaccaatggtgcaggtgagccctakgcatggaaggggctcacaagacaagagtgtaacagcaaaaatgataaagatatttttattcccctccgaaggtgaaatcaacaacttggggacttttgcttcaaccctggacttactaattcactatgcagaccaccctgagggtcaagtagctaccgacaggaagcactgctgtggggggaccccaagctgaagaggagcaagctctctcttataagctaaatgacatgaaggcttcttaatctctgtgactatttctctctgtcacctctgagatgtgggcaatcttttcaactgttc

SEQ ID NO: 33211 - DNA, 601 bp, Human
ccggtaattgtcgtagtttctggaggaggacagcagctcagtcatctcaccgagaacctacaaagcagaacagaccaatcacaggtacccgctaggcagtgtgcattgtctgtaatgaggaccttgcatgtttgcatcctgtgccatgatctcaccccatccagaatttgttgagcagggggtaattcatgtaaaaggtacagattatgactccccagttaaaacctcagctatgtcaaatatcacagaatatatttataaacacaagatatgcttgaatctgttatataacttaaacatyataaatcggggttttatcatttttatgttaaaatttccttcttttcaaaaacaaggacctgatacaaaaattaaaaaggtacaagaatatatagtgaacactatccctctaactcctgtccccaagccatgtgattcccttccttggtgtcttctgaatgcttccagagacactgcattgattaacagttgaaatgtgatgtcaggaaatgctgactatgttgctggcatggggaagagcatgtattttaagagtggagcttcagtagtctattgtgtgttattctctatgaggtgcttg

SEQ ID NO: 33212 - DNA, 601 bp, Human
agactacactaagtttcttaaattttttcttcaatgataaattaccttattttactgtaaaagcttttaatttttttaacttttactcttttgttatgacacttagcttaaagcacacattgtatagcttatagctgtaccagttatttcctttatagccatattctataaacttttttctattttaaaaatgtttaattttttaaatctttgttataaactaaggtacaattacactcattggcctatgtctatatagagtcaagatcatcaatatcactgtcttccactccacatcttrtcctattggaaggtctttaggggcaataacatgcatggagctgtcaccttctggaggacttgcctgaggctgttttacagttaatttttctaagtagaaggaatgcactctaaaataatgataaaaagtattgtatagtaagtgcataaaccggtaatacttactatcaagtattatgtactgtacgtaagtgtataacctagactttttacagctcagtaggtttgtttacaccagtataatcacagacatagtgagtaatgtgttgtgctacaatgttacaattgttctgtcactagg

SEQ ID NO: 33213 - DNA, 601 bp, Human
gcagttctctatagcagcgtgagaatggactgatacaccaggaatatgtcaacaatattgagtcttacctttacatcgatatccttgtttgatcactccccagagctatgaaacaagagacagaatgcaccacatgtcattcatccatctggtgtgaggctacaaggtgacattcctttattttccttcattttactctctagctcaagtgggaaggaaacctcatttatctctcatgtcttgtcccttctgaccttaaatccatgagaagagtttatgctgatcaaagtttctcaagaarcaggtttttttttttttgttttttttgagacagtcttgcccagttgcccaggctggagtgcagtggtgcgatctcggctcactgcaacctccacctcctgggttcaagcaattctcctgtctcagtttcccaagtagctgggactaccaggcatgttccaccacacctggctaaatttttttgtatttttagtagagacgggttttcaccatgttaggtgggctggtctcgaactcggggcctcaagtgatctgcctgccttggcctcccaaagtgctgggattacaggcatgagccacc

SEQ ID NO: 33214 - DNA, 601 bp, Human
ggacagttatgtcctgagtgataaaggaaagctgacaagggcctttagtaatcatttatcttctgttgcagaagagattctatctttttcactggggacccacccttccatgactatatgagagcaccatctcctacctgctatccctgttctaggccagccacgacagaaagaggattttatacagagaaaatgcctatctgtgcaaccaggcatttctctcttcggtgtggcggtcattcaccgggggtgtccgagggaaaccactttggggatgagactctgaactctgctgagaagytgtggactaaatggacaactactatgggtaaaaaatgttttagaggtgggactctaagaccagctgatatggtttagctctgtgtccccatccaaacctcaccttgtagtgcccataatccccatgtgtcatgggagggacccaatgggaggtaaatgaatcctgggggcggttaccctcatgttgttctcatgatagtgagtgactgctcatgagatctgttggcttcataagggcttttcccccttttgctcagcacttctccttcctgccagcatgtgaagaaggatgtgtttgctt

SEQ ID NO: 33215 - DNA, 577 bp, Human
tttggctcccaatgagcaaaggttggacactggccccacagcaagtgttgttctctgtgggagctactgggttcttggctcgcttcttacactcaaacacaaccagatctttgcattgtttgtgacagttcatcccgcagtctgtggacaagacatcctgggtcaagaagtctttcacttttctctcttccccagtgtgtctcacaaccaaattcatgcagtgctttcttgtcacacatgtctgttctatcttctggagctaagacacttaacattyctaatgaagctagcattcttctcacttggtgaagcccagagctcacactcttgatgtagcccttatcagtgaatctcagcatcagaagcagtatcctgatatcttggagggaagagatggtgtcctggtatcccatacattctgcctactctagggagaccctccggaaacactcagctgttaggtcttattttctttcttgcagtaaaaggtttcctctctttcactcctgaattctcctagtcacaaggaaggacagttatgtcctgagtgataaaggaaagctgacaagggccttta

SEQ ID NO: 33216 - DNA, 601 bp, Human
attaaaaagaaagtaacaaagtgttactataagtttatatgccaggtagtgggcttaagcaggcctgctttgggtatttctgagtttaaatttggaaaacggtaaatacgtgtgtaaaactattctttataatgtaatgaaacactaactacaagctagttctatatcactaaaactcagtgcaaggaggaactcaaatgggaactgatctttcatcaaagagaattcctaaatgatctgaatcctccaggtaagcaatactgtatgtatactttgtattcttatgaagacttggtgctaytggctttagtttggaacttttaattgttaacatattcttggcaattggacaacttgtttatgaatttcaagtcagtctggtaccagactttataggcatggaagctaagtacccccaaaaaggaaaatgatcatatgatttttttttttttaagagaactaaaaagaggctgacaaatgaatttgtgaataggtgcccaggcaactaaatgagcccatttattattaaccttcataatagaaaactcacaggattgttacttgtgattttgccaaacaatacaattttaccttgtgagca

SEQ ID NO: 33217 - DNA, 601 bp, Human
cacacacagaaatccaaatgccaagtcctgccagcagtgggaggttgagaacagccacacacaaaaaaatggcatgtaacctgagattagaaagccctctctgtgcctgaatcactggcagctgaacacacctaaacctgtttgtccgagagcagttctccaaaaacagtccaccaactttggtttcagtaaaacccaaagtaaaacaaactgtatctgtggctcaggctcccaaacaaaagtcttgcaacttctaagacaattagctaactttatagagtgagcagtgaaggaggaaackctgagagaagcccgccggctcttacctgtgagctgtatgccaaggagaagaagcaccgcacgagtagagctcttgccatacatgagggaaacccagccttggccccagagaccggacggggcagaccgagggctccaacaccctgccaaggccactccgggaggagcaagcaccgcgttttcccagagagaggagtttgagttgagttcctcacctgtgcctgtgactcagcccgctctgcctgtgcacttttctgaaatgaaaggtggggcctcagctcccaatgccctccttcctttc

SEQ ID NO: 33218 - DNA, 601 bp, Human
tttcgtgtactttgctctttgttgcttggcatggttttccagattgtcctttatagggatgcagacaatacaatgcaccaatttagagcacagttttagattcaaagttgattgggtttgagtcctaagttactccatttatcagctacgtgactcagggcaaatgacttaacctctgtgagcctcgtttcctcattggcaagatgggaggcattaaatgcacaataaactgatgagatatgtaaagattaaataaaatgtgtcatgtaaagcccctgacatttgggaagtactcagtaartgttagctcccatcattagtacctgcctcctagagtggtgtggggattcaatgagatagtgtatgtcatgcacttttgacggtgcctagcattagagtaggtactcaataagtatctcgaataaatgagtgagtgaacagacctgttgtaagcctttcatcaaagaattgctccctctccctttcacaatctcaatgccatttttgtaacggattctctgagttcctttgctttactttctgtttctttccacagccaaacaaagcctttctctttttaccccagaactcttcggtctcc

SEQ ID NO: 33219 - DNA, 601 bp, Human
aaaccactgggtgggttgaactacttatggggtaaggtttttgctaacctcatcaaacgtagtgcccaacccatttctccctgacttctcaccactttcactcagtcagttatttattcagatttattaagggcctactacattcctggcactgtgatagaaatgctgagccaaaaaagacatcaccttcaaggagctcatgccactgagaggataggaaagtaaatcagaagctacagtctagtggataaatgatggaaaagggaaaccagagggaaggtcccctaagccacactagaggctgtgaaccctggttttcttgtcctttagctttatttctgattatacttccataagccctcagagccagaaaggacattagagaatgtctagcccaggattcccagccttgactccatgaaggaggatggggaagaggatggaaggtagtctgcaagcccacagaatccaagtctcattttgtatgtctccactgttttatgggaagcagggccatggcttttatttgattctcaaagaataattatccacatatatttaagaaccactgattttttgtgtgtttaacctcttcattgtg

SEQ ID NO: 33220 - DNA, 601 bp, Human
ggagaaaaagattaaattaggattctaaaaagaagaggactacaatgaaatctaatgacataatagggatgcatttaatcaatagatggaatcttcctttatcctacctttatgcataaaataatatattaccttgtgaatcctactagcaataggaaaaccatacacatactttaatggttctcaaagtgtggtcttcgaagtaacagcaacaatatcacttgagaacatggaaatcttaggccccaccccagacctactgaattagaaacactagaggtgcggctgagcaatctgtgtyttaacaggtcctccaggtgattctgatgcagctttgaaaaccactgggtgggttgaactacttatggggtaaggtttttgctaacctcatcaaacgtagtgcccaacccatttctccctgacttctcaccactttcactcagtcagttatttattcagatttattaagggcctactacattcctggcactgtgatagaaatgctgagccaaaaaagacatcaccttcaaggagctcatgccactgagaggataggaaagtaaatcagaagctacagtctagtggataaatgatggaaaag

SEQ ID NO: 33221 - DNA, 601 bp, Human
tagggatatggggtttctttacgggagggagcttaaaaacgttctgcaattagtgatgattgctgcacaactttgtgaaaatgaaaaaggtaaattttatggtgggtaaattttatctcaattttaaaatacatttaatgaacacctgctatcagcacaacagactttcctaagccctgactcatagtggccctgctgactgcctagcccagtggtttttacaaatgtatgcttcactttaaacataagggattttttagaaaagctttacatagcacatttttgtaaaatcaacccccccacatagtaaagaaatcccataaggaaatattttgtaaaattaagaaagcttttgtaaagttactagttcatacctgatttatctgtcctgcaaatgtgaattcttttatataggatttacttaaagggaaaaacatctgttcagcaactatttagcccactgcaaaataccaagagtcgccataagagtgttagaactttcccagaactgcccagccttacgattttatctccaccactttatgagctctttcggcccatcgctttttccggtaatgctggaagaggaccactacaatta

SEQ ID NO: 33222 - DNA, 601 bp, Human
gaaccgtgagccaattaaatctctttataaattacccagtcttaggggtttttttatatagcaacacaagaatggcctaatacacggttatgattaaaaaaaaaaaagacaatgagtgttgaggaggatggggagaaatcagaaccctcatatattgctgacaggaatgcaaaatagtccagctgtttaaagacagtctggcaattcctccaaaaactaaacagagttaccataagacccaacaattccacttttaggagaattaaaaacatatgatctacacaaaagcttgtaaatgaatgtttatagcagcattagtcacaacagccaacaagcagaaaaaacctaaatgcccatcaattgaatggacaaacaatatgtggtatattcatacaatggaatattatgcagtcataaaaaggaaagaaatactaatacatcaacaaggatgagccttgaaagcattatgctaagtgaaagaagctgggcataaaagaccacatattgtatgattctatttaaatgaaatgtccagaataagcaaatccatagagacagaaagtagatgagtagttgtcgggggctggtaggaggggataat

SEQ ID NO: 33223 - DNA, 601 bp, Human
tggcttggtgctgtcttcaatagtgagtgagttctcacaaaatctggtcatataaaactatgtagcacctccccccaactctctcactttctcctgctctcaccatgcaaaattcctgctcccattgtgccttctgccatcggtaaaagctccctgaggcctcctcaggagccaaccaacatcggcgccatgcttgtacatccacagaaccgtgagccaattaaatctctttataaattacccagtcttaggggtttttttatatagcaacacaagaatggcctaatacacggttatgatwaaaaaaaaaaaagacaatgagtgttgaggaggatggggagaaatcagaaccctcatatattgctgacaggaatgcaaaatagtccagctgtttaaagacagtctggcaattcctccaaaaactaaacagagttaccataagacccaacaattccacttttaggagaattaaaaacatatgatctacacaaaagcttgtaaatgaatgtttatagcagcattagtcacaacagccaacaagcagaaaaaacctaaatgcccatcaattgaatggacaaacaatatgtggtatattcataca

SEQ ID NO: 33224 - DNA, 601 bp, Human
ggtcatgggagcagatctctcatggcttggtgctgtcttcaatagtgagtgagttctcacaaaatctggtcatataaaactatgtagcacctccccccaactctctcactttctcctgctctcaccatgcaaaattcctgctcccattgtgccttctgccatcggtaaaagctccctgaggcctcctcaggagccaaccaacatcggcgccatgcttgtacatccacagaaccgtgagccaattaaatctctttataaattacccagtcttaggggtttttttatatagcaacacaagaayggcctaatacacggttatgattaaaaaaaaaaaagacaatgagtgttgaggaggatggggagaaatcagaaccctcatatattgctgacaggaatgcaaaatagtccagctgtttaaagacagtctggcaattcctccaaaaactaaacagagttaccataagacccaacaattccacttttaggagaattaaaaacatatgatctacacaaaagcttgtaaatgaatgtttatagcagcattagtcacaacagccaacaagcagaaaaaacctaaatgcccatcaattgaatggacaaa

SEQ ID NO: 33225 - DNA, 601 bp, Human
ggtggggcctggtggagggtgtttgggtcatgggagcagatctctcatggcttggtgctgtcttcaatagtgagtgagttctcacaaaatctggtcatataaaactatgtagcacctccccccaactctctcactttctcctgctctcaccatgcaaaattcctgctcccattgtgccttctgccatcggtaaaagctccctgaggcctcctcaggagccaaccaacatcggcgccatgcttgtacatccacagaaccgtgagccaattaaatctctttataaattacccagtcttagggktttttttatatagcaacacaagaatggcctaatacacggttatgattaaaaaaaaaaaagacaatgagtgttgaggaggatggggagaaatcagaaccctcatatattgctgacaggaatgcaaaatagtccagctgtttaaagacagtctggcaattcctccaaaaactaaacagagttaccataagacccaacaattccacttttaggagaattaaaaacatatgatctacacaaaagcttgtaaatgaatgtttatagcagcattagtcacaacagccaacaagcagaaaaaaccta

SEQ ID NO: 33226 - DNA, 601 bp, Human
aaagcagacaccttattttaccattagtatcccacctctaatttatatttgttattcaaaaaaaaaataaaaagttttgtgttgacctaagtcatctttattggttctattcaaactagaacctcagagttgggtttgttaggcttcttaaaattagttctgtttcgccaggcgcggtggctcacgctgtaatcccaacactttggaaggccaaggcaggtacatcacttgagatcaggagttcaagaccagcctgaccaacatggtgaaaccccatctctactaaaaatacaaaattagytgggcatggtggtacatgcctgtaatcccagctacttgggaagctgaggcaagagaatcgcttgaacccaggaggcggaggttgcagtgagctgagatcatgccattgcactccagcctgggcaaccagagtgaaagtctgtctcaaaaaaaaaaaaggctgtttatttcattaaatatttattaaggaaatgagataaatggtgctggaacaactagatatccacatgcaaaagagtgaatttggacttctgcctcagccatatacgaaaacgaactcaaagatctaaatgtaaaaatt

SEQ ID NO: 33227 - DNA, 601 bp, Human
gttttaaagcagacaccttattttaccattagtatcccacctctaatttatatttgttattcaaaaaaaaaataaaaagttttgtgttgacctaagtcatctttattggttctattcaaactagaacctcagagttgggtttgttaggcttcttaaaattagttctgtttcgccaggcgcggtggctcacgctgtaatcccaacactttggaaggccaaggcaggtacatcacttgagatcaggagttcaagaccagcctgaccaacatggtgaaaccccatctctactaaaaatacaaaattagctgggcatggtggtacatgcctgtaatcccagctacttgggaagctgaggcaagagaatcgcttgaacccaggaggcggaggttgcagtgagctgagatcatgccattgcactccagcctgggcaaccagagtgaaagtctgtctcaaaaaaaaaaaaggctgtttatttcattaaatatttattaaggaaatgagataaatggtgctggaacaactagatatccacatgcaaaagagtgaatttggacttctgcctcagccatatacgaaaacgaactcaaagatctaaatgtaa

SEQ ID NO: 33228 - DNA, 601 bp, Human
agagttttaaagcagacaccttattttaccattagtatcccacctctaatttatatttgttattcaaaaaaaaaataaaaagttttgtgttgacctaagtcatctttattggttctattcaaactagaacctcagagttgggtttgttaggcttcttaaaattagttctgtttcgccaggcgcggtggctcacgctgtaatcccaacactttggaaggccaaggcaggtacatcacttgagatcaggagttcaagaccagcctgaccaacatggtgaaaccccatctctactaaaaatacwaaattagctgggcatggtggtacatgcctgtaatcccagctacttgggaagctgaggcaagagaatcgcttgaacccaggaggcggaggttgcagtgagctgagatcatgccattgcactccagcctgggcaaccagagtgaaagtctgtctcaaaaaaaaaaaaggctgtttatttcattaaatatttattaaggaaatgagataaatggtgctggaacaactagatatccacatgcaaaagagtgaatttggacttctgcctcagccatatacgaaaacgaactcaaagatctaaatg

SEQ ID NO: 33229 - DNA, 601 bp, Human
attgaagtttacacagagctaaactggtgccatctaattaataatattcacacctctgaacttagagacttttcagaatgtaagggaatacagtttgggttctgattcgggaactccagagttttaaagcagacaccttattttaccattagtatcccacctctaatttatatttgttattcaaaaaaaaaataaaaagttttgtgttgacctaagtcatctttattggttctattcaaactagaacctcagagttgggtttgttaggcttcttaaaattagttctgtttcgccaggcgcrgtggctcacgctgtaatcccaacactttggaaggccaaggcaggtacatcacttgagatcaggagttcaagaccagcctgaccaacatggtgaaaccccatctctactaaaaatacaaaattagctgggcatggtggtacatgcctgtaatcccagctacttgggaagctgaggcaagagaatcgcttgaacccaggaggcggaggttgcagtgagctgagatcatgccattgcactccagcctgggcaaccagagtgaaagtctgtctcaaaaaaaaaaaaggctgtttatttcattaa

SEQ ID NO: 33230 - DNA, 601 bp, Human
ttgggagtagattgaagtttacacagagctaaactggtgccatctaattaataatattcacacctctgaacttagagacttttcagaatgtaagggaatacagtttgggttctgattcgggaactccagagttttaaagcagacaccttattttaccattagtatcccacctctaatttatatttgttattcaaaaaaaaaataaaaagttttgtgttgacctaagtcatctttattggttctattcaaactagaacctcagagttgggtttgttaggcttcttaaaattagttctgtttsgccaggcgcggtggctcacgctgtaatcccaacactttggaaggccaaggcaggtacatcacttgagatcaggagttcaagaccagcctgaccaacatggtgaaaccccatctctactaaaaatacaaaattagctgggcatggtggtacatgcctgtaatcccagctacttgggaagctgaggcaagagaatcgcttgaacccaggaggcggaggttgcagtgagctgagatcatgccattgcactccagcctgggcaaccagagtgaaagtctgtctcaaaaaaaaaaaaggctgttt

SEQ ID NO: 33231 - DNA, 601 bp, Human
cagagaatgggagaaattctgagcatatgaaaaataaattggcccggcgcagtggcttatgcctgtaatcccaacactttgggaggctgaggcaggtggatcgcttgagctcaggtgagaccagcctaggcaacatggggaaaccccgtctctacaaaaagtacaaaaattagctgggtgtagtggcgcgcacctgtggtcccagctacttgggaggctgaggtaggaggatcacttgagcttgggagggagaagttgcagtgacccaagatcgcaccactacaccctagcctgggcaacrggttgagaccctgtctcaaaaacaaagacaagaaaaataaattatcctactttttaagcctgatgaacctgaaaactggaaaaataaaattatacgctactaaaactggattcatttcatgtagttattagtgccaataactaaatgagaggagttgaaatcaattccaaatagtacaaaagctctcctgtaaaaactgccagatatgtctattgagtcactctcttaataccataattggtttacaattaaaaaaaaagaataagcagatactaatcttttgatttaaaaaagatttat

SEQ ID NO: 33232 - DNA, 601 bp, Human
taacatctagaaattaaatgtgtggacctatttcagagaatgggagaaattctgagcatatgaaaaataaattggcccggcgcagtggcttatgcctgtaatcccaacactttgggaggctgaggcaggtggatcgcttgagctcaggtgagaccagcctaggcaacatggggaaaccccgtctctacaaaaagtacaaaaattagctgggtgtagtggcgcgcacctgtggtcccagctacttgggaggctgaggtaggaggatcacttgagcttgggagggagaagttgcagtgacccragatcgcaccactacaccctagcctgggcaacaggttgagaccctgtctcaaaaacaaagacaagaaaaataaattatcctactttttaagcctgatgaacctgaaaactggaaaaataaaattatacgctactaaaactggattcatttcatgtagttattagtgccaataactaaatgagaggagttgaaatcaattccaaatagtacaaaagctctcctgtaaaaactgccagatatgtctattgagtcactctcttaataccataattggtttacaattaaaaaaaaagaataagc

SEQ ID NO: 33233 - DNA, 601 bp, Human
acactattattcatccagttggggatcacacattgcactttgattgtgttcatctcttaagtttcttttgatctaaaacatctcccatatttattttccatgaccccaagttgttagataatccccttaactttaaaaagacaatagccgttggttggtaaaaactccctaatgttaattttggttttctggttttacaatacaatcattttactccatattctattttataaatccttgaggtctttcactggagctttagcctataaaaatgtgaccctctttgcaactaataacggtytgtaaaaaatgttctcccgtgtaacagagccagagttttacaggataaagtcattaatatcaagaactttcttatgagcgtaaaatttaagtttgcatgtccggatttataacatctagaaattaaatgtgtggacctatttcagagaatgggagaaattctgagcatatgaaaaataaattggcccggcgcagtggcttatgcctgtaatcccaacactttgggaggctgaggcaggtggatcgcttgagctcaggtgagaccagcctaggcaacatggggaaaccccgtctctacaaa

SEQ ID NO: 33234 - DNA, 601 bp, Human
ccaattgcccctccaagcttgtttttacaactagcttgttcacactattattcatccagttggggatcacacattgcactttgattgtgttcatctcttaagtttcttttgatctaaaacatctcccatatttattttccatgaccccaagttgttagataatccccttaactttaaaaagacaatagccgttggttggtaaaaactccctaatgttaattttggttttctggttttacaatacaatcattttactccatattctattttataaatccttgaggtctttcactggagctttagcctataaaaatgtgaccctctttgcaactaataacggtctgtaaaaaatgttctcccgtgtaacagagccagagttttacaggataaagtcattaatatcaagaactttcttatgagcgtaaaatttaagtttgcatgtccggatttataacatctagaaattaaatgtgtggacctatttcagagaatgggagaaattctgagcatatgaaaaataaattggcccggcgcagtggcttatgcctgtaatcccaacactttgggaggctgaggcaggtggatcgcttgagctcaggtg

SEQ ID NO: 33235 - DNA, 601 bp, Human
ttgcttttttcctatgcttttaaagtaaattgctgacatttacccctaatactccagtaagaatttttcaaaataggtacattttctttataactacaataccatcactatacctaatacaaactaacaataattccctaatattatccatatatttaacattttcatattcaagactttcccaattgcccctccaagcttgtttttacaactagcttgttcacactattattcatccagttggggatcacacattgcactttgattgtgttcatctcttaagtttcttttgatctaaaamatctcccatatttattttccatgaccccaagttgttagataatccccttaactttaaaaagacaatagccgttggttggtaaaaactccctaatgttaattttggttttctggttttacaatacaatcattttactccatattctattttataaatccttgaggtctttcactggagctttagcctataaaaatgtgaccctctttgcaactaataacggtctgtaaaaaatgttctcccgtgtaacagagccagagttttacaggataaagtcattaatatcaagaactttcttatgag

SEQ ID NO: 33236 - DNA, 601 bp, Human
gttttatttgcttttttcctatgcttttaaagtaaattgctgacatttacccctaatactccagtaagaatttttcaaaataggtacattttctttataactacaataccatcactatacctaatacaaactaacaataattccctaatattatccatatatttaacattttcatattcaagactttcccaattgcccctccaagcttgtttttacaactagcttgttcacactattattcatccagttggggatcacacattgcactttgattgtgttcatctcttaagtttcttttgayctaaaacatctcccatatttattttccatgaccccaagttgttagataatccccttaactttaaaaagacaatagccgttggttggtaaaaactccctaatgttaattttggttttctggttttacaatacaatcattttactccatattctattttataaatccttgaggtctttcactggagctttagcctataaaaatgtgaccctctttgcaactaataacggtctgtaaaaaatgttctcccgtgtaacagagccagagttttacaggataaagtcattaatatcaagaactttc

SEQ ID NO: 33237 - DNA, 601 bp, Human
agtatgtggaatttacccatcccttaaattcattaattcattcttttcttttcttttctcccctcatctcccccatcacctaattctgaagccttttttgttttatttgcttttttcctatgcttttaaagtaaattgctgacatttacccctaatactccagtaagaatttttcaaaataggtacattttctttataactacaataccatcactatacctaatacaaactaacaataattccctaatattatccatatatttaacattttcatattcaagactttcccaattgcccctcyaagcttgtttttacaactagcttgttcacactattattcatccagttggggatcacacattgcactttgattgtgttcatctcttaagtttcttttgatctaaaacatctcccatatttattttccatgaccccaagttgttagataatccccttaactttaaaaagacaatagccgttggttggtaaaaactccctaatgttaattttggttttctggttttacaatacaatcattttactccatattctattttataaatccttgaggtctttcactggagctttagcctataaaaat

SEQ ID NO: 33238 - DNA, 601 bp, Human
aaagaagtttcctaatccttattacataattttcagagttagtatccttaaatcatggcctctaagtaccttgcatggacacttggatgacccacaacttgttcacacacatacatcccatattctccccacttctcactctcattacaaacaaaatcagacatatagaaaagtagagaacagagtatgtggaatttacccatcccttaaattcattaattcattcttttcttttcttttctcccctcatctcccccatcacctaattctgaagccttttttgttttatttgcttttttcmtatgcttttaaagtaaattgctgacatttacccctaatactccagtaagaatttttcaaaataggtacattttctttataactacaataccatcactatacctaatacaaactaacaataattccctaatattatccatatatttaacattttcatattcaagactttcccaattgcccctccaagcttgtttttacaactagcttgttcacactattattcatccagttggggatcacacattgcactttgattgtgttcatctcttaagtttcttttgatctaaaacatctcccatat

SEQ ID NO: 33239 - DNA, 601 bp, Human
cacctggaatattgaaagaaattcagtaaaacaagatgtgtctcatagttaaggagagacataaaaataaaaatgtcatttaacagtttgaatttaggatttactgttaatcagaaacaccgaggaggcttagctcaccttttaattgagaatgtgggaaggaaagagagtaaacacattaactttagtagcagaagtgctgctaaaagaaatacgtgaaaggaaatgtaacagacaaattggcttttatcccctttgataccaatatatgtgtatacaagtcataacactgtaagtagtrtcttaagggcaaaaatgtagcttcttgtttataaaacctaatgagcacttgaaaaaatttacactctgaaattaaataagaccttaataatgaggctgtgtatgactggtgatatggaggagcactgtgctggctccagaggggtgttgcttgtctagaatctaatatgctgcagaactggttggaaaacgggtcacaactggaaaagccaaagaaaagtttccattaacttcaagaaatactagggttcttgttcttggaaatcatctcagcttcctaaaacacaaaacaaaagtttaa

SEQ ID NO: 33240 - DNA, 601 bp, Human
gtgctattgtaaatcttggattaattaacaaaacaacaaaaatctatcacctggaatattgaaagaaattcagtaaaacaagatgtgtctcatagttaaggagagacataaaaataaaaatgtcatttaacagtttgaatttaggatttactgttaatcagaaacaccgaggaggcttagctcaccttttaattgagaatgtgggaaggaaagagagtaaacacattaactttagtagcagaagtgctgctaaaagaaatacgtgaaaggaaatgtaacagacaaattggcttttatcccytttgataccaatatatgtgtatacaagtcataacactgtaagtagtgtcttaagggcaaaaatgtagcttcttgtttataaaacctaatgagcacttgaaaaaatttacactctgaaattaaataagaccttaataatgaggctgtgtatgactggtgatatggaggagcactgtgctggctccagaggggtgttgcttgtctagaatctaatatgctgcagaactggttggaaaacgggtcacaactggaaaagccaaagaaaagtttccattaacttcaagaaatactagggttcttg

SEQ ID NO: 33241 - DNA, 601 bp, Human
gctgaaaactattaaccaaagtcttatttcttcatgctaaaaaggctctgccaagcagcgtcagtaacagcaacaatgaaaaataagattgcaggtgcataccttaacctcctgattggtaaagacctcgacatccaccacacaggcaaccagagtggaaacatcacagtccatgctaggggctggcattcccccttctgaatttttaataaagagttaggcaacctcagagttgggagtgaagggaagagcttccagatggatattgctgtggccaggcctcggtgctgccttgctctgrggacggctggaggctcgggctcctggagcccgctcccactgcacgcagccctccgcgtctgaggcagcacagcagagtaacgaacggcccggctcgctcatggcaatgacatcaccacaaagactgacacaagctgaagctatttttttttctccaagccttttatctctaggcagtgcagtggagcaaattgaacatgattatgtgctaaatctgaactcagactaaatcaattcaagcagcgttagctaggaactgagtcatagctgttgttgcagccgagtgcttatgtttgcaaaa

SEQ ID NO: 33242 - DNA, 601 bp, Human
tcaattttgcctccaggaatttcaacagagctatggtgtattgactcacaatagtgaatatacccagacttgttgagctggaatattctgatcattttcctaatctagataggacatggctggatgctgacaatctgtgagttataagatatcctcaaatcatgaaaataaatgctggtgatcatgcatgtcctgggaatgttgggatgcagaggactgagtgagaccagatagggatatctcatgcagtcaaagtcaagtttacatatggtcctatttaagtggccaggagagaacaacrcacacacatcaggactgggactgaaacagctcacaaacaacacaggtgctatttgttactgatgtctctggcttggatcaacatgagagaacaaagatataggctgtgctgattgtttaataagaaaatactacttttttccctagaaccttctaaataatgggttatacttaatgggtatgatatgatcaggagacatatcaccttttcctagcccttttgtccgagaggcttgataacaaggaaggaatctcaaacaaccaaacacccaggaatttaaaggcaattttttttgacaaa

SEQ ID NO: 33243 - DNA, 601 bp, Human
acaccatgaaacttttgtaataaataggtttgtctgaaatcagtctctatcaccctggacaagcctccccaacgaggctgggagagttctacaggggagtggtgtttgaaatctattgaggaatatctttggggccaaggtcaattttgcctccaggaatttcaacagagctatggtgtattgactcacaatagtgaatatacccagacttgttgagctggaatattctgatcattttcctaatctagataggacatggctggatgctgacaatctgtgagttataagatatcctcaaatmatgaaaataaatgctggtgatcatgcatgtcctgggaatgttgggatgcagaggactgagtgagaccagatagggatatctcatgcagtcaaagtcaagtttacatatggtcctatttaagtggccaggagagaacaacgcacacacatcaggactgggactgaaacagctcacaaacaacacaggtgctatttgttactgatgtctctggcttggatcaacatgagagaacaaagatataggctgtgctgattgtttaataagaaaatactacttttttccctagaaccttctaaataa

SEQ ID NO: 33244 - DNA, 601 bp, Human
agagctaccggtggacccacggtgcctccctccctgggatctgtaagtaacaacctttgagctctttctgttgtggtgtggatggaatctgcaccttccatctggagaactggggccgccccaggccgggcttccagcaccagagcgatggtcaggcttcagctggacgcagatttcaccccgcagggcacacgcagacccatttgtttggaagcggcagtcctaaggcagtgcaggtgcctccacggccccagcccagctctcctgcaggtgtaaaggatgcagattccagggccccccrtggcctgcagaggcccctcagagcaggaagggccgggctctcggggagcccccatcccaggtgctgaggtccttgggtcacatggagctggggtggggagtgcccaggtcccctgtgatccgatggccacgtttccctcctggcttcacgcaccccaagggctgggggtcccactcactgcccattttctggctgtggggggggtctgttttcttccaccttctcaaggtgttcagagcctcaggggcctccccacttcctctggggcctgggggagtagagtctgtcacccggaggctg

SEQ ID NO: 33245 - DNA, 601 bp, Human
tgtttggaagcggcagtcctaaggcagtgcaggtgcctccacggccccagcccagctctcctgcaggtgtaaaggatgcagattccagggccccccgtggcctgcagaggcccctcagagcaggaagggccgggctctcggggagcccccatcccaggtgctgaggtccttgggtcacatggagctggggtggggagtgcccaggtcccctgtgatccgatggccacgtttccctcctggcttcacgcaccccaagggctgggggtcccactcactgcccattttctggctgtggggggggtctgttttcttccaccttctcaaggtgttcagagcctcaggggcctccccacttcctctggggcctgggggagtagagtctgtcacccggaggctgtgtgcctccccgtgacattccccagtggccgggccgaccaggcaggctctgcctgtggatggggctgctgagcatgagcgtgtgacccccatttctgagctgtgggtggacccaccgggcctgggccaaggttttcaggaggcagctctattctactccgccatggtggcctccctgaaaggggtgagtgtagaagccagttcc

SEQ ID NO: 33246 - DNA, 601 bp, Human
gcccctcagagcaggaagggccgggctctcggggagcccccatcccaggtgctgaggtccttgggtcacatggagctggggtggggagtgcccaggtcccctgtgatccgatggccacgtttccctcctggcttcacgcaccccaagggctgggggtcccactcactgcccattttctggctgtggggggggtctgttttcttccaccttctcaaggtgttcagagcctcaggggcctccccacttcctctggggcctgggggagtagagtctgtcacccggaggctgtgtgcctccccgygacattccccagtggccgggccgaccaggcaggctctgcctgtggatggggctgctgagcatgagcgtgtgacccccatttctgagctgtgggtggacccaccgggcctgggccaaggttttcaggaggcagctctattctactccgccatggtggcctccctgaaaggggtgagtgtagaagccagttccctcttctgcgagccccacccctaccccaggaggacaattcttgttcagggagggtctccccacccacttccccaccccacagtggcccacaggccccaccctagagagt

SEQ ID NO: 33247 - DNA, 601 bp, Human
aattcttgttcagggagggtctccccacccacttccccaccccacagtggcccacaggccccaccctagagagtacaaggggctccccaggctgctcactggcccagccccgccccacctggactgcacctgaaaatgggctcagagaggccaagtggcccaaaaagacgctgctgggtgggaaggggcggtggcctctgtgcccgcagtgcccctcctgcctcaagggtgttgtctgcctggcagagcctggggtgttcacaaagcccaggcacctgcagctgagggcaggggagagggragggagccacatccaggcgacggggctgctcgtcctcctgtgcgagagtggggagactcaggccagcccaagtgggcggcggccccggttgcttgatctaagctctgctcacactgccctgcccttctgggagaggggtgggcgccaactgactcctgggctgtctgggctggggaccgggatctcagacccagcccctcccctggacaggaggagccagtccaggggacagagggctcagtggctggagggcagggccagggtgcggacacaagctgcaggtaccacagaagtttgctc

SEQ ID NO: 33248 - DNA, 601 bp, Human
tcacgtatccacggtgcttgccagtttccacggtccttgcttgcaaaggggcacctggacctgcatgtgactggcctgggagcagccaggtccagggagcggcagagctgaaattgcagctgggtctgggaagtagatggatgagaagcagccaagcccatgggtctgagacacagccaggcctgggaagtagctgaactcggggagtacctggcccaggggtagcgggacctgggaactcctgctccagagagctggtctgagccatgttcagcaggccctgtgtccccaggaggctgcrcccctggacggagtcctggccaacccacctaacatttccaggtgggtctggggtcctcacagtcctcaagggtgaggctcgaggggccctcgggactgagggtgggcagggcaccccatcccccagcatcccctcccccttcctcctctgctccacctcagatctgactgggctcaggactgcgggagggactgacacccctcaggtgatggcaactcccggcccttgagggcgtcacctggtcttggggggaggtctgcagggagcaccagggtcctttggggagaggtggggctgtgg

SEQ ID NO: 33249 - DNA, 601 bp, Human
tgggtgcccagcccgacccttcctgcagcctctcccctcgccaactccttggcttcccgtgtgcggaggtgtccggcctgagcacggagcgtgtccgggagctggctgtggccttggcacagaagaatgtcaagctctcaacagagcaggtcagtctcagttgggctgaggcaggtgggcacagctggggctgaggaattcacaggcagctctgcagtgcccaccttgccaccacggtcccctctgtccctgctgccatctctccccggccagttcttcccagagttcctctggccacccragctgaccactggggtgcctgtccacgtcaggggctggctccccaggagcaagtctgatatgacgctgtgtgctgggccccctcctggagcgccgtgggcagccctccaggctctgccccaagggtgaatctttttcgggggagtgggtgagatctggggaaggggagcggagccaggcacgggagcccccatcccccagggcagcgctgcaggcggccagagatccacttccacagattctcgtggccagggcaggggtgtgttgtggtgggcagactggccaggcgaccctggcccac

SEQ ID NO: 33250 - DNA, 601 bp, Human
tgtgcggaggtgtccggcctgagcacggagcgtgtccgggagctggctgtggccttggcacagaagaatgtcaagctctcaacagagcaggtcagtctcagttgggctgaggcaggtgggcacagctggggctgaggaattcacaggcagctctgcagtgcccaccttgccaccacggtcccctctgtccctgctgccatctctccccggccagttcttcccagagttcctctggccacccaagctgaccactggggtgcctgtccacgtcaggggctggctccccaggagcaagtctgawatgacgctgtgtgctgggccccctcctggagcgccgtgggcagccctccaggctctgccccaagggtgaatctttttcgggggagtgggtgagatctggggaaggggagcggagccaggcacgggagcccccatcccccagggcagcgctgcaggcggccagagatccacttccacagattctcgtggccagggcaggggtgtgttgtggtgggcagactggccaggcgaccctggcccaccatgtgagtggcggctcgaaacgctctgtgctggactccctgcccctgcagctgcgctg

SEQ ID NO: 33251 - DNA, 601 bp, Human
tcacaggcagctctgcagtgcccaccttgccaccacggtcccctctgtccctgctgccatctctccccggccagttcttcccagagttcctctggccacccaagctgaccactggggtgcctgtccacgtcaggggctggctccccaggagcaagtctgatatgacgctgtgtgctgggccccctcctggagcgccgtgggcagccctccaggctctgccccaagggtgaatctttttcgggggagtgggtgagatctggggaaggggagcggagccaggcacgggagcccccatcccccrgggcagcgctgcaggcggccagagatccacttccacagattctcgtggccagggcaggggtgtgttgtggtgggcagactggccaggcgaccctggcccaccatgtgagtggcggctcgaaacgctctgtgctggactccctgcccctgcagctgcgctgtctggctcaccggctctctgagccccccgaggacctggacgccctcccattggacctgctgctattcctcaagtaggccctgccccctgaacccacccccccggcttttgccgccagccctcagcccccaaccccctgcc

SEQ ID NO: 33252 - DNA, 601 bp, Human
ctcggcagttccaaaagcgctgaggccagcctctctgcagggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacgggtaagtgaaggtgtctggaacctcgaaggctcacctggcggcgtggtatcagcagcgtgaggacacytgcggccatgcctcaaggcccagggtcagtcacccccgccaccacccctgccaatgcccccagcgtcccctccacagccagggggtacggcctggcctcttccctctctggggctgcacgtggggggtccctgagctgtgtcccgtgtctgcacagccccccgtcgacatggtctgtctccacgatggacgctctgcggggcctgctgcccgtgctgggccagcccatcatccgcagcatcccgcaggtgagaccccgatccccagcccgtggggatgcccggccacccgaggctcagcc

SEQ ID NO: 33253 - DNA, 601 bp, Human
tccaaaagcgctgaggccagcctctctgcagggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacgggtaagtgaaggtgtctggaacctcgaaggctcacctggcggcgtggtatcagcagcgtgaggacacttgcggccaygcctcaaggcccagggtcagtcacccccgccaccacccctgccaatgcccccagcgtcccctccacagccagggggtacggcctggcctcttccctctctggggctgcacgtggggggtccctgagctgtgtcccgtgtctgcacagccccccgtcgacatggtctgtctccacgatggacgctctgcggggcctgctgcccgtgctgggccagcccatcatccgcagcatcccgcaggtgagaccccgatccccagcccgtggggatgcccggccacccgaggctcagcccaggtcctg

SEQ ID NO: 33254 - DNA, 601 bp, Human
gtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacgggtaagtgaaggtgtctggaacctcgaaggctcacctggcggcgtggtatcagcagcgtgaggacacttgcggccatgcctcaaggcccagggtcagtcacccccgccacmacccctgccaatgcccccagcgtcccctccacagccagggggtacggcctggcctcttccctctctggggctgcacgtggggggtccctgagctgtgtcccgtgtctgcacagccccccgtcgacatggtctgtctccacgatggacgctctgcggggcctgctgcccgtgctgggccagcccatcatccgcagcatcccgcaggtgagaccccgatccccagcccgtggggatgcccggccacccgaggctcagcccaggtcctgctcgtcctcagggcatcgtggccgcgtggcggca

SEQ ID NO: 33255 - DNA, 601 bp, Human
aggtgtgggaggaagaaggggtcaaacgaactccggccctgacccctgacccctgtgccctgcagagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgaggtagttcatgactcaagttcccaccggcctgctgtgtccaagccatccccagcccckctgggagtgacatgggccctcctggtctcttggcctgcagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtgaccgtccggctcgggggtcatgtggcatgagattgggaagggctgaggggcagagtgggggacaaagcctgaggttgggcgggcctggggtcaggggcacg

SEQ ID NO: 33256 - DNA, 601 bp, Human
tgtgacccaaggcagctggacgtcctctatcccaaggcccgccttgctttccagaacatgaacgggtccgaatacttcgtgaagatccagtccttcctgggtgagccagggagtccctggccagggtgggcaacacaacgggggaagcacagactccactcgggggtgccaggcctttgcctcgccgggccgtctgctgccagggtaactgggtggtcacccgccctctgccccccggggtgtgtatggccttaggggctgtgggttctgaccccagctcggggcgccagccacctccagrgtctcccacgcctgggggtcaggcggctaggcaaacccaggccctggaatccctaaggaaaaagggaagccctgtaaggcaagtgggcttcctgcagcctgtggtcaagggcctgggggtgtgaggtgaggcctcagctcgggcccctctcccggcgggcaggtggggcccccacggaggatttgaaggcgctcagtcagcagaatgtgagcatggacttggccacgttcatgaagctgcggacggatgcggtgctggtatggcgagcgggaggaggggcgtgtggaggaggggcccgtg

SEQ ID NO: 33257 - DNA, 601 bp, Human
atcccaaggcccgccttgctttccagaacatgaacgggtccgaatacttcgtgaagatccagtccttcctgggtgagccagggagtccctggccagggtgggcaacacaacgggggaagcacagactccactcgggggtgccaggcctttgcctcgccgggccgtctgctgccagggtaactgggtggtcacccgccctctgccccccggggtgtgtatggccttaggggctgtgggttctgaccccagctcggggcgccagccacctccagggtctcccacgcctgggggtcaggcggcyaggcaaacccaggccctggaatccctaaggaaaaagggaagccctgtaaggcaagtgggcttcctgcagcctgtggtcaagggcctgggggtgtgaggtgaggcctcagctcgggcccctctcccggcgggcaggtggggcccccacggaggatttgaaggcgctcagtcagcagaatgtgagcatggacttggccacgttcatgaagctgcggacggatgcggtgctggtatggcgagcgggaggaggggcgtgtggaggaggggcccgtggaggaggggcgagtgggaggaggggcgc

SEQ ID NO: 33258 - DNA, 601 bp, Human
tgggcaacacaacgggggaagcacagactccactcgggggtgccaggcctttgcctcgccgggccgtctgctgccagggtaactgggtggtcacccgccctctgccccccggggtgtgtatggccttaggggctgtgggttctgaccccagctcggggcgccagccacctccagggtctcccacgcctgggggtcaggcggctaggcaaacccaggccctggaatccctaaggaaaaagggaagccctgtaaggcaagtgggcttcctgcagcctgtggtcaagggcctgggggtgtgagktgaggcctcagctcgggcccctctcccggcgggcaggtggggcccccacggaggatttgaaggcgctcagtcagcagaatgtgagcatggacttggccacgttcatgaagctgcggacggatgcggtgctggtatggcgagcgggaggaggggcgtgtggaggaggggcccgtggaggaggggcgagtgggaggaggggcgcgtggagggggggcgtgtgggggggtgcgtggaggaggggcgcgtggaggaggggcgcgtggaggggggagcgtggggggcgtggaggaggggcgcgtg

SEQ ID NO: 33259 - DNA, 601 bp, Human
ctggggctggggctacagggcggcatccccaacggctacctggtcctagacctcagcatgcaaggtgggcggggcggccaggccagggctgggggcagagctgggggcgtggaggtgggcgctctgagtcacccctctctctgtagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtgrtccccgttccaccccaagagaactcgcgctcagtaaacgggaacatgccccctgcagacacgtcttgtggcctccgaggactttctgtgaccccaccagcgtggcccctctccctctggtcttgcgcccccaggccaggtgggggcccttggaggtcttcctgaccctgctgccactgtgctgagggccaggccagcactcagggtggccccaggagccggtggtgggagtcctgtgcccctgtccccacaggcttggccccggctaggacattcccgggcccccctgctcaggccctga

SEQ ID NO: 33260 - DNA, 601 bp, Human
acagtcacagcactgaaggcaggagaggaccgagctattctcctgggactggctatgatggtgtgctccatcatgatgtattttctgctgggaatcacactcctgcgctcatacatgcagaggtaataccactgggtgggtgggaccctgctgtttgtctcctgctccatcctcccccatcacttaggcaaccctaaggtcatcttcctcaccttctttcctgataagaactttgagaagttcctggtaaataatacttttcaataatgttatctaataataatgatacatatagctctaygtataatctggatagcaggtgtcaaagacttctacttctttaattatcacaattactctataaggtaagtataaatatactcactataaaaacggcaaaactgaggctcaagagagatatgatttccccagtgtcatacagctcttgcttgtggcagagctaagattcaagcccacatctcgcttattccaaagtcactgttcctgccacttcacacttctgtccgttccccaccctcctcccttttccaccccaaccaacccctccctcaccttccacgtgagtggttctcaactgtat

SEQ ID NO: 33261 - DNA, 601 bp, Human
aaggcaggagaggaccgagctattctcctgggactggctatgatggtgtgctccatcatgatgtattttctgctgggaatcacactcctgcgctcatacatgcagaggtaataccactgggtgggtgggaccctgctgtttgtctcctgctccatcctcccccatcacttaggcaaccctaaggtcatcttcctcaccttctttcctgataagaactttgagaagttcctggtaaataatacttttcaataatgttatctaataataatgatacatatagctctacgtataatctggatascaggtgtcaaagacttctacttctttaattatcacaattactctataaggtaagtataaatatactcactataaaaacggcaaaactgaggctcaagagagatatgatttccccagtgtcatacagctcttgcttgtggcagagctaagattcaagcccacatctcgcttattccaaagtcactgttcctgccacttcacacttctgtccgttccccaccctcctcccttttccaccccaaccaacccctccctcaccttccacgtgagtggttctcaactgtatattccaatttcccca

SEQ ID NO: 33262 - DNA, 601 bp, Human
ctgctgggaatcacactcctgcgctcatacatgcagaggtaataccactgggtgggtgggaccctgctgtttgtctcctgctccatcctcccccatcacttaggcaaccctaaggtcatcttcctcaccttctttcctgataagaactttgagaagttcctggtaaataatacttttcaataatgttatctaataataatgatacatatagctctacgtataatctggatagcaggtgtcaaagacttctacttctttaattatcacaattactctataaggtaagtataaatatactcaytataaaaacggcaaaactgaggctcaagagagatatgatttccccagtgtcatacagctcttgcttgtggcagagctaagattcaagcccacatctcgcttattccaaagtcactgttcctgccacttcacacttctgtccgttccccaccctcctcccttttccaccccaaccaacccctccctcaccttccacgtgagtggttctcaactgtatattccaatttccccagaaactcttaaaaatgctaatgcccagcccccatcatcatcaacccagaaggtcagatttaattggtcc

SEQ ID NO: 33263 - DNA, 601 bp, Human
atacccaaaaccaaaccatcaattgctggtgtgttaattcctaattacaaatgttaatcttgataataaaattaaaggtatttttaaatgaccagttgaccaatgggcagctggaatccttccaggtgagaggtaacagggcacccttattcatccattagtctgcataaaagggtttcttttccattgtgtttgtggggagacagcaaaacacaatagaatgagcctgggccttagagaattacaagattggatcacaatttccaacacttactgcccatatgtccttgcatatgtcatrggatttctcagttcactcacttttaagaagaaattactacccaacttgcacagctgttgagagaacaaaagaaggtaatgtatgtaaattaccaattagggtgaaaggaatgtgcagtaagtgattgctcatgacataatgaaagggttgagttatcttttttcccttattagaaagaccttaaggcattctgtcactgtccttccatctctgtcaagctggaccacatgaccctccactcctttgccatctctcccctccttctccctcacaccttctgtgcctacaaactgggctggg

SEQ ID NO: 33264 - DNA, 601 bp, Human
gagagaacaaaagaaggtaatgtatgtaaattaccaattagggtgaaaggaatgtgcagtaagtgattgctcatgacataatgaaagggttgagttatcttttttcccttattagaaagaccttaaggcattctgtcactgtccttccatctctgtcaagctggaccacatgaccctccactcctttgccatctctcccctccttctccctcacaccttctgtgcctacaaactgggctggggagggagctgggatgcagaaagtacaaagtaaaacatacagaggtaggggctggagcaygtcaagaagctgcctacaatgtagaaatacagggtgaggacaggtgatgattttaaaatatgcctcatgttaccagtgagttccataagggaaaaaagaacttaagtcaagcactggagaataccatatccaatggaagtcattgaaaacgttctcacgtgtccaagtttgtctatgttatacggtagtttgcttaaagctgttctattcgaaggcctaaactttacacagatagatcatattagagatttagaaaagatttttcagcttcaggagatgagaaataattccctcggacta

SEQ ID NO: 33265 - DNA, 601 bp, Human
gtaagtgattgctcatgacataatgaaagggttgagttatcttttttcccttattagaaagaccttaaggcattctgtcactgtccttccatctctgtcaagctggaccacatgaccctccactcctttgccatctctcccctccttctccctcacaccttctgtgcctacaaactgggctggggagggagctgggatgcagaaagtacaaagtaaaacatacagaggtaggggctggagcacgtcaagaagctgcctacaatgtagaaatacagggtgaggacaggtgatgattttaaartatgcctcatgttaccagtgagttccataagggaaaaaagaacttaagtcaagcactggagaataccatatccaatggaagtcattgaaaacgttctcacgtgtccaagtttgtctatgttatacggtagtttgcttaaagctgttctattcgaaggcctaaactttacacagatagatcatattagagatttagaaaagatttttcagcttcaggagatgagaaataattccctcggactatacctttctcactattagctcttgggcctgtgtttactctcactcctttctctgcagc

SEQ ID NO: 33266 - DNA, 601 bp, Human
cacatgaccctccactcctttgccatctctcccctccttctccctcacaccttctgtgcctacaaactgggctggggagggagctgggatgcagaaagtacaaagtaaaacatacagaggtaggggctggagcacgtcaagaagctgcctacaatgtagaaatacagggtgaggacaggtgatgattttaaaatatgcctcatgttaccagtgagttccataagggaaaaaagaacttaagtcaagcactggagaataccatatccaatggaagtcattgaaaacgttctcacgtgtccamgtttgtctatgttatacggtagtttgcttaaagctgttctattcgaaggcctaaactttacacagatagatcatattagagatttagaaaagatttttcagcttcaggagatgagaaataattccctcggactatacctttctcactattagctcttgggcctgtgtttactctcactcctttctctgcagcgtgtggaccgaagagtctcaatgcaccttgctgaatgcgtccatcacggaaacatttaactgctccttcagctgtggtccagactgctggaaactttctcagtacccc

SEQ ID NO: 33267 - DNA, 601 bp, Human
gtgatgattttaaaatatgcctcatgttaccagtgagttccataagggaaaaaagaacttaagtcaagcactggagaataccatatccaatggaagtcattgaaaacgttctcacgtgtccaagtttgtctatgttatacggtagtttgcttaaagctgttctattcgaaggcctaaactttacacagatagatcatattagagatttagaaaagatttttcagcttcaggagatgagaaataattccctcggactatacctttctcactattagctcttgggcctgtgtttactctcacycctttctctgcagcgtgtggaccgaagagtctcaatgcaccttgctgaatgcgtccatcacggaaacatttaactgctccttcagctgtggtccagactgctggaaactttctcagtacccctgcctccaggtgtacgttaacctgacttcttccggggaaaagctcctcctctaccacacagaagagacaataaaaatcaatcagaaggtaggaacttggcgtactgcatttcagttaccccacagagcttcacaccaggctctctgcctctgaagttcccctttgccagcatttcaaa

SEQ ID NO: 33268 - DNA, 601 bp, Human
ttatcctaaccaaactctacagttcccaacgtgctgttccattcactcttctggccaacctgtatgatggctggggggtgtggcaattgttgccatggtgaaacttacacagtacctctccctactatgtgagaggatccaacgggatcaataggataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaakctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttgaagacaatatttttcatcacttattgtttactaaagctacagccaaaaatatttttttttcttattctaaactgagccct

SEQ ID NO: 33269 - DNA, 601 bp, Human
accaggacctaacctcaagccatgttctctcctgatccactctcccataccggccccatctggcaaactcctagacatcccccaacaccccagctctaatgcccacctccttcaagatgtgccccaacaggccaggcatggtggctcacgcctgtaatcccagcactttgggaggccaaggctggcagatcacttgaggtcaggagtttgagaccagcctggccaatgtggtgaaaccctgtctctaccaaaaacataaaaattagccaggtgtggtggcgcgcgcctgcagtcccagccmctggggaggccgaggaaagagaatcacctgaacctcggaggccgaagttgcagtgagccaaaatcgcaccactgcactccagcctgggtgacagagcgaggctccatctcaggaaaaaaaaaaaaaaaaaaaaaaaaaaccatcatcctccagtgcggagaatcttattcattcgttctgtgccactcgccaaccaagagcccctagtctgatgtgggaggcatcctctcaaaacagggtcccgaggcaaatgcttgttaaacatgcagctgtaaccccaccgcagaccctggagtctgc

SEQ ID NO: 33270 - DNA, 601 bp, Human
ccttcccattgtacccaggagccacacctctttcgtgagctcctgccccttatgctacccaaagccccgcccctccgcgactgcggggccgcccacccaaactccacccacaaatccccgcccatctccacccaggaaccacgccccagccaagagccccgccccttacatgacccagtctcacccccctggttccatcatgcccctctggttacacccacaagcccctctctgagtcacgctcccgctctgaccatgccacatacctcttgcccagtgtgagcccccagaggcccactaytttccaaatcccaaccctacaaaagaccctaccccgtgatactccctcggaagtataaagacgcccttactcaggccccaccgccacccatgtgacctgtcctgggctggaggccccgcccctacgcactgcggcagcggccccgcccctccagcaggccccgcccctccagcaggccccgcccccgcaggcctggccctcacgcattgcggtagcagccccgatacgtcacgctcaggtccgggtggtcccgccccaggccccgcccccgcctactgcggcagcagcctcgatacatga

SEQ ID NO: 33271 - DNA, 601 bp, Human
acccctcaggctccacccacaagccctgcccttcccattgtacccaggagccacacctctttcgtgagctcctgccccttatgctacccaaagccccgcccctccgcgactgcggggccgcccacccaaactccacccacaaatccccgcccatctccacccaggaaccacgccccagccaagagccccgccccttacatgacccagtctcacccccctggttccatcatgcccctctggttacacccacaagcccctctctgagtcacgctcccgctctgaccatgccacatacctcttrcccagtgtgagcccccagaggcccactattttccaaatcccaaccctacaaaagaccctaccccgtgatactccctcggaagtataaagacgcccttactcaggccccaccgccacccatgtgacctgtcctgggctggaggccccgcccctacgcactgcggcagcggccccgcccctccagcaggccccgcccctccagcaggccccgcccccgcaggcctggccctcacgcattgcggtagcagccccgatacgtcacgctcaggtccgggtggtcccgccccaggccccgcccccg

SEQ ID NO: 33272 - DNA, 601 bp, Human
cacgaggagatgtaggtgacgttgttgttgccgcaaagctcctggccggggctggagggcacagggcagggcgccgctcgacacaccacgcagtgggcgctgcccgtctggtccacgacgcacgactgtggccgcgggcacaccacgtgctcacaggactctgcaggccgggtgccaggggaagttcaggggacatctcgctgagaaccccgcagggctcttggccccaagacccacccttaacccccaagatgcgaaaaccctctggtaggagacacaagcacccccccgcccccccgtragcccccctctccattccacccctcaggctccacccacaagccctgcccttcccattgtacccaggagccacacctctttcgtgagctcctgccccttatgctacccaaagccccgcccctccgcgactgcggggccgcccacccaaactccacccacaaatccccgcccatctccacccaggaaccacgccccagccaagagccccgccccttacatgacccagtctcacccccctggttccatcatgcccctctggttacacccacaagcccctctctgagtcacgctcccgctctga

SEQ ID NO: 33273 - DNA, 601 bp, Human
agaccctccatactcacccaggctagaccctccatactcacccaggctagatcctccatacacacccaggctagactctccgtactcacccaggctagaccctccgtactcacccaggctagaccctccgtactcacccaggctagaccctccgtacacacccaggctagaccctccgtacacacccagactagaggcttggggctgagaaaagcagtcatgcctcttcaggaattaccagcagagaatgcccagccctcttgatagtagcaataattaataggtttatccccaaaggagmggaagtgtggaatcctccccggcaataggtcttagggtaggggctggggcatcctagagaagggccctaaatcaggcgctcagtgtccggaacgcaggtctatcccacccaccagccggcccccaggcctcccttcctcagtccttccaggatatcgtcagggaggttctgggatccccaagtggtccgaatccgggctctaaggagtgtccgtggcatataaattagactctgctgtggcaataaataacaggggatgatggggggcctcgggcaccaggcccaggcctgtcctgcagg

SEQ ID NO: 33274 - DNA, 601 bp, Human
cttgggctggcagggaatggtggcagccttcttggccttcatgaagggcctggcttgctgggctaaggtcacagtgttctgaggtccccacacgcactcagactagaccctccgtacacacccaggctagaccctccatactcacccaggctagaccctccatacacacccaggctagaccctccatactcacccaggctagaccctccatacacacccaggctagaccctccatactcacccaggctagaccctccatactcacccaggctagatcctccatacacacccaggctagacyctccgtactcacccaggctagaccctccgtactcacccaggctagaccctccgtactcacccaggctagaccctccgtacacacccaggctagaccctccgtacacacccagactagaggcttggggctgagaaaagcagtcatgcctcttcaggaattaccagcagagaatgcccagccctcttgatagtagcaataattaataggtttatccccaaaggagcggaagtgtggaatcctccccggcaataggtcttagggtaggggctggggcatcctagagaagggccctaaatcagg

SEQ ID NO: 33275 - DNA, 601 bp, Human
gtcctctccccatagctggtctgaggctgtggtttacacgcaggcacaggtaggcgattctgagcatcaacgcagatggaggggagggtgagccgtcgtgggagaactggcccaagaccagcacctggctggtgtcgccagccccggctgcattggtgggtgaggcaggtctggctggagtctgggtctgcaggcctggccggggcaggttgtgggggaccaaggagccctgggtgtgaaccccactgtggaggcagcaggcacctagtggtgccactgggacacccggctccaggactcyggatgtcacacatgcgtgagtcttggcgtctacacccccctcggggccagtgggtgagcagtggcccgtggtccccgccagagctcccccagagtggacttggctccgccggacacagtgccctgctctgagctgccgctggctgctccacgtctgagaccacgcgacgttgcctcatgaactgacgtggacagcagcaggggagacgctgggtggttctgtggccaagcacagcccgtgtcaggagcacaggccgtgccctttcccagggggcacactgggcatttctcaatggccttc

SEQ ID NO: 33276 - DNA, 601 bp, Human
gggtctctcttcccgtgcctccagagcacccatgcggcaccccaggccccaggctgcccatcccacagccgtgggggcggcctgaagccttgagagaggagacaaactgaggcctggacaccccaaaatggcttctttgagtctttatttccttggtgaggcagggccccagggtggggtgggctgcctggctgaggctcctgtagacccaccaacctaggggcacttttctgggcaccacaggtaaggcactgcctgggggctggaggaggctggaggaggatgcccaagctccccacaytcctcaccccagaccggggaagctggatatcctccgtgttgtcctctccccatagctggtctgaggctgtggtttacacgcaggcacaggtaggcgattctgagcatcaacgcagatggaggggagggtgagccgtcgtgggagaactggcccaagaccagcacctggctggtgtcgccagccccggctgcattggtgggtgaggcaggtctggctggagtctgggtctgcaggcctggccggggcaggttgtgggggaccaaggagccctgggtgtgaaccccactgtggaggcagcag

SEQ ID NO: 33277 - DNA, 601 bp, Human
gaacagtggagcagattggtcacattctcgtgagctgggtatgtagtgagttgttgaccccagatacagtttcttacagatgtgccatgttgcagtttctgatgaatatgagacagatttgatcccacaactctgttctacaaacacataaggcgttaaaactgaacaaatttacagtgacataagaagttacagtctgtttaaaaaaaaaaaaaaacaccttcattaatgctataggttcatttgtgttacaaatacgttcctgcttggatagaattcccacatcatgtgtgattatccrttgcattctgtcatgtatgtttaagcgcatgccaaatgcggggcactgtttgaggaggagtcgctgggagtcagtgatgaaaggcagtctctgcctttatagcctagtgaaggaatagccaagcacataaacagtctcagggctggtggcaaatggaggacactcaagtgtcctgggagcacagactgccagtgtctgaggttggaggggagtagaagtcatgaatcttcacttggatttagccaaattatgaaaatttgaagagcattttgatgattgctaaaatgctattcagcttcc

SEQ ID NO: 33278 - DNA, 601 bp, Human
gtcgcctagtcaaataccctttactgttaaaagaaattcttaaacacactccaaaagagcaccctgatgttcagcttctggaggatgctgtaagtagtcccttaagtgattgttttgttttttaagtttatacattaggctgctttagaacgttatcttctgaagatgctgattcacatcagcatagtgaattgttttgttgttttaagtacccagtgcgttagtacgctgtgcactaagcaataaggagctgtgtatgctggacttcgcacattttgtatcttaagggacaggattctcmtctgatctcaccttgtcacctttgaacaaatcactcaatttggctaggactgtttcttgatctataaaatgaacagactggcagaattaactgatttctagagtcccttcaagctttaaagttcttccattccatatgacatttttgctctgcaggaagcagaatgagttaataaactgaagctgctctgtcaattttatttatcattttcagatattgataatacagggagtcctctctgatatcaacttgaagaaaggtgaatccgagtgccagtattacatcgacaagctggagtac

SEQ ID NO: 33279 - DNA, 601 bp, Human
gaaagtggtttttcgcactacataacaaatttctgaagcagattgaatgaatgcaaatgtattttttaaatgctaattataaaagtacctgctagaactaagtgcagtcacggaatggtatttttgtttcatcatgcattttcaaaagcccaatttataagttggagttttgtttaaaaaaatttgaaatctgacatctttgatttttccctcacgaggggaaaatttataaaggtataaatttgtgtgggacaaaatagaaccattaacattttaccagcttgcatttttaatccctccttcgtgttagaaaactgtggtatacaacgctagtgtttcaagtcatgttgctactaataggtctttgtgatgcagagcattcacttagctgctgcttaatctgatattacataccaataagaaacattttatttattctgagattggaaaaactttccaaatagaacatgcttagccttgaaattgccatctttatggattactagatttgtcacttagagagatcttcgaaaaataaatctgatgaaattaataatgtcgagttattttagcaatatatttcagtcacttaaaaacacaa
